United States Patent 7,745,391 (HUMAN THROMBOSPONDIN POLYPEPTIDE) - sequence listing, part 243

SEQ ID NO: 673017 - DNA, 492 bp, Homo sapiens
  misc_feature (123)..(123): n is a, c, g, or t
  misc_feature (135)..(135): n is a, c, g, or t
  misc_feature (299)..(299): n is a, c, g, or t
tttgtggaatggatcccaacaatgtcaagacacccgtttggacatcccccctcgtggcctcaaaatggcagtcaccttcattggcaatagcccagccatccaggagctcttcaagggcatttnggagcagttcantgccatgttccgccggaaggccttcctcccttggtacacaggggagggcatggacaaaatggagttccccgaggttgaaagcaacatgaacgccctcgtttttgagtatcaccagtaccaggatgcccccccaaaaaaggaggaggatttcggttaggaggccnaaaaggaggcctaaggcaaagcccccatcccctcagggttttcagttcccttaaccgttttaatcaaaggcccctttcctttcccccaaaaattgggtttgcggccccaatcttgttttttgtttttttttttggggggggtttaaaacagggcctggcacaaagtaggcgcccaaaaaaaacttgtttgtta

SEQ ID NO: 673018 - DNA, 282 bp, Homo sapiens
gtgggtacagcatgtgcttttagaagactgaaccagattatactctcagaatctgttgtttaaaaccttcccgtagtctgtgcttatgtgtgtgtgtctgctgtgggttcttgttggtttgtgcgtttgtttgttaggtgagatggagtctccctctgtcacccaggcgggaatacagtggtgtgatctcggctcactgcaacttccacctccctggttcaagcagttctcctgcctcagcctttcaggtagctgggattacagtcacatggccactcaata

SEQ ID NO: 673019 - DNA, 922 bp, Homo sapiens
  misc_feature (48)..(48): n is a, c, g, or t
  misc_feature (69)..(69): n is a, c, g, or t
  misc_feature (74)..(74): n is a, c, g, or t
  misc_feature (89)..(89): n is a, c, g, or t
  misc_feature (91)..(91): n is a, c, g, or t
  misc_feature (185)..(187): n is a, c, g, or t
  misc_feature (208)..(208): n is a, c, g, or t
  misc_feature (258)..(258): n is a, c, g, or t
  misc_feature (262)..(262): n is a, c, g, or t
  misc_feature (270)..(270): n is a, c, g, or t
  misc_feature (281)..(281): n is a, c, g, or t
  misc_feature (306)..(306): n is a, c, g, or t
  misc_feature (316)..(316): n is a, c, g, or t
  misc_feature (321)..(322): n is a, c, g, or t
  misc_feature (390)..(390): n is a, c, g, or t
  misc_feature (405)..(405): n is a, c, g, or t
  misc_feature (418)..(418): n is a, c, g, or t
  misc_feature (449)..(449): n is a, c, g, or t
  misc_feature (460)..(460): n is a, c, g, or t
  misc_feature (473)..(473): n is a, c, g, or t
  misc_feature (484)..(484): n is a, c, g, or t
  misc_feature (502)..(502): n is a, c, g, or t
  misc_feature (519)..(519): n is a, c, g, or t
  misc_feature (521)..(521): n is a, c, g, or t
  misc_feature (822)..(822): n is a, c, g, or t
  misc_feature (836)..(836): n is a, c, g, or t
  misc_feature (842)..(842): n is a, c, g, or t
  misc_feature (845)..(845): n is a, c, g, or t
  misc_feature (884)..(884): n is a, c, g, or t
ggtgctatccacccctgcctgttactggctctgaagggcactcctcancttccccaagaaagaggacgngtctntgacactgtgatgantnggagcgggggttcaaacagaaagtgtttgggccctccttctaagtcttgttaccaaaaaaaggaaaaagaaaaggtcttctcagttacaaattnnnggaagggagactatacctggntcttgccctaagtgagaggtcttccctcccgcaccaaaaaatagaaaggntttntatttcantggcccaggtngggggaaggagagtaactttgagtntgtgggcttnatttnncaggtgctttcaatgctcatcaaaaccaggcatggggaaggccctggcaaactgctccacccgttgcntgaggttggccagangctgacttgtttntgagttcttaagcaggaaggatttgaaatcntggagcttggnagttttgctcttnacctctaagcnaatgttgaccccttcatntataaagtccacaactntncggaagttatcctcacggaactgtcgagaagttaaggctggggcccaagccgcagcgcccggtgtgatggcacttcggtctccaggacaggtgttcttgttggcagtgatggatacaagctctagcacccgctcagcccgagctccatccaggcccttgggcgcaggtccaccagcaccaggtggttgtcagtaccacctgataccagtgagtagcctcgctctagcagggcatctgccatggcccgagcattcttcagaacctgcagggagtactcccggaacatgggggtgcaggcctnctttagggccacanctactncancaatggcatgattgtgggggccccctgcagggatggganacggcaaagttgattcggtcctcaaatgtgtaagggat

SEQ ID NO: 673020 - DNA, 554 bp, Homo sapiens
  misc_feature (21)..(21): n is a, c, g, or t
aaacctcttgaccttgcccanggtgctgaaatgaaacacattcttgttggtaataaggtcatctacaaagcattgaaacgatatgagggccctctctggaagagttcaagattttttggctggagattattctgggtagtgttagagcatggagtcctttcctggttttaggaaacagcctgatgcagttcataatatttatcgccagggatgcaaacacctgaatccagccgtttgccccggtaaatcccatggttggctggccttcttcctttttttaatgtgcttggttgacacctctctcttggcttccggggttcccttaagaattagcctttcgagcagtctcaacgacgaggacttggcttggaagcaatagaagaacattctggcttacagcactcactactgttcccaggaccagctgactgatgaggaggaggaagatacggtttctgctgcagacctgaagaaatcattagagaaagcacagtcatgccaacagcgactagatcgggaaatttccaactttctcaaaatgattaaggagtgtg

SEQ ID NO: 673021 - DNA, 872 bp, Homo sapiens
  misc_feature (1)..(1): n is a, c, g, or t
  misc_feature (61)..(61): n is a, c, g, or t
  misc_feature (76)..(76): n is a, c, g, or t
  misc_feature (91)..(91): n is a, c, g, or t
  misc_feature (93)..(93): n is a, c, g, or t
  misc_feature (97)..(97): n is a, c, g, or t
  misc_feature (136)..(136): n is a, c, g, or t
  misc_feature (146)..(146): n is a, c, g, or t
  misc_feature (148)..(148): n is a, c, g, or t
  misc_feature (165)..(165): n is a, c, g, or t
  misc_feature (180)..(180): n is a, c, g, or t
  misc_feature (186)..(186): n is a, c, g, or t
  misc_feature (189)..(189): n is a, c, g, or t
  misc_feature (201)..(201): n is a, c, g, or t
  misc_feature (203)..(203): n is a, c, g, or t
  misc_feature (213)..(213): n is a, c, g, or t
  misc_feature (218)..(218): n is a, c, g, or t
  misc_feature (230)..(230): n is a, c, g, or t
  misc_feature (238)..(238): n is a, c, g, or t
  misc_feature (241)..(241): n is a, c, g, or t
  misc_feature (269)..(269): n is a, c, g, or t
  misc_feature (274)..(274): n is a, c, g, or t
  misc_feature (278)..(278): n is a, c, g, or t
  misc_feature (284)..(284): n is a, c, g, or t
  misc_feature (288)..(288): n is a, c, g, or t
  misc_feature (329)..(329): n is a, c, g, or t
  misc_feature (350)..(350): n is a, c, g, or t
  misc_feature (353)..(353): n is a, c, g, or t
  misc_feature (368)..(368): n is a, c, g, or t
  misc_feature (373)..(373): n is a, c, g, or t
  misc_feature (434)..(434): n is a, c, g, or t
  misc_feature (457)..(457): n is a, c, g, or t
  misc_feature (480)..(480): n is a, c, g, or t
  misc_feature (532)..(532): n is a, c, g, or t
  misc_feature (539)..(539): n is a, c, g, or t
  misc_feature (570)..(570): n is a, c, g, or t
  misc_feature (600)..(600): n is a, c, g, or t
  misc_feature (825)..(825): n is a, c, g, or t
naaatcttcacatcagggggagagtttgaatgattaaaaagaagcagctttttcaagaaanggggggaggagaaanaattctaaacctgtnanaacngaccaacccattaactaaaaagtatctatagattaaaanaagaaaaaangngagggtgaagaaaaggnggaacatgctaaaanccttanganaatcatccaaangngagggaagancaacngattcaccaacnccactttntcnattttacaactttctacatctcactctngattngggncttccnggcngaaacagcctggcagtccctagagcccctgagaagagcccnggttctccaaaagacagaggnggngaagccctgcaggangcgcngaccacttcccagagaactgacagtccgtgctcccaaaagtttgaaccaacagcctaatgngaaaagaaactgcactgaaaggnaaagggggaaatggtgatgaacngggcttatgtgagaatgtctatattttcataacacagccccagaatctttcnctcagtnacagcctcaggcaaaccacgttctggttggngggttctgcagggatctctcccaccactgngcctctagtcccaaaaccatccttgacaacatcgtgtgtctgtaacttccctttgcccacctccaggccacctggggaagcccacaggcagccaagaccctgaaatgaaatgaacacaaagtctgactcggtaagtattagtttcaaacagaacactaaagagaaaagttgaagctgcaatgtgtgtttaaggcagagcccagcagatccgtgtccacccatgtnccaataagacaatgggcaaagctacaaatggcaagaaaaaaatggga

SEQ ID NO: 673022 - DNA, 213 bp, Homo sapiens
tatcaacttccttacttagccccctaagtagtttgggtaaagcactcaccaccatgccaggctaacttttctactttttgtagagatggggtcttactgtgttacctaggctggtcttgaactcttgggctcaagcaatccacccacctctgcctcccaaagtgctgggattacagtcatgagccaacatgcctgggcagtacaggaaggttg

SEQ ID NO: 673023 - DNA, 219 bp, Homo sapiens
ttagaagttcaatagcaggcccagcacaggcgtgggcagggtgagatagggaggggtggaggaagtaatctggtccagggcgctcagagctgtgagatgatatggggtagcaggctgcaggtgaggcctgtgcctatcgcggttccacattcagtggccttcactaatgcacatccgtgtaccacccagtggagacacctcttgcagacgttcgattcc

SEQ ID NO: 673024 - DNA, 896 bp, Homo sapiens
ctggcggagttagaaagaaaaagaggtgaaactgcgggaccggtgctgctgagtcgctaggcttcgcctcaaactttgctgttgcatgcggagcggccccgaccctcctctcccctacgaggcccacgcagtctgcggatgacggcttgtcccctagctcggtgagcggtgttgggcagcaagcagctggcggcgagtagtcataaagcaggcttccgctaagcgcaaaaggctggcgtgtggcgagatttgtgcggcgcacaggaggcagaaggcacctaagtgcttgttcaggggcccaaggagagcttggaccacgaaggaaaagatttctcagaaccaattggtctcaatttgcaactaggaaatactcaattgaacccggggaacaggctgagagcacccttcccttaaagaacactgtggggtataccaattactccagctagaacagagcctgagggttctagtaccccgagcattcaggtcactgcgattttgcatgccttgactacgtgaatccttctgagaactttcactgcaatggtggacctctaaaggggaactgctttactaattggcgttgctgttggtccaaacagaacgacctacgtaattgggcattgtgcctaggtacgccgtcatgcgagggattgacccgacagggttgggtgatccccgggtattttttccctgccggtatttggttgcgcccagtgtccttggtgcgcttgttttccctcaagaaggttattgccgggctagccctggtgttggaaccacccagttgacatgactcactggggcgtcccctggatgtttgcgtggagcccggactcatagcccgtgtctttctcgttggctcactctttcagtggagcctcttgccttgcggc

SEQ ID NO: 673025 - DNA, 279 bp, Homo sapiens
agcccatgagagacactgatgtgtgtctcggggcttctgtgagaagagcttggttacccaccgggtcaggcaccacgtcggtgctgtgaggcatggagggtgctcacagctgtgcagtcagctacagaggcctttcccagcatccacatctgaccgggcagtcacaccaggatgagctcccaggaagagggctcccagcaagggagggcgcacctgggtgtgagcttggaggagggcagaggcacctgtcaccgctgaccctgggtgcagatgggcatg

SEQ ID NO: 673026 - DNA, 166 bp, Homo sapiens
gttggttacttacaatgctacctgcctctcttgaacaagacacagagatgtccatgaacccagtctaactatggtataatcctccagtcctgtatgtactccctttaagcctcctccttccactgagcctaaggcaactctatatcgcacccggggtggacccggc

SEQ ID NO: 673027 - DNA, 636 bp, Homo sapiens
  misc_feature (513)..(513): n is a, c, g, or t
aggtacacgggtgcagcttatgtctattttcagcacagagctgcttcaggttcaagaatccaggtccctggctagctgggacttctgatgcatgctcaaggtcccatatggaaatcacggtccctaaaaataacgggacttccttccctactggctagtccttgggatgatgtcttaaaaatccggtaataaatctccctcctcagaccctcttgaaggcaaatcagtttacacaaagggtacttcagcggctcacagtaaaatccctacaatgtgcattaggtggtaaaatttaagaaaaggaacctaatttttactaattaccattaatctaggctacaaggccaaaatattatttggtacttcggtaattccttacatgtcaatggtgacataaccacacaaagctgggttcaaataggtaagcgtttcatcatggcagtgtacggcgggtgaggttgcagcacacatcacatacggaaggggggggtgctcggtttcaccatccatggnaaggcggaatctcccggcttgaaatggggcaatgccaagacatcacggaaaagcaaaaaatcagcactgaccttactaggggttgaactatgtgctagagcatatcatcctgaacgaccaatc

SEQ ID NO: 673028 - DNA, 120 bp, Homo sapiens
atgggtatatatcagctaaggtggattgttgggtcgaacggtagctctgtttttgttttgttttttgagatggagtttcgctcttgttatccaggcttgagtgcaatggcacgaccttgg

SEQ ID NO: 673029 - DNA, 172 bp, Homo sapiens
tcccatttcccgtgtctcctcggtccccccgtttttgggcttgaccattttccactttttgcatgcgcccggggcagacttttttcaggggcttgggttttgttttccgttgccacccgcccaccccccttttgggatggaattttattaaccccccccttgggggccccca

SEQ ID NO: 673030 - DNA, 397 bp, Homo sapiens
  misc_feature (316)..(316): n is a, c, g, or t
  misc_feature (330)..(330): n is a, c, g, or t
  misc_feature (380)..(380): n is a, c, g, or t
cgtggcgtagtgcatggtactggaactgctggacatgtactgctgacctgcagaagcaagccagaactgaagcagcagttgacaggacattcaaagcgtgtggctggttccgtcactgagctcatccaggctgctgaagccatgacagggaacagatatgcgtgtagacccagaggaccccacgagtcagttgctagagaatgagtctcctggaagagctgcagtccgccgattgagggctgcatgccgaaaaagctagtagcagcgtgaagccgccgggccaagacccaagtgaggcgagatgagtccttgaacntttagaggagcagnatactagatagctgccaatgctccattgcagtcagccaccgagtgcactnggtaaacggctagcgtc

SEQ ID NO: 673031 - DNA, 1138 bp, Homo sapiens
ggacatgttagctggccaataaggtgccagctgctgcccgtgctggctgccattgccccatgtgaagtcactgtgccatgcccagaacactggtctcgggcccgacaagacctcctttttccaggctttaggtatcaccactaaaatctccagtgggcaccattgaatctccttgggtgtccgcaatgttgccacgtgtctgtctgcagattggctacccgaacgtgttgcgatcatgtaccccattctatcgatcaacctggtgtacgaaacagagtcctggctcttgtcctgtggagatctggattactacccgttcccacttgtctgaaacaggtcaagggccttcttggcttgattccatctgcctttgtggctgttgctcccttgtggctgctgactaccacagctgctcctgctgctgtctgctatgcccctagactagaggttagaccgcctaagtgaagacgtcggtagtgcatgtcggacgacggatagtgggagttgttggtcatctttgacctaatcatccaaagaatgcaaccaactgtatgccccgttggtatgtatgcgaaaacgagcggatagagtaatacggcgttacgttcctttatcaaacaatggatatgacagatagcaaaagagcgctataatcggacctccaagcggtgagtccccagctcaaataatattcgcgcccgggagggtgccgagcatcagaacccagcctcccgaatgtttacggaactgagccggggaccctcatgttcagaggggactctcattgacacgccgaatagaccctggcaccgacatgttgccaatgcgcatccatttgggaaaacttctggtcctctgttccctgacatgctgtacaaaggccctgtcattacactgcattgtgggcgtggtcacacatcctagtcgtggagccaccaccaaccacctccaggggcaaagtctttatgcacaaccagtccctgagggggcaacaataacaggacctatgtctcatggtcgcgccaccacatcgtgtgttagaacccactcgcacccaggtatacatttgctgtcaggagagacccacacgccggttatacagattaccagacgacggtaatagtttcttcgtaacacc

SEQ ID NO: 673032 - DNA, 999 bp, Homo sapiens
  misc_feature (701)..(701): n is a, c, g, or t
gtatttttagagacgggcattcatcatgttggctaggccggtcttaaattcctaacctcaggtgatctgcccacctcagcctcccaaagtgctgggattacaggtgtgagctgccacgcccatccaagcactagttttcatattgcatattcataattttatgtttgatcatattgtggattttcttaattggctttaacttctgagttaggtttttaaagtgttataaaattttgtgtggttaattttcttctgccaccagttagggtccctaacagagactctcatgtttagaaagttagaaaccaaggccacgggaagaatctctggcagaaaagaagtacacctctcaagggcagggggacttagacagtgtgctctcccagttgaattttacccatactagtgaggaccttctgcaggcagaggtgacttgtcttgaagtttggaatctgtgagtgcaacgtgtaaaacagctgagccaagaactaatggaaaaatatgaagaactgaagaggatggaagcacataacaatgaatacaaagcagagattaagaagttgaaagaacagattttacagggtgaacaaagttacagttctgcactaaaggaatgaagatggaaatctcccatctaactcaggagttcatcagcgagatattactattgtttcaccaaaggttcttcctccggacatggnaaaagcgactcagagccgagatgccaaagggcgaagaccagcgtgagcctaacgagaatctgggtcactggaggcccccaaatttgaaaaacgttctctgaaggtgcggacacggacgggtgcacaagggctccgcagtaccccgggaatagcccactggggaggaggaggcgcccaccatgacggggcgccgaagcaaaaggaagagagccctgtgctgtctaacgcaacaacacagcgggtcagcacatgagcacgagcaatgtgtaccacaacacacggtagaccagctctatag

SEQ ID NO: 673033 - DNA, 326 bp, Homo sapiens
taaatcgagctcggccgaagtctacggatgggtatgaggatgactcctgtgattaatagtatatctgctcacacctcatatcctccctactatagcctagaatgaataatatatactgctgatacatatatagctactctacataacacctcaacacccactcacctcttagacaatattgtgcctattgacatactagtctttgcctggctgcgaagcagcagtgggccccgccctactagtactcaatctccaactcttatgtgcctatacctactgtacataaactacaactactccaatgctacaactaatcgtcccaactg

SEQ ID NO: 673034 - DNA, 282 bp, Homo sapiens
aacatttccatctctcctttcccagagtaaatcagcccctgggcctggccagggcctcacacaagtttgcctggtggaaatcttcctcagctcaattggtttccttaaaggttggaaccctccttccgggttgaaggtgtcctaacttctagttggaggtttccctaagcgcactttctaaagccgggccagtttccagacacaccacaccctcggtagagacacagatttcccaagagcctatatgtcccccacggagagacacacccagaggtctgcaca

SEQ ID NO: 673035 - DNA, 297 bp, Homo sapiens
gcactgacattgtcaccccactgacgaggcccgattccatagggagtatccttgccaggcgctcctgatcctccctgcggggtcttccttcgtgagctggtcgtgcttcccatcctccaagtgcctcaccagacccccagactgggtgaaggtacagctggctcctttcgggggggcagcttcaactctctcggcgggagggcggggccatccccacccatagggctgtctcacatccagtcactctcaacagcggccagcacacagataaaagacccttgggcacacattatggag

SEQ ID NO: 673036 - DNA, 242 bp, Homo sapiens
gctgcctggagccccaagatcaccccttcctactacaccacttctgacggttgtcatttccacttgagaccgtcttcattgtggagatctccctgacatgcaagaccagggtccaggacatgtgctctctattctgacgtcggtgagaaacaattccctgtcactcgagggccacggatgtcgggcgctatcagagtgtcccgtagcctgtgagcacaggagcgcccacgcagagacctctc

SEQ ID NO: 673037 - DNA, 2444 bp, Homo sapiens
  misc_feature (793)..(793): n is a, c, g, or t
caccgcacgctggccggccgcgcggtacagcagcaccgccagcgccgcctgcgccaggctggccagcagcagcagcgcgcccaaggcgcacccggcccagcgccgcgcgggctccggacgccgcgccgccgcacgctccgcctccgagccgctctcgcgcagcacctgcacctcggcaggcgccagcgccagcgcgctcagctgcaggcctcgcgccagcgctgccagcgccagcagcccggccgcccccaggcccagagcccagggcggcgccgcctcctcagccgccccgccacccggctccacgcgcaccgccagcagcgccgagtgcgggcgcacggcctcggcccgcaggcgcaagcgcagcagcgcgcgccactcgcccgcgggggaggccgcctcctcccggcagcccgccccctccggggccacccaggaccaagagctgttggcgaagcccgggccgaagaggcgcaggaggaaggtggcgtccggcgtgtcccgcgccgcccctccgcgtacccaacccgcgcccgccgctccatcctcctccaggcagaagcccagcactcgcgggcccggcgcggcctcccccgcggcgttgcccaggcagagcgcggcgaacaaccagcctaaccgacccgccgcagctaccgccgccgccatcgcctgctgccccctctcggcctctcgcgcagcctaccccgctcgccccgcgcctccccgggccaatcgttacggctcttcgcgcctcctcggccaataggcggtgggcgggggcgggccccagggncggactaggctgcgccggggagtaaacaagtggcggccagggcgggccgggggcgtggggctccgggccccgccgagtctgctgcggctccggatgcgcggggtggcagtggccgggaggacgcggggcggcgggcagggcctcccaagcccggctgtcctcggcccgtgcgcggcgcccggagtcccactcctcccgatgctgtcccccgcgcccggaggccgagccaattctctgggaagttcccggcttgggagcggagcggccggtcggaagaacctcgggtgctggcgcgcctgaagttgcagaccagactgaaatgtgcgagacatgtgcctttttcttaggaaaggccccaggtaccagaaaggttttcagcgcgccgacctacggggctaagagggctgaaataagaaccagtgactgagcgccgggaggtttaaggtttatggaagatgttcatcgcgccgtaccctactagaggtttggggacgtgggacacagcccctgcgttcccgccgcggaccccgtgataaatacacagacacacaaaatcactaccgccttgaatctggacagctacctcaggtggttaatatctaacaggagcagagtggagctcagaaagactcagcgtgggtgctgggttccggcgcgaccagcctgatacctaggtcagcatctcagccacacaagcaggcggcagttctgtcaggaattactacatctggtgattccacttctcatagctcaccgctgggagaataattcctcaggattaacaagatctattccagaggatcctcactgctgaagcgattttagaagacagtgtggtctgttgacagtatggaatattctttacccatcagatatgatctgtatgtgattggaaggaaataaaccaactgctaacaacacttctctatagatgttcagattcagtaatttcggtatttcttctctacacttatgtacttttcaaatttcctagcacaagaagacttcgacttactgcacatgtcattttacaatgacctttcatccagactctatagaacacactttgctatgtcatgacccgtaacactcacacacaccccccacacgacaccccccccttgacccaccgacacagccacatcaacaaagcttcacaacccacacgacgtagcacaacaccccccccgaaaggaacgacacaacagggaccaacagcgacatcccaagagaacacgtgcacctcgaacacaaggccgcgcaatcacccccaatcaacaaaaccgcggggacacacagacacgccaggaacaaaaccacagacgagcaacagaggacacacggggcgcaatacaacagcccaacgcacccgacaccaactgccgtccacgcggacaagcacgaccgcgagagaacacagacgcagacgacaacacgagaggaggacacacagacacacgcaccacgcaggcagcctacagcacaccacagcaacccaacacgagaccaacccgcccccagtcccgaccacacaccccacccccccagcagcacagacgagcagggagaccaaaacacgcgccaggcgcacagcacaagacagccaccaccccccgcagacacccacgcaagccgcacgcacgcagtatgg

SEQ ID NO: 673038 - DNA, 478 bp, Homo sapiens
  misc_feature (17)..(17): n is a, c, g, or t
  misc_feature (29)..(29): n is a, c, g, or t
  misc_feature (113)..(113): n is a, c, g, or t
  misc_feature (187)..(187): n is a, c, g, or t
  misc_feature (273)..(273): n is a, c, g, or t
aggtggccccggggaanccgatgtgcccncggggcctggccggggggaagaaccccccaaacggtggccagaaaaccagagcctccagggcctggcctaaaaattacctaagncgggaaatattttaaaaagtgtccagaataaatgtgaatgtaacaaagagaagtaatgcccgatgcatttccantgtttttgccattatcctgtatccagtatttccccattgcctagccccgaataatcaagacccagactgtttccttgtcactggantcctggaagccttgccctttcaactggatttatgtttgtttctgctgctgtgaaaccccaaagtaatgcagtaggttttatgtttgtttctgctgctgtgaaaccccaaagtaatgcagtaggttttaattgaaaattgtttaattctattattgataattatttattgtaataaaagtaaaagagtaatttttaaatcctttta

SEQ ID NO: 673039 - DNA, 451 bp, Homo sapiens
ctggttgcagcccgctgaggcagatcttagaggcgacagtattttactgtcacacatttgcaaggatctctcagacagaattgcttcctaaataccatcacaaagcaatgcttaatgtcagcgttgcaaagcatttctgacagtgtggtttgaaaatccggagcagactctcggctcttcagggatgttctggcaacatagctgtgtgttcccagggcctctgaaggttccggctgggcctctgcagcgacgcctcaacggccctgaggaggaactctcgccgctaacagcatgcaggattcatttcctgtgcacagctacacacactgaagaagtgtaattaataaattatacctaggacgggaacagatcaggggacaagcagaggctcttcacaccttagatcacgcgtggtaaacttctataaaatgtcagacagtaaataattagg

SEQ ID NO: 673040 - DNA, 359 bp, Homo sapiens
aaggccagtttttttcccttcaattcctcaagtctggagggtaacaaggtaggggctaggtactgtcctcccacaggtttttaggaattaacgtgtttctcataaaccccaaatgttcggggaaaacggggaacacccactcacaagctaatttatctgcttaaatggaaagtgtgggagcctctaccctctcttttgatctgccaaggatttcctctcagagctgttgcacacacacacattggccttggtaagatacccaacaagccacatacggatctaaatttctaatgtgttcgatgggtttccattccgaaaaaaggaaatgaataaagatttctaatgaatgtaaaaaaaaa

SEQ ID NO: 673041 - DNA, 142 bp, Homo sapiens
cggagggggttaggtgggaggcgtttccctgctttcagggttcaggtaaaatgttgctggtttttaagctcccctgttgtggagtgttttaatcagttttggctttttgagtttttgtggaattaaagggccgctgctgcga

SEQ ID NO: 673042 - DNA, 524 bp, Homo sapiens
cacatttattttcatagtttatgacattgacatacctgtgcataactctgtctcagcattttaaggccctggtggtgcacaggaagccgtgactaaaatgataggtacactgttcctaatacgggatataaaagactcaacaccacacctgacaaaagaagctgttgtcttaaagatgcatcttcctttaaagtaaatgaataacaaaggtaggccataaggagcttcttatctactttaagctcttggctggcttttccaggaagtttgaggagataaatcatgactcattttctgcagggtcagtggggaaactggagaggtggctgtccctgttcctgccggtgcctgaagctttcagtgttgttccatcacactctggctccatacctttcctcctgtcctccctccctgttggctggagtctaatgtgacacttcttccaaaacacagaaccgcctacattgtgtaagaagactctcaaaaaccattgattgaaatgctgctgatgccaaaaaaaaaaa

SEQ ID NO: 673043 - DNA, 469 bp, Homo sapiens
cccacctgtaccatatgtaatagtttatactaactgtggaaactctgtatataactgtgaggtggagtacatttcatttagaacaaatatgcccaggaaaaaaaggcaaataagaagttaatgatgggaaaactgttatgtagctattatgaggaatactgtattatgaaaaatgttaagatgcttaaaatagatgtttttgtatgtctgttatcaaagaatttattttcatcagggcagtttaaggtacacagcaaaataaagaggaaagtacagagatctctcacatagcccctgacacacacagacatagtctaccacataatcagtatatgttgattgtcaggcgcagtgactcgtgcctataatcccagcagattgggagccccaaggcaggcagactgactgagacccaggagtatagagaccagccctggagaacatgacgaaaccccatcatctattaaaa

SEQ ID NO: 673044 - DNA, 866 bp, Homo sapiens
  misc_feature (793)..(793): n is a, c, g, or t
ggagagaaggcatacacactagtggacctcagcacccaaggaataacacggtggtgagttccatgggttttcttttatgcctaatatatcccaggcttggaactgaagaagctggcagcctggaaacagcaatgggtacagactgaaaaaccctgttctctttaactgaaggacgaggaacaagacagcctagcaagccagaaaacttttagaccataactgctgtgctctaaccaaacaccacagaaagaaaaggccttacatcaacttgtgcctgccagtgctgagtggggagcctagattctctgttccttcaccacctcccaggggtaaagaggcgagcccctcctgcttgtgtcagtgttggggtgtagtactgagatactcctgccctttacagccaaggttatatcagcagaggcctactgaatacccagaattcctttccctgcgcagcactaacaaggagcttcctccattcagatgtccacataggccaagtgggaaacctggacttctaatgccatctggcactaatatggcagagccctttccccagatggtacagtgtcaaaggaggcatttaaactagaaggtttaaatatggtccagaatctcataacaccccaaatgtccaggtttcaattaaaaaatcacaaatctcagtttgagttaaaaaagaaaaccagtagacataaacactgaaatgacaaagatgttagaattatttgataaatattttaaagcagccatcatagaaacacttcagtgagcagtcctaagcacactgaanacaatgaaaattttagggaatcagttagagatacaaagaaatgaaatttgggacctgaaaactgcaataagca

SEQ ID NO: 673045 - DNA, 395 bp, Homo sapiens
tgacctagaggatcccccggagccttaacctagctggttgggcgcggtggctcacacctgcatcccagcaccttgggaggctgaggcgggcggatcatgaggtcaggagttcgagaccagcctggcaggatggtgaaaaccccatctccactaaaaaatacaaaaaaattagccaggcgcagtggtggacgcctgcatcccagccactcgggaagctgaggcaggagaatcctttaaacctggaggcagaggttgcagtgaaccaagatcatgccactgcactccagcctgggcgacagagcaagactccgtctcaaaaaaacaaacaaaacaaacaaacaaaaaaaacccctagctatataccctcacaccgtacacacaaaccaagcaccttg

SEQ ID NO: 673046 - DNA, 413 bp, Homo sapiens
agcagattgtatttctttctggggtacaagagatgttttgatgtaggcctgcgtgtgaaataattatatcatggagaatcatatcatggagaatcatatctatggaaattgaggggtgatcatcatcacccctcaaccatttatcccttgttacaatccaattacattcttttatatgtaaatgtaccattattcattgagtatagtcacccccgttgtgctatcaacatagatccttttatatgtacccccagacacacactgaaattacccaaagccaaatgtattctcaggtacaggatttcaagtgactaacttttcaatgtgatgatggactatatttctcccctctaattctgtccgaggataggacagcaaagatttttgcctcaagtagccttagaggtaccaag

SEQ ID NO: 673047 - DNA, 872 bp, Homo sapiens
ggaagaaggcccctcggctcagcagagcgctatcctccactgttacccgggttccccggctggctaccgggctgctccgtgcatctttccccccaggcgtcaggaactgcgcctcatggcggaggtgacaggtgaaggtgcagccgctgacgcgaatccggtcgaaatagaaacacagcgtaccccagtgaggctccggtttggactccatcaggcgcccagtcatttggggcagtggaccccttctccgggatccccttgggagtggccgggaaccggggttaggattcatagaattatgtcaccagttccctcatggaatcacagacccaagtactttcagaatgaatggcctcattattagaagcccagcaggcgggcagttagccattcaataggttgtgtctatggggtcagttctggatctcttaaggagcaatacgggccttttatataggactacaagggactcttcagaaatggctgcgtacaaaatgaagggatccgataaaccaagaaaaactagttataatcaaatacattagaggatgcgggagaactcaaaggaattattggagcagagattatcgttataaaagtaattgtgccatttacgaggaattcacaaaattcttgaaagaatctggcacagtaaaaggttaatcaaagctggtaagtctggtagccagctcacaaacagcaggggtatatgctctatttaactgggagcagaaccggtcttggactgggtggcgcctggtacacgcgccccgcattttgaatcctgatctgggacagtgccttacccacaggtgtgtaactttccaacagtccaggcgcaaacgtccggatcgcacagagccctgttccgc

SEQ ID NO: 673048 - DNA, 765 bp, Homo sapiens
  misc_feature (54)..(54): n is a, c, g, or t
  misc_feature (103)..(103): n is a, c, g, or t
  misc_feature (110)..(111): n is a, c, g, or t
  misc_feature (117)..(117): n is a, c, g, or t
  misc_feature (132)..(132): n is a, c, g, or t
  misc_feature (151)..(151): n is a, c, g, or t
  misc_feature (157)..(157): n is a, c, g, or t
  misc_feature (173)..(173): n is a, c, g, or t
  misc_feature (186)..(186): n is a, c, g, or t
  misc_feature (195)..(195): n is a, c, g, or t
  misc_feature (206)..(206): n is a, c, g, or t
  misc_feature (214)..(214): n is a, c, g, or t
  misc_feature (225)..(225): n is a, c, g, or t
  misc_feature (233)..(234): n is a, c, g, or t
  misc_feature (237)..(237): n is a, c, g, or t
  misc_feature (267)..(267): n is a, c, g, or t
  misc_feature (284)..(284): n is a, c, g, or t
  misc_feature (288)..(288): n is a, c, g, or t
  misc_feature (328)..(328): n is a, c, g, or t
  misc_feature (336)..(336): n is a, c, g, or t
  misc_feature (348)..(348): n is a, c, g, or t
  misc_feature (365)..(366): n is a, c, g, or t
  misc_feature (369)..(369): n is a, c, g, or t
  misc_feature (375)..(375): n is a, c, g, or t
  misc_feature (381)..(381): n is a, c, g, or t
  misc_feature (387)..(387): n is a, c, g, or t
  misc_feature (411)..(411): n is a, c, g, or t
  misc_feature (420)..(420): n is a, c, g, or t
  misc_feature (468)..(468): n is a, c, g, or t
  misc_feature (484)..(484): n is a, c, g, or t
  misc_feature (528)..(528): n is a, c, g, or t
  misc_feature (548)..(548): n is a, c, g, or t
  misc_feature (554)..(554): n is a, c, g, or t
  misc_feature (566)..(566): n is a, c, g, or t
  misc_feature (611)..(611): n is a, c, g, or t
  misc_feature (619)..(619): n is a, c, g, or t
  misc_feature (622)..(622): n is a, c, g, or t
  misc_feature (642)..(642): n is a, c, g, or t
  misc_feature (653)..(653): n is a, c, g, or t
  misc_feature (668)..(668): n is a, c, g, or t
  misc_feature (691)..(691): n is a, c, g, or t
  misc_feature (756)..(756): n is a, c, g, or t
tgacatgctgcttccagaatggaactctgtctttaagttctatactagttaggnggctaatctatcagcttgctttaataatgtaatggatgtcctattttanctggggnncctggncaagtcttccttganttcggcttcatcccaaggnccatgnatgttttctttaaaangctgcaagcgaantgaggtagnatgaacacagncatgaganagacatcagcngaagggcnnagngtacggctcccacagcactaatggacagtnggcctcccacggctganaatncaaaacgcagtgtgacccccacatagctccggggggtccntgcctttngtttcttctgcnacatgggccacagggcnnaantctggntggcanatgtcnccttgttggaggcatgcggggggnggggggggngtgatgccaagcatacagaagctaagttggccatgttcaaggttagtntgctggttatattggnagcattggaccatagtcaaaagatgagatggcctaacagcatgntgactgacatggcatagatngtgttngtgctgacagantctgtaagggtcttcagcactggtgaaaacccataagtgaaagtnatgaagantanggcactcttcaggtcagccnacgggtctgcncactcttcttccgcncttcacctccatcaatgagatcnaacaaaacatacccaatcagtgaagaagccaggccagtccctaaaagccaatggggggccagaanacctcattc

SEQ ID NO: 673049 - DNA, 651 bp, Homo sapiens
  misc_feature (17)..(17): n is a, c, g, or t
  misc_feature (25)..(25): n is a, c, g, or t
  misc_feature (37)..(37): n is a, c, g, or t
  misc_feature (184)..(184): n is a, c, g, or t
  misc_feature (206)..(206): n is a, c, g, or t
  misc_feature (395)..(395): n is a, c, g, or t
taagcatgcaatttttnatggtttnctaaatctattngtacacttaatatgctagtattaatttcacaaacagtataaagaatgtactccaatgatattacgcggcaactactcacctgaaaaagaaaacatggtctctgaaataattcctaattatacatttcggcaaataagcactataacngttaaaaggttaagacttcagngtataatctcaataacatcctgcctttttaaaattggcttaaacacatttggttagaagatctatgcaaagataacacacggttcttaccacgtgcgtagattaccacctcaaactatcagaggcgaagtgaacaccacaaaatgagcacactatttagccacaatgacgggccccagtaaataacttnaatcacgcattattattaaaaaccacacgtgagtgataaacatcgacaattgtaaccactgaatctagataatacgcgcatctggcgatctcaccatctaccgtcctaacggtgcactgggggtaaaccaccgagaattcattctacataaatgagctatgttaacaacgataacaatatttcatggcttgatgaccgggtcacatttctagtccacacagtacttcactgtgaccattctcttaactcggctaaa

SEQ ID NO: 673050 - DNA, 589 bp, Homo sapiens
gacgaggcgggcgcggaggtgcgctgcggggggcacccgtcggtggagctgccggggtacgcgccctcggaccccgacctcaacgcctcctacccctactgctgccggccgccctgcgagacgccgcggccctgggagacccatcgggcctgctgatcccgcgggccggacccccatcccgcggaccgcgcttgcgttccacccaccccgccccgctcaggacccccgcggcaagggaggacgggcagcggggcggggtccaggccaggcctcaggggcgccgcctcttccacgtggctttgcagcctccggcctggccccctctgcgggctccgtgaccacaggagggggcccctgatgtgaccatttctgtatctgggaggtttctcttcttatttgtgtcgttcatatctggattccattttcaagtttacaataaatgtttgggcttggctagcccgactgcactttttttggcaagtccaaaccctggggctgctctgcctggtgttccgaggcgagggggacagagcgagcgccccaggacggcgactttccacggaggaagagcagacagagacgcagagca

SEQ ID NO: 673051 - DNA, 422 bp, Homo sapiens
  misc_feature (26)..(26): n is a, c, g, or t
  misc_feature (63)..(63): n is a, c, g, or t
  misc_feature (82)..(82): n is a, c, g, or t
  misc_feature (160)..(160): n is a, c, g, or t
  misc_feature (165)..(166): n is a, c, g, or t
  misc_feature (180)..(180): n is a, c, g, or t
  misc_feature (229)..(229): n is a, c, g, or t
  misc_feature (263)..(263): n is a, c, g, or t
  misc_feature (265)..(265): n is a, c, g, or t
  misc_feature (278)..(278): n is a, c, g, or t
  misc_feature (299)..(299): n is a, c, g, or t
  misc_feature (332)..(332): n is a, c, g, or t
  misc_feature (346)..(347): n is a, c, g, or t
  misc_feature (354)..(354): n is a, c, g, or t
  misc_feature (356)..(356): n is a, c, g, or t
  misc_feature (415)..(415): n is a, c, g, or t
ccgcggcgccgcgatggacctcgagnagtcggaagagtttaaagaacgctgtactcagtgtgnagctatctcatggggtctnactgatgaaggacaaatatatatagcacttcttgccacaatgttacagagaaatatcaggaagttacaaacactagancttanncctaatacccaaanaaaagccctcaaccgggggcttaaaaaaaaaaacaatactgaaaaaagntgggattggtatagtgatgtagaaggtatccaananattcaatatcaanaagcagaagcacttaaaaaancttgagagtaggcccagagattaaaaaacgatnttttacaaaatttnnggaagcncnaccttcagaagaacaagcaggacatattgtaagaacccagtttataccactgagaaganaacctac

SEQ ID NO: 673052 - DNA, 221 bp, Homo sapiens
  misc_feature (215)..(215): n is a, c, g, or t
  misc_feature (221)..(221): n is a, c, g, or t
cagccgagtggaatgccgagcgaggacagtcgtgcaccgtggcgggcctacgcgttataaaggatcagttggccgattgagtttttgggggcgagtgaggttatttatacacaggactgaagtgggaccgagagatagtctatgaagcaagaccgatcgagacggtctgtttgagacttttgagaagtgatgaggttaagaaataatttagcaanaaaaan

SEQ ID NO: 673053 - DNA, 933 bp, Homo sapiens
  misc_feature (459)..(460): n is a, c, g, or t
  misc_feature (705)..(705): n is a, c, g, or t
agcggatctgcatatatccacttgtgacagagcgctcacagtgcatcaatatggcttgtccccgtggatctctagctgaaaagggccttcccagagattcaaaccaatcggttatatgatcgctccatggatgagagtggtggaaggtctcagtacgttaatgtttgaaacagctaaagcagaacgaaaaggacatgtcgtatctatacaaagagttacatgataatcatgagttagtgtaggacttggagactatacatgtaatgattgagtgtactgaaagactgtttaacatcttcagggctcacccgtgcaagtcaaatacttcgcgttgccatgcttgttcaatgtatgatactcatgaggctgtactgaacagagggctgtggacatgatacctactagagcaagagaaatggggttaccatacccatcgggaggccgcatagggggtctaannggtcctggtcgccggacggagcatccggagttggttcgctggctgcggcgagctgacctgtggtccaccgtctggcgattcctcatgcgttgctagactgctccttgcactctctagcgcaccctccaccccatttctcgcgcgtcgggcggcttaggctttgattcgtgatcaatggtccgcggaacaaaacgagacgatttgtctctgcttatccgcacggagtcgggagtagactctccaantccgagtgtcgaggccattgaaggcaggcttgcggcaatgatgaagtgcaatggaccccatgacagcccactctgacgccattgcggactaggtctctcgcgtcccaatggaaacccgggttgtgggggtctggggctgcgtcgtagaggcgaggaccctaatcctttacgcgatataaggcgactggtggttgaacaggactctccggcggatatgaaggaggaaga

SEQ ID NO: 673054 - DNA, 382 bp, Homo sapiens
attcccagcaatggtggaacatgaattgcctgtaatttctacaatttaatactgtgagttataattttctggctttaatctgtggtaatctgatagtaatctattatcttaatttgcatttttcatgggtacaagccattgtatttattttcctaaatattgataatttataacctttgattatctagtgagttgttggccatttcttattttaaagtatttcagtgtataataattaaatatataattttttcatgtgttttgcaaatttttttatgtgctttgcaaatattttttcccatctcttcatttgtcgtttgattctgtttatgctgttcctccccccactccagcctgggaaacacagaaagaccttgtctca

SEQ ID NO: 673055 - DNA, 586 bp, Homo sapiens
  misc_feature (293)..(293): n is a, c, g, or t
  misc_feature (406)..(406): n is a, c, g, or t
  misc_feature (449)..(449): n is a, c, g, or t
  misc_feature (479)..(479): n is a, c, g, or t
  misc_feature (497)..(497): n is a, c, g, or t
gaggctgaggcaggagactcctttgaagccgggagacagaggttgcagtgaaccgagatcacgccactgcactccagcctgggcaacagagcaagactctgtcttaaaaaaataaataaagaaaaattacgaaaaaatgtgcttggatgggcttggcaaactttagccattagctcacgtaccacttcggaagggcataccttcagtcacttcaccctttaatccctctgctcaagactaaagttctgagaggaagtctaatcggctgagttgtgtccatgtgggcagtgcangaaagggtgcagcgggaggcggctccagggacgtctttggcttccatcatgggagagcaggcgcctggattatccaccctaacaaatctgggcaaaggaaaacgaggttctcngaggaaggagacatagagcccaaggagctaaccaagagacaantagtcatcctgtcttgtcattttcttttanacatgtgtgtacattatnttacacttatcactttgttttctttctctcctttaattgcaccctgctgccaaaagttaacaataaaatgaaagtacttgagatagctc

SEQ ID NO: 673056 - DNA, 266 bp, Homo sapiens
  misc_feature (58)..(58): n is a, c, g, or t
  misc_feature (142)..(142): n is a, c, g, or t
  misc_feature (224)..(224): n is a, c, g, or t
  misc_feature (232)..(232): n is a, c, g, or t
  misc_feature (250)..(250): n is a, c, g, or t
ctcaaacgaatcacccaccttgacctcctaaagtgctgggattacaggcgtgagcatncgtgctgggcccaaattttaaaatacagtataacaaatatttgtatagcatttatattattaggtattataagtaatctagagnttatttaaagtatacaggatgacgtgaatttaagttacatggaaatactacacccttttatgtcagggacttgaacatctangggttttnagttagggggagccggtnctagaaccaatcccct

SEQ ID NO: 673057 - DNA, 174 bp, Homo sapiens
attggaacgaacacaggaaacacagattctttgtccttttcccaacagcccaggctgttgatacctcagagccttcatctttactctccaaagatgaaagggaagcccccgatctctctacactgcatgtcatcacggggtgagcctgccatttccatatcttcacaccgtgcc

SEQ ID NO: 673058 - DNA, 128 bp, Homo sapiens
tgctaagtgagttgaaaagcgaaagtgctgaatcccaccagcatcgctggatgtgtcatccactgagcccttcatctcccatgaaacttgaacttttaaccaatttgcctagaattctgacaaatttg

SEQ ID NO: 673059 - DNA, 150 bp, Homo sapiens
cgtctcaaaagagaatagcgaactgcctttatgtacaaaagccgcagaagaaaagttcagtgctgtggcctgtctctgatgccctccatattccgctgcatctgaatccagcacaataatgaatttccctcatccggttatccgaatgac

SEQ ID NO: 673060 - DNA, 158 bp, Homo sapiens
caggatatgactgctttctttaaattatttggtaggtttaaaatattgtaatagtggtaattataaagtactaaaaacctagaatgtaaacatctaaatgtttttattctgatcaaagaggatatcattatttttgtattaaatttcccatctccaac

SEQ ID NO: 673061 - DNA, 1096 bp, Homo sapiens
gtgagccccgagtgccactgggccgggtagatgggccttatagtcggcggtggaggctcgagagctgcgccgggagagctgtgccgagagtcttcgtctcttttttggctcctgcacttgttgtgtctccctggaggctcgtgcgccatcgtccggccgtgtacccggctagatcgcgagtgtggcacagcgtggccttcgcctgcgtggggacatccgtttcgtacgtggctagttgtctcctctccggtgcatgccgtaggcattcatctgtacctggcccatgctacggtgactactgcgggctactatgagctgggaattcacttggcatggtttccaggagacacttggtcctcagctctctgtgggatgatgtaggaataggaatcactcgctcttgccgtaggcggaaggaatcttagacagcaggaaccagctgtccggtgaagatgtagcagacagccgggtgtagaggcagtcgcaccgctgcctcgttaccttgagtgttcgatccacagggcctactgcgccctcgcagtggactctgtccccattccttcaatgccccgaggttaccactcggccgaaccttgcaccacggaggctggaagcttgggcccgttggttgaattggggcaaaagctggcttgcctgtaggcaatgttcccccgtagggcttgacgggtcctatgggacctacagttgtggcggcttaatggcccttgttgccttggtaattatgcacccgccacgtggagacgtgtgtcagggaccgcgaggtgccacggacagcaaggtgggctgcccttgtggacctcttggcggaaagaagcttccacgggtgttccttggcccagggtcaaggcgcgttcggtgcccaatgggagaaaaattcccttaccccttcagcaaagcttgaaggctcttggctccaagggtccacgggggaaccttcaggacacgggagggtgagcacatccttccattgattttttccccatcccttaacgttagccagctatgttctaaggaacattaccttgggaaaaaggagattttactctttgattgggacggcccagggcgggttgga

SEQ ID NO: 673062 - DNA, 136 bp, Homo sapiens
tcgaatgcggtgcacggccgacaggccacagttgtgggcgatgtctgtggccttgctggccacggcgagatcgtgcccaggcgcgggatcaccagccagcgccaggctcttggccggcgcctcgccggtggcgggg

SEQ ID NO: 673063 - DNA, 224 bp, Homo sapiens
gtttgggaccaccctgtccaacatatcaaaccccctctctattataaattcacaaaaaaaaaaaaaaaaaaaaaaaaaaggcccgttgtgggggggtgcatttgtaatcccacctcctgggaaggctgaggcaaaaaaatcacttgaacccgggagacaaaggttaccgggagctgagatcacgtcactgtactccaacctgagggccctgaccctgtaaactg

SEQ ID NO: 673064 - DNA, 100 bp, Homo sapiens
gtccttacgactttggaggtgttcttactaatagtaaccgagacattataaatggagatgcaatccacaaacgaaatcaatcccacagggaaatgcactg

SEQ ID NO: 673065 - DNA, 149 bp, Homo sapiens
tcttctgtgcgtcgattcctatggatgctgccatccttcctggacgagacgggacggtgaaagctggatgtgagcccagatgggttcccagcccacatcacccaggagctggctggtgactggacctgggagagggagcactgttgccc

SEQ ID NO: 673066 - DNA, 694 bp, Homo sapiens
gcttaaggctcaccactgagttcgtcacagaggcctgggggtcagcacggagggggactggagctggagagtgactgtagagcctcaggactcaggtacttctgccctcccttaggtctccctgttcttctatgtggtgacagatggcacggcagtcctactaccagaggttggggccaaggggcagttgaacgtttatcagtgggcagaccagtgaacttggtgagttccgctttacagcttttgccaccaaccaggtccaggggatacagcccccaagtatggcaggtacaatgtcttctggagctccaacccaggacatgccctggatgacagagatggtaaagagtcgcctaaatagctggtgtcagcaatcgagccccaggggccccccctgaacgctagctcggctggccagggatccctgcaagtgggcaggacagaggtccaagtgggcaagggcatgggcagattcttggatacagcaggtgaccctgaacaattcccatttccatagacgttggggtaggaatcaggcagtgaccaggcaggaggcaactcaagccctgacaagactggccggcagtctactgtacccagggccctggagaagccatggctggagggctataagaagagcggctatggagaacagacccttccagcgtgaagggaggacggggccatgagcctc

SEQ ID NO: 673067 - DNA, 219 bp, Homo sapiens
gagcaggaaagagagaaagaaagagatagaagtagtacagaaaaaaacagtgtaccctcatgcctttaacaagcctggagtaaactttaaacaccatacaattgttcaattggcaggtctatctccagtgaccctgataacactccacataccaccttgttagtcacgcgtaaacagggagcgtagccatgaaagcactgagagccactgcacaacctg

SEQ ID NO: 673068 - DNA, 121 bp, Homo sapiens
  misc_feature (64)..(64): n is a, c, g, or t
  misc_feature (66)..(67): n is a, c, g, or t
  misc_feature (73)..(73): n is a, c, g, or t
  misc_feature (92)..(92): n is a, c, g, or t
tgatgactcagaggaggagaaggcagcagcacccccaagaagactgtacctaaaaagcaagttntnnccaagnccaaggcccagtgaaagcngctaccacccctacccggagtgtactagt

SEQ ID NO: 673069 - DNA, 173 bp, Homo sapiens
ctttttaaacttgaaaaaactgggataatgttaacttttaaaaaaaacctttggcccccctaggaattgatttttgtttccagattgttttgtttacaaattgttagtctttgtttctatgaaaaacttttagggggcctttttaaatgtcttagaaattaaaagttggccca

SEQ ID NO: 673070 - DNA, 319 bp, Homo sapiens
gttgtgtcatccccttcgtgtgggggcgtcttgttgggcggttgggtacttgcgcatgcggtgggtttgatgagctgggactggtagctggtattgagggcttcaggtcctgggagccgactgagtggcaaagggcttaatagtagacagaggggttagcgaagggtgctgggtgcggctctccaggccctggaagggtttctggtcttggggttgccagtgccaaaatcccccttcttgttgtggaaacagggtaagtcgggggatccatgggaaccttggaagccaaccctttggtggcaggggtagggcagggagg

SEQ ID NO: 673071 - DNA, 366 bp, Homo sapiens
  misc_feature (83)..(84): n is a, c, g, or t
  misc_feature (102)..(102): n is a, c, g, or t
  misc_feature (156)..(156): n is a, c, g, or t
ggcccagccagtgaaagggggctgtgtctgaaacaaagaccgcggtcgctgcatcgtcttagagctgcaagagggaggcatcnngttgcggccgcctttagngacaccatgtgaccgtttcggctcactgacacgcagctttggttaaagagcggncgcacaggaggggaggagaccgcgcgcgggacggggaggaatggcctgtccgcgttaaaccatcacaagccatggttgcggaagggccacgcgtcccccagtaggagaatgactccgattcgtgaccctcagcgcccggtccatgttgatagtcaaggaaatttttgagctatttacagcttggcccaataatgtaaagtatactacttc

SEQ ID NO: 673072 - DNA, 382 bp, Homo sapiens
  misc_feature (305)..(305): n is a, c, g, or t
  misc_feature (314)..(314): n is a, c, g, or t
  misc_feature (321)..(321): n is a, c, g, or t
  misc_feature (326)..(326): n is a, c, g, or t
  misc_feature (328)..(328): n is a, c, g, or t
  misc_feature (331)..(331): n is a, c, g, or t
  misc_feature (336)..(336): n is a, c, g, or t
gtttacacggttgtggacaaaatgtttctggctggcgaaattcgaaagaccagccagacgaaggtgcttaaacagctgctgatgcttcagtccctggagtgagggcaggcgagcccccccccggccccggccccttctggaattgcctgcttgctttccctttccagggccgtgggcaacccaacagtcctttcctcagctgcctaggaggaagggacccagctgggtttgggccccaagggaggagactgcccccccctgcctttgggccctggctgtgggcaaaggcccccgtgtgtgttccnagtaaccgngccgttnttgtntnatnccatnagggtttgtgggtggagtcccccataaacctgtggtcctgcctgga

SEQ ID NO: 673073 - DNA, 180 bp, Homo sapiens
  misc_feature (24)..(24): n is a, c, g, or t
agctccaacaagaaggatggctanatccaaaccagatagtggtatctcacataagaaattttaacttaatatggcacataaaatactagtatgctttaggacttcccagagaatggttataatgtcaaatcgccaaagagaaatgaatatacaatgtagaggaaaacacatgggctgtgt

SEQ ID NO: 673074 - DNA, 353 bp, Homo sapiens
tgatcatctaagacgctttggaggtccagtgctgagatgtggtggcgcatggtgaaatcgacgactatcgtcgggataggctcgaaatgcgattacgcggtcgagataacgtttacctccgatcgaacctgattgctccggcctgctcaccaatgaagatctcctaataccacagaccggtagcgatgcgaaagagatcgtgtctgtctggcgacaggagtcagtgccgtggcgaacaggtcgactggttggctgttccaagacgaagcgtggccgaagacgttatctttgtcggcaacgatggccgacgcatccgcaggctccccgccaagctgcccattcggcgcatagcg

SEQ ID NO: 673075 - DNA, 305 bp, Homo sapiens
atgatatggacttctaacgagtgcacggaatggaatggaatggaaccaacccgagtgcaatggaatggaatcgaaattaatggaatggaatggaatggaatcgacccgagggaatggaacggaatgcaatggaatggaatggaatgcaatggaatggaatggaacggaatggaatcaacccgagtggaatggaatagaatggaatggaaagcaatcaacccgagtggaatggaatggagtggaatggaatggaatggaatgcattggaatggaatggaatcgaatgcattgaaccggatagcttg

SEQ ID NO: 673076 - DNA, 1148 bp, Homo sapiens
  misc_feature (165)..(165): n is a, c, g, or t
  misc_feature (167)..(167): n is a, c, g, or t
  misc_feature (215)..(215): n is a, c, g, or t
  misc_feature (240)..(240): n is a, c, g, or t
  misc_feature (247)..(247): n is a, c, g, or t
  misc_feature (249)..(249): n is a, c, g, or t
  misc_feature (265)..(265): n is a, c, g, or t
  misc_feature (267)..(267): n is a, c, g, or t
  misc_feature (275)..(275): n is a, c, g, or t
  misc_feature (283)..(283): n is a, c, g, or t
ccaaactctgggggaaatgactcccctctgccctcgccccgcgctctgctaccatttccttacgtctctgcttcgctcaggatgcaaaacgcgcgaggcgcacggagagggccgaagccgcggtactctccgggccaggccgcccctcggcgcgccgcgcagccngngattccccggccgctgtccagcgctggccgcctgagccaaggctgccngggagccagtacagtcggggccgcnggctggnangggcgagcttcctaangngcgggggngaagcccnggcgccggggccgggtacggacatggccgtgcgcggcaggggctcctggcccgtctggacatgtgaatccacgctggcttgacgcgctgtgggctggaacgtagcgggtgtgcgatgctgggtccttcttgctgcgcgcgtggcggcgcgtcgcgcgcggcttggcggtgcgtccaactttacggggtccccctggcctgatcgcgcgctgcgccggcctttcctaccgtcgtcgtcgacggggcctgacgccctcttacgaagcctcccccttttcaaacgtctggggccgcccacttgccgcttgcacattgttcggcacacacggtctcgaccctcgggtgaccccaatgtcaagttttttacaccgattccccttcaaatcgcttggctatatctctgactctacaggggggcgtttccaaaaacgcccacaacaccttgttgaacattccccggcccttccccccttctatacgaggtccccatgtaaatcttggtcttgtgcacccttccgtttcccccgggcggggcacggcgcgggtcgtgtccctgccctcttgcgctgtgcccggtgtcggccttgtgccgtgtgtgcacccttcctccccggcctactctggcgccgttcgcgcctccctcctttgcctggttctgcaacccgccctccagctcccgcttgtccgccctccttcccgtcttgtacgctcccccggggctggacgtccttcccttcggcatccgcgccttttccgtggggcctttcttgcaccgatgtggccccttgacttccttgcaaccgtacaacgctacgcgccgggcccaatttcgacacgcccgcactgataacccgcccgggggcccc

SEQ ID NO: 673077 - DNA, 148 bp, Homo sapiens
tttcccacaggcagctgctatgggtaggacgcaggttcacgaggggcatcacaacaaaccccagtacagtcagcccggcacagcggcctccttgtgttctgtggtcttccctgctgctgccacatccttaccctcctgatgcctctga

SEQ ID NO: 673078 - DNA, 554 bp, Homo sapiens
  misc_feature (165)..(165): n is a, c, g, or t
  misc_feature (167)..(167): n is a, c, g, or t
  misc_feature (215)..(215): n is a, c, g, or t
  misc_feature (240)..(240): n is a, c, g, or t
  misc_feature (247)..(247): n is a, c, g, or t
  misc_feature (249)..(249): n is a, c, g, or t
  misc_feature (265)..(265): n is a, c, g, or t
  misc_feature (267)..(267): n is a, c, g, or t
  misc_feature (275)..(275): n is a, c, g, or t
  misc_feature (283)..(283): n is a, c, g, or t
ccaaactctgggggaaatgactcccctctgccctcgccccgcgctctgctaccatttccttacgtctctgcttcgctcaggatgcaaaacgcgcgaggcgcacggagagggccgaagccgcggtactctccgggccaggccgcccctcggcgcgccgcgcagccngngattccccggccgctgtccagcgctggccgcctgagccaaggctgccngggagccagtacagtcggggccgcnggctggnangggcgagcttcctaangngcgggggngaagcccnggcgccggggccggaagaacccggccaattttcacccagtaaagcggggcccgggcctgcggaagcgtgggccgggcatgcgagctcccgctatgggcccgggttcctccggaggcaacgccaaggggcccccaacccgagggggctccggacgcagccgccggcgggagctaacgacccgtggtcacgaggtggccttatggattaacacaattacccaccttatggcaggaaaggctcggtcgggacaccggggcatccaagaaagagc

SEQ ID NO: 673079 - DNA, 752 bp, Homo sapiens
agcgggggcgtgcggcaggggcccagccctgccttccactgtgctctctgtcagctccaggtcaattcagagacccaactgaagcaggtgggagaagtgaggctgtgactggggttggagccagggagggggttggggggcaggcagcagagggagggaccctgaagagagcaggcagggcacagcagagcaggctggagaagcgaggccagcaggccagtgggccaattaagggcaaaggccaagactcacctccccttcccagggcctaccccagtgtgaggacccagtctgtgtgctttggatgtatgagctgtggatagaggaaggggaagagtagaggatgatggtcttggggtccttgggctttgtcatcttgttcccagtctgtctgtctgtccattagcacatgagcagcaggaggcacaaagaccgcctggccgggaagacccccaagccctccagccagcacagcaagctgcagaagcacgcagcgctggctgtgagtatcctcaagtctaaactggccttgcagaagcaactcaccaagacgttggcagcccgcttcctggccagcccgtcccctacggagcactggcatctgtgctctgccaggggcccctgtgcctccggcctggccctacagcagccactacctcttcctggtcccatcctgggcccagctctgtttcgaccccagaggagctgtccgcctgcacaggacctatcgtccttgcccttattagcctcat

SEQ ID NO: 673080 - DNA, 707 bp, Homo sapiens
gaggcatcgaggcatccagcgcaggggcttctgctgagtggggctggcggagctctgaggaaagcgcagataagttttctctctctttgaaagataggagattcaatagcaactagcttataacacatatatagtcaataggtgtactaagatattgcttagcgttaagtttttagcgtaatttgaatagcttaggatttgaagagaaacatatgaagacttagaagacgtacgcatgaggaaggaccaagatgaaaggttatctaaaacgatgacggaggttgagatcgaagctctcttcatggagtaacaaaatgtatttgcagaggacacattgagagagctggactgacagagctcgcgatatttaataccaatagaatgggtcaatgcgtgattagattcaatatcgctggtgacttaaatagttgtaaaggtcagtttaaaagttgtaggtgattaagataatttgaaggcgatcttttcaaaagagattaaagccgaaggtgacttacaagaccttgaaatccatgaccgcagggagagttgcgtcatgtaacgcctagtataacgcattgagtaaaggcagacgattgtggacagatgacttgggaagtggtaggatgagacaatctgtctgaagatagaagttagaagtgcaatactgccaatacacagaggtacgggaagggcgaacgacacgaata

SEQ ID NO: 673081 - DNA, 118 bp, Homo sapiens
gccaacatggtgaaacccgtctctacttaaaatacaaaattcagccaggcatagtgatgcttgctctgtgcagctactcggcagctgaggcagagatcgtttgacccggagcggagtt

SEQ ID NO: 673082 - DNA, 200 bp, Homo sapiens
tagaggatcccccttccccacccacgggtaccctccccagccgggaagttcatcactacgtaagggaaagctccttccgcccctccaaagccctcaccaggcctaacagaggcatgcatttttatatcacgattattcaacggacttctggtttaaaacgaggtttataatggtcacggtagacgagcctgggcaagggt

SEQ ID NO: 673083 - DNA, 366 bp, Homo sapiens
gcccccctgtccctaactgtaaaatcagggtcagggttcaactgcctacccccatcctcatatttttgtctgtcccagccccccaggagcattttcattgtggccggctaactccgcctggatgtgaacaggcaagcccagtgggaaatgagtcccggacttgtattgcccagtgggcccctctaaaggtcccttggtttaaagggatagggaaggaggagggatgagaccctccccccctccccgaagtaaatttaggatttgagttttctttatgcccctgagtccaactaataactgtttaggacggaggggtttgctgggttttttcgggggtttttttaaagcaataaactcctttttgcc

SEQ ID NO: 673084 - DNA, 535 bp, Homo sapiens
ccagaaagcaaggggctcaggaagtatgtggggaacagggcagagaaagagcgagtaataaatttaagagcaaataagtaaatggccagggcagactgtgtcatcttgccatctaagtgatagaaactctcagattctatatcattttgagttgtcttaaatcccagtaaactgttatgcttgaattcatgtctttatacctgaaatggcctcattactcatttagactcattttacacattataaaactgtgatccaaagaggtaaatttatttagtacaagtcaaatagcaggtaaatagcagaaccaggaccaaattcagaaattttgagaccaagttcagtactcttcccatttcaccttgaagtgctccacacacacttaaaaaattgaagtaaattgattcaactgaggttattatggtgaaagagaaatgacaagtttccaaagacccagcgatgtgttgcgagtacagtaccataaagaatatccctggtgaagtcatcatattaaactcttctttaacatgaaaaa

SEQ ID NO: 673085 - DNA, 559 bp, Homo sapiens
  misc_feature (13)..(13): n is a, c, g, or t
  misc_feature (29)..(29): n is a, c, g, or t
  misc_feature (57)..(57): n is a, c, g, or t
  misc_feature (111)..(111): n is a, c, g, or t
  misc_feature (126)..(126): n is a, c, g, or t
  misc_feature (551)..(551): n is a, c, g, or t
aacatcagccccnagtgccaagaccttcntattcattaattttaacgccctcagagnaaggccctcagggagggtcatcctcccatgttttgaagaagagactgaggttcnagagaggataagagncgtgacccaaggcccacagagctatgggtgtccagcacccaggatttgaagcccaggtgaatcccgagcccttttccccatatcatctgtttgttctgttgtctaaaagcacactgcaagccgggctcagtggctcatgcctgtagtcccagcactctgtggggccgaggcaggcagatcgcttgaggtcaggagtttgagaccagcctggccaacatggtgaaaccccgtctatactaaaaaattcaaaaattacccggacgtggtggcgcatgcctgtaatcccagctacttgggagcctgaggcgggagaattgcttgaacccgggaggcagaggttgcagtgagccgagatcgcatcactgcagtccagcctggatgacagagtgagactccatctcaaaaaataaataaataaataaatnatgaaatt

SEQ ID NO: 673086 - DNA, 265 bp, Homo sapiens
  misc_feature (116)..(116): n is a, c, g, or t
  misc_feature (127)..(127): n is a, c, g, or t
  misc_feature (148)..(148): n is a, c, g, or t
  misc_feature (198)..(198): n is a, c, g, or t
  misc_feature (235)..(235): n is a, c, g, or t
  misc_feature (262)..(262): n is a, c, g, or t
gggcagagcaggcccggaagccagtagtaagatccccaccactcccctgccagggaggaagatcaggtgatcttgtaggcaaatcccgtaggcggcttaccaaggcccacattggngacaaagggtntatctgttttttggcacagantcccctgcaagaaaggtgcagtcggtttctttttgcaggccctttcccantttgcccacttaaggtcaagtaacagggggagcttgnccagttaggaggggaaggttccagggnagg

SEQ ID NO: 673087 - DNA, 759 bp, Homo sapiens
tggtacatatggttagggtcagccattttataatgatctcggatagaccaaaccagccttcggagcgttctctggtcctacttcgtgacctttacctgtggtgggttgtgacccagtgtttcatatttaactctcaaagggagcaacacaacaaaccctgggtaaacaaaagagcaaaaagtgaacaaccagaacaaaccaactctatatttcgcggagcacattatccaggatacaccctattttgtggtgtctatgtgttaccccttacgcgcgtgtttcccatatatacacgtataacagtgtgtaggtatgtgcgtatctgacacaacgtggtgttctacacacagacggggccacacagcactacacagcgggtctcgtctctatctatatttctcacccccctttatcttgtgagtacaataatatagcaaacgtggaggcctgtgtgttctcatatgttctatctctgtgcggcgcgccggtgtgtgagagtaatgagtatatgagtgtgtctgcacacaccaactatgtggttgagctcccacaaaacaactatcaccacaccgagcgcaccacgttctcgacacttctatgatgggcccgaaggacgctgcagcgcccccttcacacacagagacagcaacacacccacaccacacacacgagaggggcggcgcggcggccccaccgacctcgcacaagcaggggatactccccccccccacaagcgggcgggcgcgcccccacaccgaa

SEQ ID NO: 673088 - DNA, 333 bp, Homo sapiens
  misc_feature (239)..(239): n is a, c, g, or t
  misc_feature (301)..(301): n is a, c, g, or t
aaaatttaaactataaataggccgggtctggtggcttatgcctggaatcccagcattttgggaggctgaggtgggaggctcactggaggccaggagttcaagaccagcctgagcaacatagggagacctcagctctacaactgaaaaaaaaatagccaggtgtgttcatggtggcacctgtctgtattccagccgcttgggaggctgaggcaggaggtttgcttgagtccaggagtttnaggttgcggtgagctacacaattgagctatggtggcactactacactccagcctgggccatnagagtaaggccctgtctctaactggaagtcca

SEQ ID NO: 673089 - DNA, 185 bp, Homo sapiens
ccacccggactcagaatctcctcagacgccgagatgcgggtcacggcgccccgaaccgtcctcctgctgctctggggggcagtggcctgcaccgagaacctgggccggctccactccatggggtatttctacacccccatgtcccggcccggcccgtgggagccccgtttacatcgcagtgggct

SEQ ID NO: 673090 - DNA, 389 bp, Homo sapiens
ggtagatctagaggatccgaggcgggcgtcgtcatgaaaagcatggttccctaaacacagactgtctggtccatctcggagtttccacagtcgtgactcacatgcaagcaatgtacaactatggcagggctgggctccttccctcccagacaggctcaaggttatgctccctgtgccgggatcagaatctggaatcaggacggccactccagtgacatgaaaggcacacgggtgacaggacggacaccccagagacaggaaggacgccccagagacaggacggacgcccccagagacaggacggacgcccccagagacaggacggacgccccagagacaggacggacaccccagagacaggacggacgccccagagacaggagggtacc

SEQ ID NO: 673091 - DNA, 346 bp, Homo sapiens
tttcctgacattcccttactgactgctttccctatggactttatatcagatgcagagacccagccttacagaagttgtttaaccaactttaataaccacataagccaattccctgtaacaagtttctttaaaaaagaaggaatgtgttcgacaaaaaaagcaggaccagtgtgaggtatacaaaggtactattcccagactgtgggcatattgcaaactgattccccttggttttttaggggtttatttcctagggttcacagtttccttacaattccttacattagtattttgctgaaaacatggggaggattaaaaaattttccagcattccccctcaacccta

SEQ ID NO: 673092 - DNA, 615 bp, Homo sapiens
  misc_feature (319)..(319): n is a, c, g, or t
  misc_feature (359)..(359): n is a, c, g, or t
  misc_feature (411)..(411): n is a, c, g, or t
  misc_feature (446)..(446): n is a, c, g, or t
  misc_feature (485)..(485): n is a, c, g, or t
  misc_feature (593)..(593): n is a, c, g, or t
cagctcactgcaacctctgcctcctgggttcaagcgattctcctgcctcactcagcctcccgagtagctgggattacaggtgtatgctcccatggccagctaatttttgtaattttggtagagatggggtttcaccattttggccaggctggtctcgaactccagacctcaggtgatatgcctgccttggcctctcaaagtgctgggattataggcatgaaccacggtgtccagcccagttttatcttttaatcagttacatatattcgtttatactagatgaacttctcatttttattaaaccttttgagagtttttntaatcacagtgacttttgtcagtatgaagcactatgagtnctttccatttttagtagatacttcagtgatcaaattttacgcatttgtgttngtcttcgtagcttccaaagtttagtcattaatttngtcaagatttttttctttaaaaactattgtggtgtattngaacttccctcagtcttttctttatagatgtatttaaatatagcagtcagtacttccagtattgatttatgtaagatgctactattgcagttgtaaaaatgctgtgantcctttcatgtgaatatgttag

SEQ ID NO: 673093 - DNA, 135 bp, Homo sapiens
  misc_feature (36)..(36): n is a, c, g, or t
  misc_feature (69)..(69): n is a, c, g, or t
  misc_feature (95)..(95): n is a, c, g, or t
gtaaatccaagggccagaccgtgacctcataaagcntgatctccttctttccagactgtggcaaaagtntccaagcggcattcaaattctgcccntactgtggaaattttttgcctgtagaggagcatgtagggt

SEQ ID NO: 673094 - DNA, 933 bp, Homo sapiens
ataaacaccctaaccctgatttccctagttccccccatccttaccatcctcgttaatcctaatagaaagaaattcataggcccccattcatgtaaacatccattgtcagccaatccagcttagattatcagtcctcataccccacatactaagtattcagtgtgccataggactccaccgaagtctattatcttctgacactgaccactgagccactaagccaaacaaccccagatctcccttaagcctctcaaactagacgaacgttctccataaatattcatcccctggtagcatgtgtatcgttacatggtccattcagtaagaactacctcacgtgtagagtataataaactcagagccaatacattgaatcagttcttcaagatatctactcatcttcctaagttacccactactagactccttagttaccgctaataagctattccaacctgttcatccggctgttgagggcgtagtgagatgatagtccttcgttgctcatcagttgatgataacgcccgagcagatgccaacacagcggccattcacggcaatcctgatacaaccgtatcggcgatgtcggttcatgctcggcttaaggatgattatcctacactccaagttcagtgagaaccgacaaaaatagccgttgtagacgctaatgcaaggctcaccccactactagctgcctcctagcaggaagcggcaatcaagcccatagggtgttcacccgggattccctgaacttagagggccaccagctaagccatatcattcacccttagtggcaggattttttactcggttccccctggaataccattcgattaattgtgaggtacacctgttgggcgggcctcaaaaagaaaatgggcgggcattacagcggcgaagcatcacgtagggaacgccccttgtagcggcacg

SEQ ID NO: 673095 - DNA, 952 bp, Homo sapiens
cctataagcagggaagcctatacacgtgtcctgggagaaactggtagagacataaccgcgtcttatcctagctctagaagtgaagggtgtcactgtccctgtgctctccgccactatccgtatttgcgacctctgggcgggaagaccatgaggtaccccatggagattccgctccgactgaactttctgctgggcggttccatgagcctcgagtgctgcgtgcggtgatggatgggtttactggtgttgttgttgcagggaaggatgggcggtagggctgggttatgtggacccgatggagtgagctgcggggggatttctcgctggagggctgcgagttcagtgatgggtgaatagagcggtgtcgtcttaggtgagtcccgataatttcgttgcaacacgagacatggaggcttggagtgttcccgcgatagctatggggcatctattgcctctataaaaaaatctagtgcgattcgtgaaatcgcaaaaaggtctagaccataggaggcccaatatgtgaagaggttgctaggaatggttgcgttccgaaataccgtaagcacaaatgcccatggatggaagacacctcaattgaagatgagggtgaacagtcaacaagaggaggtgagacagaccgaggtgagttggcatctatacacgccaggtactaaaggcctgtctgttaccggcagagctgagtccaatcagccacccgtgtggaggctgacgtggattaaatcagaccagaagtaccgaggtgattgcgggagaatgaacattgtgtgggaagacctggccaatggctggtcaaagggagtaaacccagctcaaagaggccaaagccccgccagaaaggcacagggcaaagaaagaaaggacaagttcggagaagaaaaaagagaacctgaaacaaaaggagggaaagtaaagaccaacaagagaaaaagac

SEQ ID NO: 673096 - DNA, 930 bp, Homo sapiens
  misc_feature (323)..(323): n is a, c, g, or t
ctttagaaaagaaaagtaggcgtatttgggatactgccagcggcgagcggcggaaaggaggcgagccccgaggcggcctttgttagtgtgcgctgtctcgttgttcttatacctgggctggaatttctttaatgaaccggctgtccccgcccgttttacggcgtgactttctttttgccttcctgcccctgttcggccaattcctggagtgaatattgtttcaaccgctggttggaagttcccccccacccggcaggtggacttgaatccctaagggcatactgaagtgggcctttagatttgattggatcgtaagctgtccntcaatcatggcttaatggatttatgggttatcaccggaatgggactggtggctttataagaagaggaaaagagtactgagcttgcatgccccgccccccgagagcctcccctagagtgatgctaagtggaaaatgtgaggtgcacgctgccacccgagggcccccacccacgggaaaagtttacatgtctaagtggattcccggccacccggagagagtgccccgtggagcgcctgggagcacggagcctgaccacccaccccggagccccacgaaactgtggagtcacatggcacgcaagcagcgcccccttgggaaagctttatggcaaccacgcctgccaacccacttcgaggcagccaccgtaggctgcaccccacgccaagccaccacggcccggggctaacctgaggccttgggggccccatccctgctccacagtgtgtccctgaggcacgcaccccgaagtccaaagagattattctcttcccccagataccttttctctcccctgaccccttaaccgcatctgcttcattcccctcaccttccccggctgatctgaggtaaactttgaagttaaattaaagctgtgtttgagccatcc

SEQ ID NO: 673097 - DNA, 157 bp, Homo sapiens
cggggcccacagaagttgcacctgcacagacacagacctgcaactcacgcacacacttgtactgcacacacacgcaaagtcacacatccaccctggaacacgcagccccgaccacacagtcaccggttgtccacatccgcacacacaacgggatgaa

SEQ ID NO: 673098 - DNA, 1099 bp, Homo sapiens
ctgttttatactgttgacgagggtttgtgtgtctgcccaaaggttctctggtggtattggaccctctcgaaatggctttctatagttgcgcgccgtgggttatctaacaggcgcctgcgtgcagagtagcccggcactttcacggagatcactctttcagaggcgaatctaaggcctttccctagggcggtgataaacagggggccaatcaaaaaagggtttcccctttggggaagtactcgtctgactggcgtggacattgacacccgatggggctaccactccctggagccaagggctgggaccccaagggttcctcccgatatcaacctcaccaggaggcacaaggaatggtagcaggagaacctcttcaggccctcgagagagcaccagagggacacgacacgttaagcgaggggacgacctgagggaaacgacaagaaaacattggctggcgatacccaggggcctgcagtgtcggtacagggaggaagctcaagggcggcgcataagcgcagtgagccacgcagcatctaggctgggaaggcctagctgaggtctcgcccacaccctgaggagccctggtctcagccccactcagtctgatgaattgcttagcatcgttctgcctttcgatctaggggcctgggtgggcctcattaactgctaggggtcccctttgagctctatgacttctggcctgaaggagggatgcatatgtcgtactcttgctcgtatccttgtacccacatttgggggaacactagaagagagggaggaaacaagtacagtccacagctctgcttaccagacactgtcctctccacccgcaagctttgaggaagagcatcccctgtcctcctttacctggccactgctgctgcagccaatatcctctctgcgcctgagaccctctccacagaggggatgtggtcctggtcacagacataacctagcagcagtaggataaactcccttcctatgaaggggaagcagactgggccataaggagacagcaggacatggctcaagtgcccaaggtttgtttagggcgtggcattggccatgtgtaattattgagtggagtatggtgggcctt

SEQ ID NO: 673099 - DNA, 146 bp, Homo sapiens
cggagatgtgtgtgctgactgagacggaaccgggagccgacagaaagcagtatgcacagagggctgagctcggacatgggggcagagcggcgaggctgtgcaggcacgtgggtgtgcaggcctcgtgcttgtcaggagagatcggg

SEQ ID NO: 673100 - DNA, 319 bp, Homo sapiens
caggccagtgaagaactgaatgaaatttctgagctggtgatactatttcattacattagaccatttagaaactatccagcaactcctaactgcagtactgaagaacattccattagtcactgcgtaatgtgaagatgccagctgcttttctgcaaattctgtggagcacttctatggctggaacattgcataaaggagagtcgttgattgtaaaacaccctgacgatgcgaaaagtcttacaagaaatcctggagaagaatccgagatttcaccacctgactcccctcaaaaccaagcacatcgctcactggtgccgct

SEQ ID NO: 673101 - DNA, 102 bp, Homo sapiens
gaatcgagctcggaccgggagtggagagagaaggctgtttctgtttggaaacagaaactcattgctagtaaatggagtagcagatgggaaacagtaattccc

SEQ ID NO: 673102 - DNA, 199 bp, Homo sapiens
  misc_feature (179)..(179): n is a, c, g, or t
aagcttctcaacgtagggaggggataaccgatggaaagagatagaaggcgcagaatcgcatttgctgtgatgagttgatctctagtgcgtctgcatgcggactgacaggccacactctgcagtggaccacagcattcctgaatacatcaggaagcacatgagatctcttaaaagggagngtgtaacctgcatttctaag

SEQ ID NO: 673103 - DNA, 236 bp, Homo sapiens
cgcgagactacaggagaggacaaatatacgcgctgaaatgtaccataaaaacctggaaagtgaactccggaaactagaaatagattcagcagatggggttcatcctttctttttggctcagaagtgacatactgtgtacgggggatctcgaaacgcagagaggacactgctcagctggctgctgatctgcctgaaggagtggctcagcccgtggatcttgcgggaggtgagactat

SEQ ID NO: 673104 - DNA, 237 bp, Homo sapiens
ttttttttgggggggggggggggcccccccccccaaaaaacccctttttttttttccccccggggggggaaggggggggggggggaaaaaaaaaaaaaaaattttttttttttggccccccccccttttttggggcccccccccttggggggggggggggggggcccaaaaaaaaacccccttttgggtttttttaacccccgggggggaaaaaaaaaaaaattggtttttttccca

SEQ ID NO: 673105 - DNA, 735 bp, Homo sapiens
agaaggaggagagcccggaaccatgtgtcctggagcggcgggcggagccgatgctgcggggaagccgctccgtggtgcccccacccccgcgcgcctcagtggtgcctggccgatgggcagggctcgcgagttgcggggtgctcgcgccgcttgtcatgtgcgtgcggggcgcgcgaggcgtgcggccagctcggggcagcggaaacccaggagaagctgaggggggggcgtgtagctgtgtcgggcctgaccgggctactgacgaagcgacttccccgtgcgcgtttttccccccagccttccttcccggccggtatgccggccccttttttccttccccttccacttagcgttccccggatttttgcgggcaaggtacgcggccatcgctttccacaagccggccgcctgtctttcccttcaaggaaccttcatcgggcgcgtgggttgagccccttattccccaggagggcaggttgaattgctaaacccttgttaaccccaaaagggagggaaaccaggcttggcttaagcctcatcaattggttacctgggtgggagcaccaattgtcccttaaaagcttcagggcacagcaattttaaccaaacaaagaattgaccccaagttccaataaactctcgagtctcatttgaaaaccttcaaacaagtctggtgaagaattcaatgttgaaaacatctctctaaatatgccgtgtacccggtgtctgtcacag

SEQ ID NO: 673106 - DNA, 166 bp, Homo sapiens
cgtatgtctcccaggtccagcatcagacatatgtaggtgctctgtactctgacatgtgactttattaaggggcatgtcaacctcttagatcactttcctcaatccttagaatgaataacttgtacacgtagccaacctgtggactagtagccggaccgtggactgg

SEQ ID NO: 673107 - DNA, 690 bp, Homo sapiens
cgccgtggggggaccccgcgcttgtgggccgggcgcggaccccgccccctgggttcaccccgcaaatcatcccccgctgtgtcacccagcccctgtgcccaagggggttaaaaacattaacgagtgcgctacccacgacgagtaggaaatttccccaccggcggaggccccgagagtcgggacatatggaggtaaccccaaggactactctggaggacaaaagacacgcccgctagggtagtcaccgactctttgtcaaaaccctcaccggttggtgctcgcccagacggagtagcatgaagggatctttcgcccctcactaggtgagggaccactatgagcgggataattcatgaagtggaagatacacctgtgcgaccgccccaaaacgatggggacatttcttgggaacgccacgtgcatttctccccctgtgcgcgtcacttaatgtttctattttcacaccggtatccacgttcattaattagtatccccaccaaccgtgtgcgctactatataccagtgagaagcacactattcttcttagcactcccccaaacttttgtaaagagctgttcatcatgctctcccaacgatagtggccccaccaaaccaaagaagtataaattctccttttctagcaccaccccccctttattaacaagaacatcttcaacgcacaacataaca

SEQ ID NO: 673108 - DNA, 392 bp, Homo sapiens
aggtagcttggtgttgtgttgcacgcctgctgtcctaggccacttgtgagagttgaagcaggaggacttccttcaacccagaaagtcaaggctgcagtgagtccgtgatcgcgacatcgctctcgagcctgggccacagagtgagaccctgactcaaatttaaaaaaaaaaaaaaaaagaagaagaaaagaaagggctgggtgcaatggctcaatttcttcttaaaaaaaaaaaaaaagggatacacgttgcagattgtgcgggttggacccttatcaagggattggtaaatacggtcccccaaagtgctgggtattacgggttgtgagccaccaccccgggcccttatttttttttttttaagggaccctcatttctgtttttcacagcag

SEQ ID NO: 673109 - DNA, 391 bp, Homo sapiens
ttcaggaacgttaactccatcgagggccgagggatttttgggataagtttagtttagtctactgcctctgaactgctgcctggcacataacatgtgctctccacactatttgctgattaaacagcatatacctagattatttccgcttacatgctatatttttggaaagccatcacactgttacggaaggttggaagggctaggttggtgtgtttccgtagagctttagtcgtctcaatgaatcttcagtgcagtactaccactggaaactccgcattccaggcaggcttttgtatgaaggaagcctgatggttatcatgtcctaatgttgaacctcagagttttcattaaggaaataagcgtgagatacgagtctccctttccaagtaca

SEQ ID NO: 673110 - DNA, 311 bp, Homo sapiens
  misc_feature (17)..(17): n is a, c, g, or t
ccaggagatacaaaggngagtgttactcattctataccctcttctggctctcatatgacttgctgggtaagaaagtagagaatttgttttttttgatcttacaaatgacccaaaaatctgctgggtcacctgagttaaggctgtggatctcgtgcagggattgtgaggaggatgagcaagtgatcaccatgttcacttggtatctactggcacaaatgccaaactatcaattctactgactcatctgcatctgcaactggcaggacatacctgtatcccgtgcagagcctgccagatgctactctgtagtg

SEQ ID NO: 673111 - DNA, 138 bp, Homo sapiens
taaaacaagcaaatttattaaaggaaaattttgctcctttaaggtttgcaggtgaaattttgtaggtgaaaaggttacttttcaccagtctatctggcatgctcaatgatgcagagtcacctggatcaatgatagcca

SEQ ID NO: 673112 - DNA, 1127 bp, Homo sapiens
  misc_feature (4)..(4): n is a, c, g, or t
  misc_feature (76)..(76): n is a, c, g, or t
  misc_feature (154)..(154): n is a, c, g, or t
  misc_feature (333)..(333): n is a, c, g, or t
  misc_feature (402)..(402): n is a, c, g, or t
  misc_feature (413)..(413): n is a, c, g, or t
  misc_feature (896)..(897): n is a, c, g, or t
  misc_feature (946)..(947): n is a, c, g, or t
  misc_feature (961)..(961): n is a, c, g, or t
  misc_feature (963)..(963): n is a, c, g, or t
caanaaggcccctcagttcccctcaagcctggcaccagccgcaggcccggtgtaactttgcagggataggggactncttttgaagacggaattttctcttaaatctctaagtgttttgaggtttgcaaaatctgttttcgggattgttctttcntcagttaaaataacaaaataacccagtgtgttcctgtagaggatccagggttttagaaccggacttgcgagtctcacctgcctggcccctctcccccagccccaggccatctgcaatctgttttaccagcacaggcctcccttcctctccctctgccttggcctctcccacacccaagngcccattcctgtctattctcccagggtggtgagtgagcctctgcaccacacttgccaagggtgctcacngagcaggcatnaggcccgcttactggaggaagcgagtctggactcgggctcaggcctgtggcgagccttcatgggggctgccctgcacctgtcctcagctggggcctgcggcaccatagaactttctctgtccaaaaggaaagcagacatctctccccttcgatgtgtcatcccccgcggcccccgagcgtcccacatgaacctgcagcacatgcccggaggcactgcatacagtggctgcaccccaggccatccaaagaacagcagcacctggaaggcagcagcacctgccagccctggaaaggcacaccaggaagctggcggggacagggtgtgctggcctgttccaggaactcggagctcatgtggccagggccaggtgcagcctggctccttacaggggccaggagtggcacgggagaagtaggtcgtcggctcccgtcttgccagggcctggacactactgctttttcctgtgcccccatttttgtccnngcatccctttgtgttgggattgcactctgtagcactggaatgatgtggnntgcaagtccagttngnctagtgaggacaacacagtgcttcccaggggctcagatctagggttgacccaggcttggggtgctaagggggagcccaaccagctcctgcccctgtgtcgggctcctccctctccactgcctttgtgctcccccctgcacctgcttcaagagggaagccacagc

SEQ ID NO: 673113 - DNA, 517 bp, Homo sapiens
catatgcagcaattctcctgctcagcctcctgagtagctgggattaagggtgcctgccaccacgcttggctaattttttgtattttgggtagagacggggttgtctccatataggccaggctggtcttgaactcctgacctcaggtgatccacccgccttggcctcccaaagtgctaggattacaggcgtgagccactgcgcctggcctcttttcccttcttatcataggcatccttgccctcatcaaactcaagattgtttactgtttgtcattataattttgattaatgtcatgaaaagggatgcatggagtattctaggaatatagcagggacccattgaaggtttcagggaaaacctgaaggcaatgatgtttaagatgagacaagaaagtaaaagtaaagtagatcaaatgaaagaatgagggagaaagtgtgttttggggaggggaggtgattaagtatcttctgccgaaaaggaagccatgtttgcaactaaaggcaagattaaaagtca

SEQ ID NO: 673114 - DNA, 205 bp, Homo sapiens
tgaccaggttaagagtccgtgtggccaaggagtagccaagccgccttgtatggcaagcgagacgagtctcctaagtccccgtcagtgtggttttcaacacaggactgtctcttgtcgttttcccctaatgccttctcctgccttttctgtgcctagtattttggctcttcacatattccatattgattttgacgctctgtatatt

SEQ ID NO: 673115 - DNA, 174 bp, Homo sapiens
ttttttttttgggacttttttggggcaaaggaattttggagattttagtgtcgccgcttccgggcgggttttggcccaaccttggggggttccctttccctggggcttttgcctaccaacaattgggttttttcttggggaaacccaaaaattttcccccccccgcccccccca

SEQ ID NO: 673116 - DNA, 202 bp, Homo sapiens
aaagggggcccacccaagcagggggttgggggcccccaaagccaaggttttcgccccggcttaaaaaggttaatttgggggggggggcaaaaagattgaagccaaggtaaataaatcccaggggggggggcccagcttgtaaaatgtcccccaaaccttttttgggccctttttttttaataacccccggttaaattcccca

SEQ ID NO: 673117 - DNA, 1544 bp, Homo sapiens
  misc_feature (1496)..(1496): n is a, c, g, or t
gacatggcgcgcgagctgcgtggcgctgcgtgtctgtggggcctgccgcctgttggctttgctgtgtggcgccggcgctggcggtcgtgccgggaggacaaagccaattctgtgtactctggaggaccataagcccagttgggcctccagtgtcgaaacccaagaccgtggcagcgttgtcatggtcacgtgacgactggcttcagccattgcgagaaaccggctacgtcaccacaggcaggacacacccttgtattcgacttatcagcatgacagagaagctgtgaagggttcacacgtgtccgaacagcagtgacgattccatggggcgatggacaaaagacaggcgtatgagtggacagcttggttaagcccgtgtcccatgctaccttcaaggaaacatacgaaggtgctgaattaccgcgtgagactgactcgtcacaaaaatgtcgcaacgtctgcatgcccttgagaagaaaagactagaggtctacaaacatcgtgaggttggtcgttggaccgggtcaccgaaacgccgaaacttgtccgaagcgacatatgtcgggcacgaatgtacaccctttgacaagaaactcgaagctagcctggatgaataacgggccaaccccatgataaagcaagtcctaaggggaataccgtggatactccggtggaacctgaagaagccagagggaaagtaagcgctgtgctgcttacacaaaacccacattgggcgagccagccccatatttggccgcaataaacatctagagggcggatcagataagcgggcccatataccccctaggggaaactgtgcgtatcatagacaaagataaaagcctaagggaggcatagtagagggcccctaagccaaggacaaatgcaccttcaatgtacagggacccaatggctattgtggggacgataggggaggtttacaataacctctaccatcattattcgagatcgcggtaggggacttggaggcaaagaacgtgttggcgcacgggctccactaagttgttgccccccggccacttcggagccaaaggtccacacacaggagcagcacaaagcccctgggggaagatctaacacacaagggtttgtgtgaccatatacgtcaaaaacattgatgcttatcgtagggacacagttggatttatgaaacaacaactacagcgaccggaaaccaggccgatacaccagaggacagatttctaagacagagcaccggtggcgatacaaaagacattacctgcgaattccaaattaccaaaccctgataatcacttccgcaatgattgcattacaggcaagcattatataccccagtacgcaacaggagaccacgactgagcattgcgcaataactggatgatgataaaacgcaaaggaatacgcacagaaactggatacgaggccagtgcgatataccccagtatgtgataactattgtaaatgtgtgaacaggggatgagaactgtaccacnccattgacacaagggaccacaacattgacaatgttaaagtgtgacaac

SEQ ID NO: 673118 - DNA, 740 bp, Homo sapiens
gcaactgctgggcacgacagagacgctggtgtggtctgcagcaatgaaaccgaggtagcacccacaccctggacctctccagggagtctctcggagggcccttggcccagatctttgacagccagctggtggctgcgcatctgtccatcagtcgtgaatgtgcagggcgtaggacgcgcctgggcttcatgtggccactacaggtccatccttgactgcccaaccatggcaggcccaggccctgtggaaggagccgtggcatggaatgtcgaccatgagtgtgggaatgccatcgatgtgtgtgcccatggtcaccggaccttctcgaggtacttctactcccgaaggattgactatcgaccctgtcgtcagtcaagtgcttccacaagctgggcctctgtcctatggggccaggtcgagctggcagggctacctgcgcatagcctcttgttgccatcctcctcccccaggacccctcgttccagatgcccctggatcctgttatgcctatgtcagtggccacatgggtgacgccctgctggagaagctctgcctacagttcctggccctggaacttcgaggccttgacgcaggcctgaggcctggtccagtgtccccacagactgctccaagtgctgctgcccaggagcgactggcggtgcccagcgagctggccctactgaaggccgtggacactggagctggggggagcgtgctccatgaggaggtggagggttggg

SEQ ID NO: 673119 - DNA, 294 bp, Homo sapiens
aaggcctgtctgattgcctcctttggaagggctcatcagaaactcaaaagaatgcaaccatttgtctcttacctacctgtgccctggaagtcctctcccacacttcgagttgtcctacctttccatattgatccaatgtccatcttacatatattgattgatgtcttatgtctccctaaaatgtataaaaccaagctgtgccccaacccccttgggctcatgtcatcaggacgtcctgaggctgtgtcacacctgtgcatccttaaccttggcaaaataaacttcctaaatcga

SEQ ID NO: 673120 - DNA, 437 bp, Homo sapiens
  misc_feature (257)..(257): n is a, c, g, or t
tgccttatgtacctgtagctcccaagagcctcgggcctggttgtgtgagggggggacaatggggcccccctgtgcctgctcgtgttgcccaaaagtccctgggtgttgagggggtggttcagcctgcaccccccccttgtttaaaaaagggcccttttgcccctttcaaaaaaaaaaggaagggggggccctaggcctttggctttctggtaaaggggggcaaccccaaaggttttctgggggtggattaaaaattngggtgtgggggttgaaaaccttttgtggcccccttggggacccacgcttttgtccccttttggttgccaggaaacaccaaacaaagccccccgggcattaaggtggttttaaaagggcttcgggatttttgttttgccctaaagtttttgggatttaacaaaaaaattttgtttgcccga

SEQ ID NO: 673121 - DNA, 267 bp, Homo sapiens
atcctcttcacagctttcagcaggaagtcgacgctggacatcgcttgtctctcagcgaagcagaggttgcgatgagccaagatcatgctgttgcattccagcctgggcaacaagaacaaaactcactccatctcaaaaaaaaaaaaaaaaatttctaaacatgggaaattcatttggcgggaataaaagggtcaagtcaaagatttgttaagataagggcataacgatgcctccagtttctgttaaaacacaccaggatactgtgat

SEQ ID NO: 673122 - DNA, 359 bp, Homo sapiens
tgggtcggcgtgatgcgtctataagatcgtgcgtggagacgctgcgggccttggggatgcacgccggtttgcgtcgtcgagcccgggtcctcctctgcctagacccaggtgtccagcttcaggccccgcctccctcagacccagaagcccaggccccagcctctcctccctcagacccaggagtccaggccccagccctcttccctcagacccaggagtccaggcccccatccctaatccctcagacctgggagttcaggcccccatccctgctctctcagacccaggagtccaggccaccagtgcttcctccctcagacccaggagtccaggcccccatccttcccctctcagaccca

SEQ ID NO: 673123 - DNA, 896 bp, Homo sapiens
attcggcaagtggtgcaatgaatggagtagagagatgactcagttatatatggggcctagaatggagtagaatcttaaataccgagagggatgaagatagttgaatgtagacgaggggacccattcttaataaaataatgtgtgtagtggttgcctatacgtgactccgtaccgtgaacactaatttactatacaattaaagtggtctgggcaattgccttggagatgaatgatttccgaagaggagagaatgaactgcgagcatccaatattgggagaacaggtgcagagaattacgagtagctattaaggggcggtatgcagactctaggatagaccagcggtagaacaaggacacctaaggacgtgtggtctgattcgtgcacagggtgaagtgagatacgtaagtagaaatagctgggtaaatagcatggtaatcgagaaaatggaggcatgcatcgagtgagaacctgtgaggccgcatgaggaattacctgggcgagtttatgctattgtatgaaccgggatgtgaccttcttggaatggctgaggggtaattgtatgagagtcctgtaaagagttggaatcgtgcctggtggttgctaggtgtttgtgacgtggttgattggtttggatgacagtgcaggaaaatgttgatagcaataggcgtgttagcggttccaagaatctctgctataacaaaggaggcacgggataaaaagctcgccagataaggaagttgctcaagttggttccgaactcgggttggacaccagatgtttgtggcagatccgggggcgtcttgttggcccactggttttgataaacttggttaaaagggaggcacacaagcacaaagttgcacaaaatacacgaaaacctcctgaaaatactgc

SEQ ID NO: 673124 - DNA, 99 bp, Homo sapiens
tgtcataaccctgtatcaaccctgccaattacgcggttagttgggcgctcgatatcgagcgcccaactacccgtttattaacaaggttaatagccgggt

SEQ ID NO: 673125 - DNA, 899 bp, Homo sapiens
ttctggatccggagctgtccatcagcaccaaaggccgcgggcgggctcagtgtcatgggtgccgcggttctggggcgtgccgagccccggctcctgcgccttccccttcctcaggcccagcccgagttcccggacgccgctgggactggagtgccagccggtgttggacagtggagcggcgcctgacaccgctgccgacaccattctctccgtgacccagcaatgccccacttcactctgcactgacgggacatttcaccatgtgaccccagtcagttggagcctctggctgccccgcaaaccccgtgcacccatcgtggccatcatgaccacaagcacatcatttcacgtcagacagcatcaggatcagcacatccagacccagacacgtatgccggggactgtgagcaaacactgcggattccagctgactgcacccctgagccagatgatgccttctggggtgcaacattgtgaacagcgccctggagcgcaggtaccaggcactgccggacctcgatctgcatcatgtgctgtaatgtattggagtcgtctactgcttcttcggttaccgctgcttcaaggcagtgcatcttccatcactgggtagctgaattggctcggtgggtcatcgttcctcactcatgactaccgagagcgggtgctagacgacaacagcaagagtgcatggggacgagacgacgggaaatagatcttgaggcactcgggattgctactagcggagctggatggccaactgacaagatgagacacgagagaggcctcataccctggagagggcagactgaacaggccataaatgacacgcaaatgcaggcacatgaatgagatcagaaacacaacaaaccagaccaggccccaagaggagataacatgag

SEQ ID NO: 673126 - DNA, 355 bp, Homo sapiens
  misc_feature (118)..(118): n is a, c, g, or t
  misc_feature (260)..(260): n is a, c, g, or t
ctggctgcgacatctgtcaccccattgatcgccagggttgattcggctgatctggctggctaggtgggtgtccccttcctccctcaccgctccatgtgcgtccctcccgaagctgcgngcttcggtcgaagaggacgaccatcctctattggggaaggttgtcctcttctgaaactacctttgcaaaaattatagcagtgagaaaattatgacagtgaaagaaatctgacctaattgactccatgcttgcttctaacctnccagctgcccttgttcattcctgggcatagggagcactaactttgggaggatttagtttatagtttaactttgaaacaaagatgattaacagccc

SEQ ID NO: 673127 - DNA, 389 bp, Homo sapiens
aataaactttaagtacagtaacagagactatccaaactgaagtacaaaaaaaaatgacagaccaaaaaggaaggcctcagcacttgggggcagtctgactgggtctaacctaggagtcactgaatattaagataagggttcaaggatgtaggaaattgtgatgaaatcacgaccaaaactttgtaaaattttatgaaaactctaagcatacagactcaggaagctcaatgaacaccaaagagaataaccttagaaacctattccaaggtatatcagaatcaaatagctacaaagtaagtgactaatagaaaatcttaaaagctaccaggggaaaaaagacatagtacatacagatgaataaagataataatggaagcagatgtctttca

SEQ ID NO: 673128 - DNA, 1020 bp, Homo sapiens
tcaaatggcggatgacggccggtgcagctgggggggcccggtggccctggtggccctgggatggggaaccgcggtggcttccgcggaggtttcggcagtgtgcatccggaggaccggggtcgcgtgccgtggacggggcctggggcctgaggtccgggggagctcgcggatggcatagggccgacggataagggagtggagtgccctgtcatccaagattggggcctgtattggttcaaggtagcatgaacatcgaagtccgctgcgaaggacagatctaatcttcttcgtctccatgaccgcagttagacggaatcgatgagtagtcatttgatttcgttccgtgcgggcgtccctcttctcgataggcattgagcgtttggagacatgacttagtgccaagtgctcatgaagcgagaccacgtatgcctggtcgcaagcgcgacctccggttctagaggcgcatttttgtttgcattagtctgggggactacataattgggcctaacgatccgtgtcgtgcgggtgtgttagatgttgcttctcacatggatacgaggtgcgacgccatccgtgccgatcccggatgggcgtgtccagtcgatcccttggtttccaacagtcttcctctccatccgtttcctccctgtatgctgtcaggcagtggcttactttggacgtgggcaaactaaagagatctggggacagattgtcacccccgaggatgttggatccccctgtgcaaaccgggttggaccaggggcgctgacattgagtggtcatccttgttcgcttggcgtaccggcgcgatcaattccgcgtgttaacccccatggtggggcctaccttggggcggatttcgggtcctcctggcaacccttggtgccccttagagcaaacgggcttgctccaattgaattggaggccagggataattcggattggaactggcgtaacaaggcgtccaggcccccggtggaggccttgcaacttggccccaacccccttggggccaaacat

SEQ ID NO: 673129 - DNA, 451 bp, Homo sapiens
gagcgtaagctgagacatctcccatcaagccctgattcctctgagcggtcgtggggctctctctcctcccagtggcctttgaactccgtgaggggcaagggactgggggctttcttggtcaccgggctttttcagtgatcagcccacaatgaacatgtaccataatgggtggctaacgctctgtatcaggggctggtctgtgtgctttcatataaatctggataacatttaattctcacaacaatcttgtaggaagacggctatggtcattcccattcgtcaactaagaaactggggccgggcgcgtatggctcacccctgtaaccaatcccagcacttgggcaaggtcgaggcgggcggaatcaccctgaggtcgggagtccgagaccagcctgacccgaccatggacaaaccctttcgtctactgcacatacaaaatcagccgggcatg

SEQ ID NO: 673130 - DNA, 853 bp, Homo sapiens
ttgtattcagcaaaagcccaggtcagcggacagtccgctcggaaaatgcgcctgggagatgcggtgaacagggtgtgattaataacacagtattaggctatttcatggccgcatctacctctacctcacgaaggtgggcaatatctccagataaactccgcttccggcgagcacatggagaatgagatggcccattatgcctgtgactgtggggatgcagaagatccaaaacgatcctacggttggattgagatgtgggatgtgctgatcgtccggtatgacctctcctgtcatgcacggaagccacaaagtcccacttgtagctgagaaacccctgaaagaacccaaaacagtcaatgtggttcagttgagacccagttaagggagcaattggtaaggcatataacgaaggatgcgaacactgggtgatggagtatctgccattgtgatgagtgctacattacagaactggtgatgctgtgcgtgagaacgggaattcacaattgagagctgaagggaatacatttcagtttagaaacgccatgatcaagtgaagagatgcagaaaagacggataaggggcagacaggtcccgatgtcatggagcggtcccttcgggcgggaggatcggtctccgatggacactacattcaggtgcgcgcaggggactgacgacagatctgagttcgcgctgaatgtcatgaaaggtgccgcccagtagcaacgggtcgccgggcaggaacgagccaccagaggatccaacacacgcaggacaaggacacaaagacaggagcgcagtagcaaaacccaaatacgcaggagacacggtcccacacgacagggcaagaaggaac

SEQ ID NO: 673131 - DNA, 575 bp, Homo sapiens
ctaaatttaactatagcctttacattatctctactaggtacttttatatttcgctcccacttaatatctactctcctctgcctagaaggaataatactatcactatttgtcataacttcaacatccacattaaactccaactccataatctccataaccatcccaattaccattctagtttttgcagcctgcgaagcagcagtaggtttagccttactagtaaaaatttcaaatacttacggaacagactacgtacaaaacctcaaccttctacaatgttaaaaattattttcccatctatcatactcctcccactaacatgactctcagccaacaaaaaaacctgaaccaatgtcacctcctacagctttctagtgagcctatttagcttagcactcctatgacaaaatgacgaaaattacctaaatttctcagttatattctcctccgattcattatccaccccactaaccaatctaaaaacttggggcccccctactaaatatggctcgctagcccaacatcatattacttcaaacgattaacacccccgaggggggggccgggtacccaat

SEQ ID NO: 673132 - DNA, 183 bp, Homo sapiens
tggtttttggtaaagacaggtttctccatgttgcctaggctgctactgaactcctaggatcaagcaatctgcccatttgggtttcccaaagtgctgggattacaggcatgagccatcacatccggctggggaatacttttaaaaacttaaagcgagttgaagggagttctgattaagagttat

SEQ ID NO: 673133 - DNA, 967 bp, Homo sapiens
  misc_feature (515)..(515): n is a, c, g, or t
aagatacgtcaagtggacacattgtacacggtaacttagatctgtggtaatctgtagctgggtgatttcaagagtatatgaacaaagagtgataggtagctagtcttcactggctagataatggcttcagagtgaggttcgtctatgatacataggttggtcttactccgtttcaattcgataactcatgtgcagtatcgggacagtaacatctagccgtgagaggtggatggtgttttacgtgggctattgaccttattcaggaggcacttctatcttcgtgtggtccatagaaaactgcaagaatattatatactggaattaagcgtgtcattattcccctcctgtctagcacaacaaagacactgaaacattatttgtttccaccacttatttttaggactttgaagaatatcctgaacatagaacgaactttttcttactacttcaggctgtcaattctcattgtttcccagcattccttgctattccacctacacagtttaaacttgttntggattccatcatttgggctttcaaacatactatgaggaatgtcgcagatacgggtaaataaaagatgttcttttattcatttgcctgcaatccaaaaatacaaatatagttaattgtacataggaaggtattacttgttcagagtttgagtgtgtgaattacatatatgaacatctgagaaaatcctattaagcagtttaatcactggtcccactccacattccaagtgaggtccatacggcgaaatgagtaatgggagaaggggccagtataattggttgcgtaacacaagtcaccggtcagtgatgttgtcaaagtcattaaatcgggcttcgaatgcgaagggtgcagcacctaatgggatttcccagtttaaaatccacaggttactacacattgggaaagcgtggccacaatccggctcacaaggccgtgggaaaccatttcccgt

SEQ ID NO: 673134 - DNA, 104 bp, Homo sapiens
ttgatagagggatcgcaatataaggagcaagcccccattttcacccgatcctagggctctccctataccaagctagaagggctagggccctaatgactagtggt

SEQ ID NO: 673135 - DNA, 233 bp, Homo sapiens
aatagtattctagcagtagtactctagtgctttagactcaccctagttactttgaaataccagtgaaccaaagaggactggagcatctgactcacaagaagaccagactagtggagacataaaaatacctctttatattggattgcaaggaaggttttctccactttgttggaaagcaggtggcatctctaattggagcaattcctgtagccatttctggagtactccagtgg

SEQ ID NO: 673136 - DNA, 526 bp, Homo sapiens
  misc_feature (246)..(246): n is a, c, g, or t
  misc_feature (414)..(414): n is a, c, g, or t
ccgaggctctctacctccttcctcagatccagcatcttcggacaatggtgctttctggcacatacctcctccctccctcttttcggggcggcggttacatgcatccatggccttcaatgaaataagctcaaagggagacgggaagaaatgggttatctcacatgtttatccggcttcggcccccagaaaaggctacattttcagtactcaagaagtctttactcggtaacccaaggatgacatatntgtgaaatgaggtatactttacatcaaatacacagattgaaaggatgcagctgggggagtcggggtaaatgtataatcatcatcccagtcgggataggaaacatttccatcatccttggtgcctcggtccaccagaattggattctggaccgcttgtgcaaggagggntatagcctcacagaaagtacccggtgtacaattcattatgtggtataaagcaaatctcccagggttaatttctaaaccaaactttatttatcaaaaataattaagggtaaca

SEQ ID NO: 673137 - DNA, 174 bp, Homo sapiens
gctgtaggattcctgggcagtggggctggttttcggtgggagagcagagctaggatgggtagggctctggagctcagatttgagcacagcgcccgacatgatggtatacgactggctgttggcagcagtgccctggctactgctcgccccggctgattgttggtagatgccagg

SEQ ID NO: 673138 - DNA, 971 bp, Homo sapiens
ggctccatcttgggcctgctgggactcgcgtcggttggcgactcccggacgtaggtcgtggtgggccgagttctgaggccgttgattctgctttacttttccactctagtgccacgatgcctgcttagtaaccatgagctgggatggaagtacagccgctgctgggcagaagcgtttaccgtcgcgttgatccctatcgcagggctcggtgttgcactctcaaagatataggcattctgatggcgagccttgtgtgtcaagagtaactgatgcattgagtcagacaagtggtctctgctctatgggtcaggctgtgcagttggcagagggcacttgatcatagctcacctggagtccgtcgagctctgtgggactcaagcgggtcctctttgcttacaggcctcccttgaataggcaagagactacgagtgttgtggtgtataagaaatagaccagagctcagcgatgtcaaagctacgatcggcagaaatttccaccaagtcaattaattgcgacttatggtacgcggttggaatgcccgttaatgttcccatggagacactgagatgagatggtttgaacatggaagactgtgtcgggtacgtgacggacgtacattatcttttgcacttaggagcacaggttgtggggattagaaagctacgtttatgtcacctaggtgtggctgagccagaacagctaagagggccctttgggtacatctcctttcagtgacttcagacgagctagcgactgcaagtggttccggaagaaggccttaattacttttggacttgacagaccctgctctggtctaaaacggaagtttttggtgttgggtacccatgtctgcgcctggaattggttcggcctggcctgagcttggaccgcttcttatggccatttagaaacgtcctgacctgttgcgaagacgcgccacctatttgcccctatgtcggtaatagcacaca

SEQ ID NO: 673139 - DNA, 380 bp, Homo sapiens
ctctgatgtagaggacgccacgatgcatgtgaatgccgcccgctttataaaccactcttgtgagcccaactgcttctctcgggtcatacacgtggagggccagcacattggtatcttcgccctgcgccgcatactgcgtggtgaggagcttacctacgactaccagttccccatagaggatgccagcaacaagctgtcctgtaactgtggcgccaagcgctgtcgtcggttccttaactgaggccgcggctgtccaccacgaacccttacaccttctggtgtcgtcgctgtcatcttggccctagcctgggggcttcctagacccttccagagcatattacccccacaccttatgtgtcaaggtggatgtgggctgcgtg

SEQ ID NO: 673140 - DNA, 211 bp, Homo sapiens
ctcagtgaaattgtgacatgatctggtggaacttgagatgtgcctggaaactatattaacagaaacctggatattttgaggagctcctaggtgagggcaaaaagaaaactgaaaaatgttactggagactagggggaagggattctatgtgatgcaacagcagaaagcaacatggctgcacgtggttacgagtgaaaagtacaaaataata

SEQ ID NO: 673141 - DNA, 383 bp, Homo sapiens
aatttcgactggctgatcacaacgggatgggctgtggcacgtgctggcatttttcttcacatgcaaccatgtgctcccccgtcttcttgggcaacgaatgaaatcccaacggttgtcattacgccagcgcttcagcaaaaagggctcctcccggcccggaggggcgggaccacaagtggccgtcacaggctgagatccgtctcttagatgttgatggggatgttggcagcagagccgaacttataggtgggacatacgcatggagtcgtcaactgtgaaccgagcagtgaaggggctgcctgggacgtgctgttcatttgtacttgactagaatgctagaagtacccacgtgacagcacaaggcaggtaggaacacgctgcat

SEQ ID NO: 673142 - DNA, 661 bp, Homo sapiens
  misc_feature (661)..(661): n is a, c, g, or t
agacattaacacgcacccaaaccaagaaactggcactgctcatggagagcaagaggatgtgatacagagatccacattacgtgtctcctcatcagagattactaatcttataggccttaatcatgtctcacactgcagcttaaatcgtacccctcaaagaaggtgcctgataccaatgtgaacatataatcatgactccccgggagaacatgataaataccatctctttcattcccccactttcctgggtgaaccctacccgagaatatgtcttatttgctgctctttcgcggaaaggaatcaccccccggggcgtcttccccctcctgattctatgaccagcttctcgagtatatcacctaaccctccacctaccccgtcatcccccccaacccaaccgtctccgccaccctatcatccggccccccccccggggcccccctttcaccaggtctacctgctcaccccctcccacgtgccttggatgttttcccgttccctccccgccggctcttatccgcccccatcacgcttttctcccttctctcccgcctcccgcccccggacttcagggagccccctccggatccttccactccggtcagccctgctcgatttccttcttttctcccactcccccctcatcaaccctctccgctcn

SEQ ID NO: 673143 - DNA, 213 bp, Homo sapiens
  misc_feature (89)..(89): n is a, c, g, or t
tttttgggggggggggccccccccccgcttttctttctggggggggccttgggggggggcccgggctttggggggggtttttccctcanaaagggtccccgaaccattggcggggcctgggggcttttcccgggggggggggggtttttggggggccccccggcccccccccccctttcccccccccgggttggggtttgtttttttttttta

SEQ ID NO: 673144 - DNA, 161 bp, Homo sapiens
tgttgtatgtctactactgcagaattagatcaattgatcatgcgtatcgcatacgaattagaacaattaaatgaaaaagatcaacaaattgctcgtatcattatcccgtatttaatcacaaaactaaattgtgattacagacgacgcgctcttacgcgggg

SEQ ID NO: 673145 - DNA, 408 bp, Homo sapiens
  misc_feature (30)..(30): n is a, c, g, or t
ggaaagcacacgcaacaggtatatattacngtggcatcactttcttgatatagttgactctgtgtccccaagcaaatctcatctcaaattgtaatccccataatccccatgtgtcgaaggaaggacttggtgggaggtgattggatcatgagggtggttcctcccatgctgtcttgtaatagtgagagagttcacaccaagatctgacagttttataagcattcgacagttcctttttcacatgctctctctggcctgctgccatgtaagacatgcctccttagccttccgccacaactgtaagtttcctgaggcctccccagccatgtggaactgtgagtcaattaaacctcttggctttataaattacccagtctcagggaagttcttggttgcagtgtgcttccg

SEQ ID NO: 673146 - DNA, 282 bp, Homo sapiens
ctttgttcgcttcattttacggcttgttcttcttgacaataaagggaggtgcccttaatagcttggaaaaagtaaacatctccctggcccatcccttcatttaaccaggctattcaagtattcctatgccagagcagtgccaactcttggaggtccagagtgcagccaatgcctttgtgtggtagttctaaattttaattgcaccttaaaacctgggcacctaagcaatgagccaaagcaaacggtaaggaccaccaccaaataaggtgttgttaatttgac

SEQ ID NO: 673147 - DNA, 385 bp, Homo sapiens
aacttttaagggaaattaacatgccccccccccatttaacctacctgccgggtagggaccatccctgcttttttgaagaagtgaaagagccctgatttcagcagctaagaaatggggtcttttaaggggatttagacattgcagattgttccccagagaagggaccttagcatttcctgttaataaggggcctaattaaggctaaagtccccagaaatggtaaagaaagaatcccctttttggggtgggggggtaaaatccttttttagtggctagagtggggaaccctgaactttttttttttttaaagagccatgaagcaagttcctggggggtttgcagaacttggataatgagatgaaaaaacaagaatggaattaatgta

SEQ ID NO: 673148 - DNA, 198 bp, Homo sapiens
  misc_feature (194)..(194): n is a, c, g, or t
gaacatgtgcatcctcatacattcattacttgtggaaatacaaaatggtacagccactttggaaaacaggttagccatttctcataaagttaagtataaatttatcatatgacccaggaattccactcctaagtatctatcaagagaagtgaaaacatgttcatacaaagacttgaatatttttattacatttncacc

SEQ ID NO: 673149 - DNA, 103 bp, Homo sapiens
tttacgcattttaaaatttacttaaatatgtttgtactgattttggtcccatctgggctgccttagagaggctattttcccacacttcaacaaacagtagatc

SEQ ID NO: 673150 - DNA, 489 bp, Homo sapiens
tgcacccacagcaacatataggtattaggcacagctggaaacattcctcttgagaactggaacaaggcaaggatgccctcttttaccactcctattaacatactactgagataaaatgcatccaaataggaagacaggaaatcaaacttctctgtttgcaaatgatatgatcctataccccccaaaaccccacagtctctgttgaaaagctcctgataaacaactttagcacagtttcaggacagaaaataaatgtacaaaaattaggagcatttctatacacgaataatatccatgcagagagccaaatcaggaaggcaatcccattcacaatagccacaaacagaataaaatatctaggaatatagctaaccaggagatgaaagatctctacaatgagttacaagatgctgctgggaacaaaaaaaaccaaacaaaccacacagagatgagcccaatcgagggaacaccatcccatactaagggaaa

SEQ ID NO: 673151 - DNA, 142 bp, Homo sapiens
tgagtcaacacatttttattaaacacctgaagttactgggaggaggccatgatgctggacacactgtcaaagtcaattttttccacaatgttcttgggtttaaagctctttttttggctacaaataaaaatctgcccctttt

SEQ ID NO: 673152 - DNA, 1194 bp, Homo sapiens
gtccctcttattaattcctttatctaccgccgaagagtctttgtgctgctgtgcccctaagggctctcgaccttctgaccttcattcaggtggtgcgccgagcctggtggctgctcactcccctctcccaggtcgctccccgtcccctcagacataattgattcttcgtccttttgagtacgaagaacaggtctgctcgtctcaccgaaaacgtgcgtgcccgtgaaccgtagcgaggctagcgcacgcacgtgatttgggcgagtgctcgatgagccagtgtatgactgataagtgcacaagtagtcctttagcaaatcggctgaagtatattgccttgtcgctacattgcctatcgcagtaggatacgtatacggacgcaaaccattcgtgttcaccctggctggttaggtgaaggaaaggacccgcaaacggtgcgtcaaagatagtgaaacagcatcgttagaccgcatcgtccgtcccgcttgtgatgcaacttcctgaacaaggcctgggcctgttggcgtgcaacaagcggcacatagaaactcacacggaaaatacgactggactactaggatgggactgcgcctcccggacgggtcccatgaccttccatctgaccctcgtagagtcggcccaggcaccctagtccgcggagcaagatacgccggaagcggcaatgtcacgagggaacccacgcttgggaacgcgatcccacggggaggcccatcagaggaacgccaaggacataacgcgcagaccagggaggggacagcgcaaagaggaccacaaaagcgatcacgaagcgaagacgacaaagcacagtagaacaaccattatcgcacggggacgcagaatgacgacaggacttagaccaaactagcccactatgtaaaagaagccccacccaacgggcataaaataactcaggagcacggagggccattgccagcgcgccacagcgaaacggggaacttaggggccgtgggaaaaacccaccggcgggcgacaaggcaagaccacgaaggaacaagcatgggctgaggaaacacccggaagaaaacgacgagtggaccccaagaacggcacaaccacccaaaacccagcgagggaacaaccgccgcacaggccaacgactaccgccaacagacatccatgcaaacctacgcgagaagtactaatcaataacaa

SEQ ID NO: 673153 - DNA, 647 bp, Homo sapiens
ccgctttcctctcgcgccgccgcagccgccacctcctccgcaggcagcccaccgcgaagcgaggtcgaataagccatggcagacgccaaggccacgacggcggtcaccctccgcacccgcaagttcatgaccaaccgcctgctcgcccgcaagcagttcgtgctcgaggtcatccaccccggccgcgccaacgtctccaaggcggagctgaaggagaggctggccaaggtgtacgaggtgaaggaccccaactgcatcttcgtgttcaagttccgcacccacttcggaggcggcaagtcctccggattcggtctcatctacgacaacctcgaatctgccaagaagttcgagcccaagtaccgcctcatcaggaacggccttgctaccaaggtagagaagtcacgcaagcagatcaaggaaaggaagaacaggacaaagaagatccgtggtgtgaagaagaccaaggccggagatgccaagaagaaataagaacatttctgtcttcatctattcactatcagcctttgcttggtttaggacggtatccctgtggcaatgttgctgagtgcttaattatgactagaaaagactttgccatttgtgtcaatctcccgttatgttaagagggcattttgtagtaaaaaata

SEQ ID NO: 673154 - DNA, 164 bp, Homo sapiens
  misc_feature (161)..(161): n is a, c, g, or t
catgtgtgcaggggaagtgtcgctacgtttactatgaggaaaaactcagagggcaacagggttatccgagatgaccaactctgaggcgaagttcgtggataccaaacacccatttcatgaaaataaaatcaaaagggaaatcaaaaataaagaaaacgctnaag

SEQ ID NO: 673155 - DNA, 245 bp, Homo sapiens
aacgaaaatgaaggctccggacattcagtcccaagccccatgttagaaggtcagtcaacgctggagctgagtcacaccggtctccagcacaaaatccactcaagcctctttacagacgatgaaatgggttcaaatgttcctcaacttataaggacaaacccatccattattttgaaaacgtcacaagtcaacaaacgcatgtaatatatgtaacctgccgaacaccataacttacatgcgttttt

SEQ ID NO: 673156 - DNA, 174 bp, Homo sapiens
ttcggcacgagcttgagcccaggagtttaagaccagcctaggcaacatggtgaaacctgtgggactgagaggctgcttggttgagaggtgggaggatcacttgagcccgagaggtcaaggttgccgcaccactgcactccagcctgggtggtagagcaagatcatgtctcaaaa

SEQ ID NO: 673157 - DNA, 301 bp, Homo sapiens
tatacatatagtcaataaggcaatataaaaaaaaattatatacctggagtagaccagattcttaagcttataggcttaagtcaaactaggcgcatgagcaccatcccacggtgaaggtcgagcaacttgatggactcttctggtgctatagtacaactggtgtgaatatttagtgctcagcagagtaaaactttccttagtatgggttggggtagcataatagggttgtggtgtatgtctccaaaggaagctttcatagtaggtattatgctttatatagctcagtataaggcagccctaa

SEQ ID NO: 673158 - DNA, 637 bp, Homo sapiens
  misc_feature (2)..(2): n is a, c, g, or t
  misc_feature (63)..(63): n is a, c, g, or t
  misc_feature (65)..(65): n is a, c, g, or t
  misc_feature (68)..(69): n is a, c, g, or t
  misc_feature (87)..(87): n is a, c, g, or t
  misc_feature (111)..(111): n is a, c, g, or t
  misc_feature (122)..(122): n is a, c, g, or t
  misc_feature (130)..(130): n is a, c, g, or t
  misc_feature (139)..(139): n is a, c, g, or t
  misc_feature (147)..(147): n is a, c, g, or t
  misc_feature (160)..(160): n is a, c, g, or t
  misc_feature (206)..(206): n is a, c, g, or t
  misc_feature (215)..(215): n is a, c, g, or t
  misc_feature (217)..(217): n is a, c, g, or t
  misc_feature (225)..(225): n is a, c, g, or t
  misc_feature (235)..(235): n is a, c, g, or t
  misc_feature (247)..(247): n is a, c, g, or t
  misc_feature (254)..(255): n is a, c, g, or t
  misc_feature (262)..(262): n is a, c, g, or t
  misc_feature (275)..(275): n is a, c, g, or t
  misc_feature (285)..(285): n is a, c, g, or t
  misc_feature (294)..(294): n is a, c, g, or t
  misc_feature (298)..(298): n is a, c, g, or t
  misc_feature (342)..(342): n is a, c, g, or t
  misc_feature (350)..(350): n is a, c, g, or t
  misc_feature (389)..(389): n is a, c, g, or t
  misc_feature (399)..(399): n is a, c, g, or t
  misc_feature (401)..(402): n is a, c, g, or t
  misc_feature (415)..(416): n is a, c, g, or t
  misc_feature (453)..(453): n is a, c, g, or t
  misc_feature (539)..(539): n is a, c, g, or t
  misc_feature (630)..(630): n is a, c, g, or t
cnggatggtcccccactttccacaaactataaacagcaacatgaacacagagaatcacaaatncnccnntctttcctcatgtctccnctccccccattcttccataatgcntcccagttcgnccctagcngcgccaggncatctggnagttctgggctgngggtggggtgcggtgggtggcctcagagtggtgcagatgcttccgngccagagananagccagcngggggggtgnatctgggctggngtgctcnnccagggncggggggaagtgngggccgtgtnctgggtggngggngcggaggacagagagacaccagtgctcttccacctgccatcggntataaatngagggttcctccagctgtgaggaggactccaaccactgngtcaccactngnngaccctcctctgnnatcaccgggggataccgatgctgcaggggctatgagnaggaggtcattgcctcggttggacatgatgtcctcaggaaccgtggtggtgatgatctcatccttggttctggggatcaggagtanaggaccctggtatctgcacagctgctccgcgttgtttagattgagatgctgcctcacggtcctggtcaccaggcccctccagctgtctggnatgacct

SEQ ID NO: 673159 - DNA, 778 bp, Homo sapiens
tcccttgtggcccaaatttttttttggggggggtcggaaaaaaccgggggtaaggggcccttttctttaccattcctttctaacaccagaaaagaaccctctcaaaggggagacatgaagagaagccccaaaaaggcttgtggtggcctcaagagggaccttgtgaggcgcgccaacaccttgtgtggtgcagtgagattctcctgtggccctctacaaagacggtgttggggaacaggtgggcaaccttcttgggcgcacacaggccgggcgatcttttgggtgttgccaaaagagagccccgggtggggtgaaccccctcgatagagatcttgcgcgcgcgggctctacacatatattttcagcgctctcgaggcaaaaatttcgcgcccacaatgtggggggggtttatacacacaccgcgggtgttagatcttcaggcgccgccggagagtgttatttgcgcggcgccacaaatagttgtgggtgcgtcccacccaccaaaaaatgggcgctgcgtctctaccacgagtgtttttcgtggaccaccaactggtgggtgttgtttttcacaccaccaggggggggagcacgtcgttttatcacatggagtagacacacagcgggtgtgtggagagacctcttcgcggaggcctgtctcaccatatttcttctcacagaagaagaatctcctcctgaagagaggagggttggtgcgcgccccccgtcgaacgggttgttgttgacacaggatacacctcctctccggaggaggacc

SEQ ID NO: 673160 - DNA, 1722 bp, Homo sapiens
tcacaatgcgcctctaccctctgatatggctttctcttgctgcgtgcacagcttgggggtacccatcctcaccacctgtggtaaacactgttaaaggcaaagtcctggggaagtatgtcaatttggaaggattcacacagcctgtggcttttttcctgggagtcccctttgccaagccccctcttggctccttgagatttgctccaccacagcctgcagagccctggagcttcgtgaagaacaccacctcctacccgcctatgtgctctcaggatgctgttggttggcaggtgctctcagagctcttcaccaacaggaaggagaacattcctttacagttttctgaagactgcctctacctgaatatttacactcctgctgacttgacaaagaacagcagactaccagtgatggtgtggatccatggaggtggactggtggtgggcggagcatccacctatgatggactggccctctctgcccatgaaaatgtggtggtggtgaccattcagtatcgccttggcatctggggattcttcagcactggggatgaacacagtcggggaaactggggtcacttggaccaggtggctgcactacgctgggtccaggacaacattgccaactttgggggcaacccaggctcggtgaccatctttggagagtcagcaggaggtttcagtgtctctgttcttgtcttgtctcctttggccaagaacctcttccacagggccatttctgagagtggtgtgtccctcactgctgctctgattacaacagatgtaaagcccattgctggtctggttgctactctttctgggtgtaaaactaccacatcagctgttatggttcattgcctgcgccagaagacagaggatgaactactggagacttcactaaaattgaatctttttaaactggacttacttggaaatccaaaagagagctatcccttcctccctactgtgattgatggagtagttctgccaaaggcaccagaagagatcctggctgagaagagtttcagcactgtcccctacatagtgggcatcaacaagcaagagtttggctggatcattccaacgcttatgggctatccactcgctgaaggcaaactggaccagaagacagccaattctctcttgtggaagtcctacccaacacttaaaatctctgagaatatgattccagtggtcgctgagaagtatttaggagggacagatgacctcaccaaaaagaaagacctgttccaggacttgatggctgatgtggtatttggtgtcccatcagtgattgtgtctcgaagtcacagagatgctggagcctccacctatatgtatgagtttgagtatcgcccaagctttgtatcgcgccatgaagacccaaaggcagtaataggagaccatggtgatgagatcttctcagtatttggatctccatttttaaaagatggtgcctcagaagaggagaccaacctcagcaagatggtgatgaaattctgggccaactttgctcggaatgggaaccccaatggtggagggctgccccactggccaagaaatatgaccaagaaggaagggtatctgaagattggtgcctcaactcaggcagcccagaggctgaaggacaaagaagtgagtttttgggctgagctcagggccaaggagtcagcccagaggccatcccacagggaacatgttgagctttgaatgggcggctcca

SEQ ID NO: 673161 - DNA, 462 bp, Homo sapiens
  misc_feature (31)..(31): n is a, c, g, or t
  misc_feature (66)..(66): n is a, c, g, or t
  misc_feature (96)..(96): n is a, c, g, or t
  misc_feature (161)..(161): n is a, c, g, or t
  misc_feature (454)..(454): n is a, c, g, or t
  misc_feature (456)..(457): n is a, c, g, or t
cgcaacctcctcaacctcaattagcctccanagaacggaagagagttagggccttgcccctggaantaagctgtggccctaaggaaagtgtttganctattttgacccactaaaactttcctttacatcagcagtaaggcctgtttcactttccttatcanttgtgccgtgaagaatcaactttaatttccttcaagaacttctcttttgcatttacaacttggctaattggtacaagagagctcacttttggcctatctcatttttggcatgcctttctctcaaagcttaatcgtttctagcttttgctttaaagtgtgagatctgtaactctttcagttgaacacttagaggctatcaaaaggttattaattggcctaatttcaatattgtgtcttagggaatgggaggcctgaagagagggagagagacagggaaatggcctgttgatgtngnnggttt

SEQ ID NO: 673162 - DNA, 860 bp, Homo sapiens
  misc_feature (633)..(633): n is a, c, g, or t
  misc_feature (675)..(675): n is a, c, g, or t
tacggctagtacgaggctggtttgaatcggcaccgaggttggaggctccgggcccgagatgatggctgcgagctcagcaaccccagtgccagcagagtcagactgtgccgggcagatgctggtaagtgcagtccacggattgtatttcggtggggccgctgccgtcgcggagccagatcacctgatgggaagcgggcatcacggtcgtgctaacagtggactcggaggagtcccagcttcaaggcggggcctggggtcgaggatctatgcgcgcctcttcgatgccattcgctggacaaacccgagacggacctactcagccatctggaccggtgcgtggccttcatcggttcatgcgcccgcgactgagaggccgtgcggtgttggtccactgtcttgcaggagtcaggtcgaagtgtggccataataactgcttttctaccatgaagactgatccaatttccctttgaagacaagcctatgaaaagctccagcattctcatagatccacgaggctaatgatgaccatgaggggtttgaggtggcaggactgaatagttatacccatggcaactgggatacgtacaggtggatacctctagtgcaatcttatacagcaattatcgtttacanaaggttacagagaagtatccagaattgcagaatttacctcangaactctttgctgttgaccaactaccgtttcacaaggattgaacgatgaggttctctacaagtgtagaaagtgcaggcgatcattatttcgaagttctagtattctggatcaccgtgaacgaacgtggacctataggctttggccaccagagaatgacccatcttcatgttacccaggaggcagc

SEQ ID NO: 673163 - DNA, 1009 bp, Homo sapiens
gactgcgataagcccactctgcatcaactgaacgcaaatcagccactttaattaagctaaggccttactagaccaagtgggacttaaacccgacaaacacttagttaacagctaagcaccctaatcaactggcttcaatgctacttctcccgccggcgggaaaaaaggcgggagaagccccggcgaggtggaaagctgcttcttcgaagttgcaatgtcaagatgagaatcacctcggagctggtgaaaagagaggcctaacccctgtctttagattgacagtcgaatgcttcactcagccattgtacctcacccccactgatgttcgcgcgacgcgttgacatatactctacgaaaccacaaagacattggaacactatacctattattcggcgcgagtgagctggagtcctaggcacagctctaagcctccttattgcgagccgagctgggcgcagccaggcaacgcttctaggtaacgatgcagcatctacaacgtgatcgtcacgagcccatgcattgtagtaatcttcttcatagtaatagccatcataatcggaggcttggcaacgtgactaggttcccctaataatcggtgccccgatatggcgtttgcccgcattaacaagataagacttcgtgactcttagctccctctctcctactcctgcgtcgcatctgataatagggaggcggagcaggaacaggtcgaacagtctacccaccttagcatggaactagtcccagcctggagcgcggagaactaacatcttctcttaagctagcaaggtgtcttaacgtaggggcatcaagtcaccacaccagatcacaatggaccccggagacagacaaggccctggagaacggcaacaagagcaatggcaatccgacaaggggacataaacaagcgagcaacactggcgggagggacataagctaggagccagaagaacagggaacgagaacgaaacgggagaaacgagaggaagaggacagcagcaaaacactg

SEQ ID NO: 673164 - DNA, 797 bp, Homo sapiens
  misc_feature (442)..(442): n is a, c, g, or t
  misc_feature (444)..(444): n is a, c, g, or t
  misc_feature (448)..(448): n is a, c, g, or t
  misc_feature (485)..(485): n is a, c, g, or t
  misc_feature (497)..(497): n is a, c, g, or t
  misc_feature (530)..(530): n is a, c, g, or t
  misc_feature (541)..(541): n is a, c, g, or t
  misc_feature (546)..(546): n is a, c, g, or t
  misc_feature (574)..(574): n is a, c, g, or t
  misc_feature (577)..(577): n is a, c, g, or t
  misc_feature (581)..(581): n is a, c, g, or t
  misc_feature (584)..(584): n is a, c, g, or t
  misc_feature (609)..(609): n is a, c, g, or t
  misc_feature (613)..(613): n is a, c, g, or t
  misc_feature (624)..(624): n is a, c, g, or t
  misc_feature (632)..(632): n is a, c, g, or t
  misc_feature (637)..(637): n is a, c, g, or t
gccacaccctttggtggagactcccatgggaaattcccattgagatcgcccgggagggttaaggcggaataaagggaatagaattttttttgggagaaaggatccccacaaccatttcggagaccggacgtggttgtgacccagtgaaattgtaaaagtggtgataaatagggttcttaaaacgtctagaaaggccactggataggctttttctctgaaccgtgtagtttttttggaagtaagtttttcacagtttaaattgtatcttgtaaaacaccccaaacccctaataattccccaaccccgattaccacacgagccaaactgttgtcccctctatttatctttgattttccgtcttggccattgtttaaaaaaaaaatctagatttgttttattaggttcagagtatgtggggaattatagaatccctctttcatcncnttgngtatgtcttttgttaacatatttgttatgccttattntaaaattgagtntccaactggaatgcctttgaagaccgatgcttntatagaggttntttgncctaaatagttcagcctttgtatttttnttntggnatntaatcagattcctaatcatagcccntaanaaggaatgttnctttaatnttggnctttgctcatgtgctcgtgtccccctttttttttttcttaaaatcatagccatatggtaaattttctattttgttatggttctcttttattgatgggcatacccgtgggtgttacttggaaatggcccatttttattaaaatatttctggaagaaattta

SEQ ID NO: 673165 - DNA, 1216 bp, Homo sapiens
ctcaccgtccagatatctcatcatacaaacgacttaatcaccagcccaaagcaatgactaatccaaactagacgctcaaaacagaataatagccatacacaacactaaaggacgaacctgatctcttatactagtatccttaatgcagtttctattggccacaaataacctcctcggacgtgcctgccctgcacgtacattgtacaaccaacgcatccctaactatctataaacctagccatggccatccccttatgagcgggacgcgagccgatttagtaggcttgtcgcatctacacggattcacaaagatgcgcctagacccacgaccatgtgctctcatcgccagccacatgggacgatcgatcgcgtaagcgaacccccacctttactacactcgcgatcatcgtcaggcttagtattagtctgagaaatcgcaagtcctagaccctcatcgtcactatcagaccgaaatcatggcgcactagggccgtaatctgcacgtaaaacccgccataaggcaatttacctgggagggcccactcgtaacgttcatgaacaccgtaagttggaagacgcacagccctagcgaagtgatcaagcctagtgtaaacccgttcccttcatagcagcagttaatcagtcgtgtcatgaactttcctaagttcggtacctggacgtatgcctatgaacatcgcatgatcgcgcttaaactcccaaggcacgtaacgatttgtgtcaacacatatcgatagttataggcgcgtctttgaccggtggcgaactgaagggatatcatctaataagtggaacaccaacacgaaatccacgatttgccggtattcgagtagttacggtaaaaaaacaccgaagacccaatgaacgccccgtaaccgaagggggcacgcttcttcaaaggccccgtccctaaaatggaccctcccgggtccgcttaggcccattgttggatttttcaacttttccgacttccccacttaaaacggcatgctctcgaataactaaggtgcccttagctaaacaccaaacaactaggcttaaagccaataatttacccaaagtgaattgggcggcgaatgttaaccagggaagaaaaagccaacatacgcatgggtccgaccaagaagagccaaacctggtcccatgaagaggccctttcggatacggggataagtccttatttatataccctcagaaa

SEQ ID NO: 673166 - DNA, 468 bp, Homo sapiens
gctcgactgtcagaattctaggcgttctgaacggcggtaattagcatatgacatgtcattcccttcactgagatgcagctcccttgatgagaagaccctcttctcacttcgaaaaagcttaatatgctaaaaatattttgtaaacattttcttggtggtaaagtttgccagcgactcgcaaacgcaatctgcgtacacaacatccaggcttcgatcgtggatttgcattcctatggagtgtgagcacataggcgcagattggaacatgatctatagtctgtttggcatggcatttgttggtgggccagtcataacccccccctcacgtccaccagtagcgccacagatggaaaaaggtcggtgcgacgaagcacaccgagtccagccggtcgagcatgccaccatggccttcgaccaatatggcccccagtccttaacccaacggtcgcccttgatcgccgacatgac

SEQ ID NO: 673167 - DNA, 389 bp, Homo sapiens
agctcggtaccggcatgtgctgtaggccagcgttgtgcaaaagggctgaagtgatagtgtatgtgattttgatatagtgatttattactactaacactgtgattagttaagttgttaatatatagttgtatatatttatggggtacaaaatgatgttatgattcatgaatataaagtggagcaattaaatcaagctagttaacaaatctatcaccttatacttattttttgtggtgagaccacttgaaatttactcacagcgatttttttctgttttgcttttgagacagtctagctctgtcacccaggctggagtgcagtggcacaatctcggctcactgcaacctccacctcccgagttcaagcagttcgctggcctacagcacatg

SEQ ID NO: 673168 - DNA, 130 bp, Homo sapiens
tcgtcagccgtaccaccagatttcacttccacagcaggctttatttgttctgtctctgggacctagcagttgaccctgggcaagttacttctcatttgtcctggcaaggacattaaaactctgccttgtt

SEQ ID NO: 673169 - DNA, 889 bp, Homo sapiens
  misc_feature (442)..(442): n is a, c, g, or t
  misc_feature (444)..(444): n is a, c, g, or t
  misc_feature (448)..(448): n is a, c, g, or t
  misc_feature (485)..(485): n is a, c, g, or t
  misc_feature (497)..(497): n is a, c, g, or t
  misc_feature (530)..(530): n is a, c, g, or t
  misc_feature (541)..(541): n is a, c, g, or t
  misc_feature (546)..(546): n is a, c, g, or t
  misc_feature (574)..(574): n is a, c, g, or t
  misc_feature (577)..(577): n is a, c, g, or t
  misc_feature (581)..(581): n is a, c, g, or t
  misc_feature (584)..(584): n is a, c, g, or t
  misc_feature (609)..(609): n is a, c, g, or t
  misc_feature (613)..(613): n is a, c, g, or t
  misc_feature (624)..(624): n is a, c, g, or t
  misc_feature (632)..(632): n is a, c, g, or t
  misc_feature (637)..(637): n is a, c, g, or t
gccacaccctttggtggagactcccatgggaaattcccattgagatcgcccgggagggttaaggcggaataaagggaatagaattttttttgggagaaaggatccccacaaccatttcggagaccggacgtggttgtgacccagtgaaattgtaaaagtggtgataaatagggttcttaaaacgtctagaaaggccactggataggctttttctctgaaccgtgtagtttttttggaagtaagtttttcacagtttaaattgtatcttgtaaaacaccccaaacccctaataattccccaaccccgattaccacacgagccaaactgttgtcccctctatttatctttgattttccgtcttggccattgtttaaaaaaaaaatctagatttgttttattaggttcagagtatgtggggaattatagaatccctctttcatcncnttgngtatgtcttttgttaacatatttgttatgccttattntaaaattgagtntccaactggaatgcctttgaagaccgatgcttntatagaggttntttgncctaaatagttcagcctttgtatttttnttntggnatntaatcagattcctaatcatagcccntaanaaggaatgttnctttaatnttggnctttgctcatgtgctcgtgtccccctttttttttttcttaaaatcatagccatatggtaaattttctattttgttatggttatgattttaagaaaaaaaaaaaaggcggacgaggagcacttgagcaaagtccaatatgaaagtaacttgccttcttacgggctatgattaggaatcggattaaataccagaaataaaaatacaaatggctggaactatttaggtcaaagaacctctagggtaccggagctc

SEQ ID NO: 673170 - DNA, 286 bp, Homo sapiens
ggaaaaaaaccccatttttcccaggcgggggttaaaaaaaggttaccccccattttacccggttttttaaaggatttaattttccccccaaaaaaattttaagggccccccaaaaattttttttagggcccccaaaacccccctttaaaaaggttttttttttgcaacaccagggttaaaaggaaacccggggggttttttttggacccacgcccccacccccccctttttcccccccccccctttttttccccattggggggggaaaaaaaaaaggggtttttta

SEQ ID NO: 673171 - DNA, 932 bp, Homo sapiens
tgctaggtagagacccggtgtttaatcaggacgagggtggatcgcttgagcccaggaggtccaggctgcagtgagccatgatcgagccactgcactccagcctgggcgacagagcgagaccctgtctaaaaatattacagagataggccgggcgtggtggctcacgcctgtaatcccagcactttgggaggccgaggcgggctggcatcactatgagtcgccgagattgtagacgcaactacgtgttgtaccaactggttgatgaacaccgctatcatccttaataaatactacaaaataagaccaagagaaaaccctgcgcggggcgctcttgtcggtggcgcaggcgtacgcagagaggcttgagggcgaggagaatttgccgctgaagcctccgtttcgggtgatgccagaccatgctaggtggagtcccagaatgagtgcggaagacacatccgtggcggggtccacgccttagtgggcgagacggccgtattaacatccgatcgtaaaaaacaccgtgttgtactcctggtcttacacgagaatttcggcccaactagcgtaacttaaaaaagggcggtatacctaaaaaatgcacaaaacatcttatggcacaccaatggctttgcgcaagcaactaaacataaaaataacaccctgatagccacaacgcaccccatcttactcgacaaagaccaacgagcctttcccctgaacgagtctcccacaaacggtacagctctaagtagccccatcacggtattgccaagcgcttctattcttgtgccattaacccacccccacactggtgaaggccaccccaaataatctctgaaacctccttgatcaatgtgcacaattgaacaacctctccgcattttccaaacaacagcactcttcatctgaccccttgtacccactcttcgtca

SEQ ID NO: 673172 - DNA, 420 bp, Homo sapiens
  misc_feature (22)..(22): n is a, c, g, or t
  misc_feature (43)..(43): n is a, c, g, or t
  misc_feature (113)..(113): n is a, c, g, or t
  misc_feature (130)..(130): n is a, c, g, or t
  misc_feature (405)..(406): n is a, c, g, or t
  misc_feature (420)..(420): n is a, c, g, or t
gtgaagcccaaccgtgcccggnccctgtttttggtttttaaanaagaacaggggtcttgctttgtaaccccccaggctggagtgcaagtgggtacaaaacgtaattcacctgnaatcctcaacccccccngggcctcaagggctccctctcgttttagccctcctcaagtatctgggacctaaaggcgtgtgcctacccattccctggctaatttttttttttaatagagatggtgtctcgctatgttgcccagtctggtcttgaacctctgggctcaagtgatctgcccaccttggctccccaaagtgttgggattacaggcatgaaccactgcacccagccatgtttttattttatctgagagaaaactgaggttcataacttaactgcatacttctggaatnntacacagagaaatn

SEQ ID NO: 673173 - DNA, 705 bp, Homo sapiens
ggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacaggcccgcgcattcagcacccatccattcatgcgcactcagaatgccacgagcacaccccaagggatgaccggttgaagagacagaagggggtcttcatctggcgtgggggcccatcagtggcgcgtaactgcaaccagacagactccagactcaggacgggcccgggaagcacatcccactggggactataagtctccccacgtacacggggtcaggggccatcggcaggcacaccacaaaacggatgcccgcactgagtgacaaccctgtgcctagctgatgagacccctgagacaggcctgaaggagaagaagcacaaagccagcaagaggagccgacatgggccaggccgtcccaagggcagccggaacaaggagggcactgggggcccagatgacccatccttgccagtgaccagctggcgggatgatgagggctg

SEQ ID NO: 673174 - DNA, 1204 bp, Homo sapiens
cttgacccatttatgtctagtgttccattattggaacgctaagcttatgggagttatttagagcctactgctcaaggtcatcaccaaggtctggttgcaaaaattcacaaaattgcaacctcaggcataaatggcttaagcccaagagatggcactgaccataaatggtggcttgtgtgtgaagggtttggacttcaagatatactaacacctagaaaactaaaagtgcaattgacccccaattactattttagtttgaggtatcaagggcatttgccaatctcttatatgtagcttctagagttgtgctgtccaatattatatccactagccaacgtggcttttgaaattaaaattaattaaaattaaattaaaaatgtaattcttcagtcacaccagccacatttcaaaggctcaatagccacgcctggcttgtggctaccatattggataacaagaaacacttccgtggttgaagaaaattttaatggacaatgctgtgtttcatttgaattcgttgtccttgaagaaaagggaagaagaggaaagaaacaagatttggtagctcttgggcatatccaagcatttttgattttagagaggccctatggagtaatgaaaaaaatacaagctgacacagctttaaatccccactgtgttatcttgggaaaatcacttcaacctccttgagtctcaatttgcaattttggaaaagaaaaacaatttttgtcctgtctttcttgcaagattattatgcaacctgattaaatgtacagatgtgcagactcttaaaaaccttatgttaatgtaacccatataaagtacgacttttggtcgagtaccagcacaaatttgcattcaaaggaagaatagttcatcagtgcaaaaagcgttcaaaggtaatcagttcatcacgtatcttgagaaaaagagaatgcattcaaaacacaaagcaaaattgcttcagtttcttttctgcccatctgaatatttcctttagtatttgtcccacatgacatccatcccatgtatttatccactctttcacaacattgcctatgaacatccttcaactggctcagttctttattgcatagagccacttagcttctctagtttcttatgatttcctattttacacttaacagcaaaaggaggcttccatttagaaggcactatctcaaacataaataatttcatattt

SEQ ID NO: 673175 - DNA, 332 bp, Homo sapiens
cctatcaagaggaggtggtagaccgagattctaaattgaaaaatgaaggccgggtgcggtggctcacgcctgtaatcccagtgctttgggaggccgaggcgggtggatcacaaaatcaggagatcgagaccatcctggctaacacggtgaaaccctgtctctactaaaaatacgaaaaattagctgggcgtggtggcgggcgcctgtagtcccagctactcgggaggctgaggcaggagaatggtgtgaacccgggaggcggagcatgcagtgagccgagatcgcaccactgcactccagcctgagcgacagagcaaagactcttgtcttca

SEQ ID NO: 673176 - DNA, 152 bp, Homo sapiens
ctgggcctagataccgagacagtgctataatgctcgtaatggcaataagtctcagcgaaaatgacagattgagacatatttcaaaaacgtgtatcataggtagacctgaagaggttatgtatattgaagacaggcacaggaaaacgtagaca

SEQ ID NO: 673177 - DNA, 123 bp, Homo sapiens
cgggtgctctgaggatcccgggtcggcaaaggtctgcagaaagttaaataaatcacaaagactgctgtcatatattaattgcataaacacctcaacagtgctcagagtttcatccgtttggtt

SEQ ID NO: 673178 - DNA, 151 bp, Homo sapiens
tgtatgactagcggatagtcagtccccagatgagtgagccccagagagagctctgagtacaagtacaggccagctcaggcccaaatcgccagctctcccgtctgtatctgcatctaacatcgatctgctgctcatgggaagaacagaattg

SEQ ID NO: 673179 - DNA, 1459 bp, Homo sapiens
tcagcggacgcgtgggtcgaccacgcgatcgagaaaactccaggatcccctgaccacacgactgacccagaccacaccaagaccccctggcagctgcccctcctggaagcagaaagtgcctttatctcagccatccgcagactgctcggacagatgcggggacaggctggaatgagggaggcagtcttcatcatcccggagcatcccaacaatcatacagagcaaacaacaagaaacaaaacaggagaatgaaagatgcaatgaatgaaagacaaatgaagaatcaagaataagaaagaataaaaaagcgaaagaaagaatgaaaaaaaaaaaacaaaaaataagaaaagatgataagagaacaggataatacagcaaacgatggcaaacatagactgaacaggacgacaagtaagagagcgcacacacaatggaaaacagaagacaaagaaaaagagacatgaatagaaaagagatagaaacaaatgcatacaccagcagagaatatgcgagaatatagagaacacaaaagtagaaaacatgaagaactagtgcacagagaagaccatgacacaatggaacccaacacaaagaaacaagcggtcccaatgtcagatgaatgatacatccaaagtctgaatcataaccatattaacaaaacaagagaaaagatcaaaacacgatcaatgacatataagagatccacaacaaaaacatactccctacaactacactacaaaataaacaattaaccaacacaaacacataccacataccttacaacaaaaaaaaccaaaaaaaacacaatcaccaatacaatacttactaacaatactacattacaccaacagaatacatcaacattaaataccaacaaaatatacaacaatatacaaaaaaaaacaaacaaatcacaataaaaacaatataaaacaccaccaacaacatacacaataaaaatacaccaaacaaataaacataacaccaaacaaaacacaaccacaacaaaacatcaacaaaaaaaaaaaaaacaataaacacacaaatactctactaaacatctaaacctaaacaacataaacaatataatacaaacaaaaaacacactactcactacctaatcacataccctacaaccaacaaccacacaataaccaaaccactacaaacacacacaaatcacaaaaaacaaacaacaactacaataactaacaataaaaaacacaatctccaaccaacacaaaaaaaatcaacataaaaaatagaacaataacaacaaaaaagaaaaataaaaacaacacaaacacaaaaaaaaaaaaaataaaaaatagacactccaattacactacaaacaaataaaatacatcaacaaacatcatagaataacacaaaatagctaatacattaaaacaatcagcaacaaacataaactacacaaaaactaaaaatcaaccagaac

SEQ ID NO: 673180 - DNA, 291 bp, Homo sapiens
actttcggattcagtggagaaaaggtcagacgatgcagacatgaatagatgcagctatggctagaagggtagcaaccaggttcctgctagcctatctgccttaggtgtatcacttcactttataagagcatgtgaggttcccataggattaagaaaaaacgtgtagagttcaaaagttaactgatcggtatcttgcatcggtgggtgtgcacccgaagctctgtacaatacgctatgagaagtatataacatgaacaaatctcaaaacaaactcgagactagctcttctcg

SEQ ID NO: 673181 - DNA, 506 bp, Homo sapiens
atgccaataacctccatctaaagtcagaccaaagaaagaatcttaagaactatgagacaaaagtgtcaggtaacccatatgttaatctaacttgttagattaaaggacatttttcagcagaaatctcacagatcagaagggattagggtcctatctttagctgccttaaacaaaataattgtcaggcaagaaatttgaatccagcaatcctaaggttcataaatgaaggagagataaattatttttcagacaaatgctgacagaatttaccacttccaagccagcactacaagacatgctataggagttctaaatcttgaaacaaaacctcgaagtacaccaaaataaaaccttcttaacgcataaatctcacagggaaagcaataactgacaatgggcgcgaaaacaacaaggtattcaagcaacaactagcatgatgcatataacagtacttcccatcttaaatactaaagaacgtaaattgccttaaatgtccccttaacaga

SEQ ID NO: 673182 - DNA, 828 bp, Homo sapiens
aacatactcggattctaccctagcatcacatcgactcgacacaatccccgtatctagagctcgttcttactgagcccaaaacctgcccctgactcctcctagcacctaacacttgactagacaagtctattacctaataactaatttcatcaggcaccagaaatctctcaccatccatctatcaccatcatagcccaagacacaccggcatacttgaacacttctactgtcctctctttcttctgtcccactcagtcctatagccctatcgtccgtaatcacattaacctatttcccccgtagacaactctcaattacaatatatacaccaacaaacaatgttcaaaccagtaactactactaattcaacgtcccatagttcatactaaatagacctccacgcaatcctatatattggatcactcccgtagagtcataccctggatccccgttactcctgtcatgaacattagtatcatctgtcctagcactattaaacgtttaccacaaccaccagaccatcatattctttcacccacagcaacagtcctacctccattgcttaaacccaactaaaacactctaccgaagcacctctaacgcccctgtactcacccgagagtcgtcaggatgaatcctcatatagccgactcgctgtgagtgatattcaaaagacaacgcatcattcccccttatgttaacttaagcttgagactattggaccctcaatataatccgtcccgcctggatagaatgcgaagccaattgcttgaataatggcttcttgggggagcgccatggtgtcgtgagaagctttttttaaaaact

SEQ ID NO: 673183 - DNA, 323 bp, Homo sapiens
catgagtttggtagaaaagtaaaagtaaaagctgcccccgttacatactgtttattgttttaatggccaactaactatttgcaaaaaatgtgatttaatttattgctgttttgggtagaaaaggagaactaatgactgtggatataacccatgttttgtataaaaaattttattttttgtgcgaactggtcatttaaaaaatctacttcctttgatgtttggaaataaaagggtatgggtccttgtaaatgtttttatcaagcaaaaatgccccggactcaaagtataacaatgtgttttcattaaaaaatacatcccccgga

SEQ ID NO: 673184 - DNA, 120 bp, Homo sapiens
aaggttatcgtgaactgtagaataggtgatagtgcctctggttggggcacagtttggttttagtggccctgcgcccgttacctgtgtgcgtactccttcgggacatgcgcgttggttctg

SEQ ID NO: 673185 - DNA, 952 bp, Homo sapiens
gaatcggggccgtaccatggtctggataagactcataagagtgtgaacgattgctcctggagcagttgtatgtgtagaaagtgagatcagaggagatgtaatctatcggacctcggacagtgatccaccctacaggcaagaattattgtcggaagctcgggccaatagttgatgggcgaggggaagctactagaagaacaggtcggccttatcgatagaatatgtcttacccagatattatcactcctgacgccgaagatccagaaccaaaagctatgatcattgcaccaataatgtgtttgacatgtgggttgtgattcccaatgccatggaagtatgggagtataataatgtcattgatagtcgagaacgcatatgtaggcacgataggaatgtaacagtatgtcgagcaagatggctgcaatctttggcggcttgtgtgcaacctacgagtatccatttgaatgcctcagtccctgatgaatacggctgactctagtggtgctagactgcctttcgatcgggggtggcagatcttgagtcgaccgcaggcccagaatagtactggctggtatgtttggactgaaaggtcttggcctgattaccagcaccgtaaagaagagtatgatgggacgctcactcagttatgaagttagtagcgttgtttacatgaggatagcattggccttggaccactggcttttgaactgggccagcgttgatgtctctgaagaacttcgagattaatcatgtgcctgattcgtaactggtggacggacaatgggtgccggacggccccggtgtcataaggtaattcaaaactgggccttggaacccataggtgtgaataacacaccactttttagtctccacaacacgcgcttttctcaagaaatcgcgcaaaaaacagcgcccaataggggagggcgacaacaccgtcgttgctcgccgg

SEQ ID NO: 673186 - DNA, 485 bp, Homo sapiens
  misc_feature (13)..(13): n is a, c, g, or t
  misc_feature (481)..(481): n is a, c, g, or t
tttggcatcggcngcttcactacagaagaggaggtggactacacggcggagaagtgcatccaccacgtgaagcgccttcgagaaatgagtcctctctgggagatggtccaggatggcattgacctcaagagcatcaagtggacccagcattagaggagtgggctgtgactttgtgctggcctggctgttctggcctcactgatctgtgcacagccaggaacctcactgcctgacgtggtccatgctcaaagcagatgggaagctctgcagtgacttcaccacagaatgttctctagttgaaagctgaggctagctttcttagcctcggtcctgtgtaggcatgtattccgtaatcttcctcaggagttcttctcttgcctggcgtggcaattcttatctgagggcctggaagcactgccttgttactgccacagggaggacctacctgtgcagagatggaagaactggaagaaggctctangttc

SEQ ID NO: 673187 - DNA, 204 bp, Homo sapiens
gaaaaggagtctcgcccccctgctcgccagcctgggcaacaaagttagactttgcctcaaaaaaaaacccaacccaaccaaagaaccagaatagcatgtgcccgtatacccaaacgtttcccaacgggcattatgttttgccactgttttatttccaatggatcccaagttttatgctttaataaaatttaatcataacttcca

SEQ ID NO: 673188 - DNA, 391 bp, Homo sapiens
gtcgaccatgtgcatacattataaaagagcttacattatctaaggctgtatcccaacacgatgaatgtctgtaggctgaagagccagatccatttgtagcccttccattgctcggaagaataagatgcaagcttcagaacaagtgggaccaatgaggctgcaggcttgaaagtattcggagagttgctggagttggcccacatggtaaagctgaagagcctgacactgtttctgtttttgctgtgttgtgcttgtttatgacgagttgctagtggcattttgttttgggaaatatctagagctagataaatgaaaaatgaacgaagcaatggatgaaggcatcaaattgatcgatacatgtattatgataaaccttagtcttttgtcgacg

SEQ ID NO: 673189 - DNA, 296 bp, Homo sapiens
ctatatgaggaacgtcactcatggctgtctattcattcttaatacaggtgttttaagaatttgaaacataatggcatctaggccgggtgcggtcattcacacctctaatcccagcactttgggaggctaaggcaggcgtatcacctgatgtcgggagttcaagaccagcctggcccaacatggcaaaacactgtcactactaaaaatacaaaaattagccgggtgtggtggtgtgcagctgtagtcccagctacttgggaggctgaggcaggagaatcgtttgaatctgggaagcg

SEQ ID NO: 673190 - DNA, 559 bp, Homo sapiens
ggagagaactagtctcgagttttcggaggtatttttcaagaaaaaacagggtttcaccggtgtaagccaggatggtctcgtcctgacttggtgatccgcccgcctcggcctcccaaagtgctgggattacaggcgtgagccaccaaaccgtggccccggaagtatctttaaagggattgacaccagttccgggcttctgaccaaagaaaaatatgtcccaggagactttgaacgaggcagacacggagggtggttggcagaaacactagcagctgctctcttggatgctgctggggtgctctccgaggacggtggtgtgacacagcgcacttacaacatgagcaggccgcctggcatccaggggtggtcctacaatttcagatgggtgcccctgggattgtgtgcgaacgccaagcctttgggcgcgcatggaaacccagtctcacaaagaaggtctacccaaggatcagcatagctaggacagagacgccagggtattatacaggcccataatgttgttgtacacgacaaaacacccgttctggcaaggaaagtctca

SEQ ID NO: 673191 - DNA, 510 bp, Homo sapiens
gtctgagcaagctgggtagacagcatttcacgctaatgagtaaattatccaagtacaagaaaaatctgatgttcaagtttagggaaattacccttacactttccaaatatttttctgttcctgaaaatgtgcacctaaacaaattcactgtgaccttattaagatcttcaatacttttttatacttttcacactgagtgtcagtctgaacgccttatccaccatttcccttagagaaaatctaagggaaggcaaactgcacaacccaagagaataacatgatagaagcttgctccccacatgggaccccttgtactggagggtggctgaacagacaagcaagatgagacaaattctggctcctcctacatcagttcctcccaatgtggttccacagtatagtttcaaatggcttcccagaatatctgaaaaacccctttttcctctacatcttctgcttcccactaccaccttcttaaaaatacctttcccagcttgctcagacggtatc

SEQ ID NO: 673192 - DNA, 456 bp, Homo sapiens
  misc_feature (13)..(13): n is a, c, g, or t
  misc_feature (155)..(155): n is a, c, g, or t
  misc_feature (160)..(160): n is a, c, g, or t
  misc_feature (166)..(166): n is a, c, g, or t
  misc_feature (193)..(193): n is a, c, g, or t
  misc_feature (196)..(196): n is a, c, g, or t
  misc_feature (225)..(225): n is a, c, g, or t
  misc_feature (228)..(228): n is a, c, g, or t
  misc_feature (231)..(231): n is a, c, g, or t
aaagtgttaaaanaagtttccttgtttagttagaagactaggaaagggtagtttagtgaggtagaaaatttaaagagttactgttctattaggttcacactatagaaaaaactatgtagccccacatttacacctgtagaggtgaatggggagcntaggntttganaacagtctagcaataaggaagccactntcnggggccatggaggagcagtaatgaggcantcntanttcctccagccagaactcccaccttcacgcaccagtaatgagccccccaatcttgagcatcagtcgaggttgaatggagagcctagacttcttcccccactgttagtaacaaggtgtgtacccttccctcccctgccacagtggtatcataaaatgccagctacaacagaacatttacagaagacccagagtctcattacatgataccccaaatatccagtttca

SEQ ID NO: 673193 - DNA, 286 bp, Homo sapiens
tgttgttgccgaggctggagtgcaatggcgcaatctcggctcgctgcaacctccgcctcctgggttcaagcgattcccctacctcagcatcaggcaatatacccaggtgacaaacctgcacatgtaccctgtgaatctaaaataagttaaaattatttttaaaaaacaaacaaataaaaagcaacaacaaagccccaagaattagctgggtgtggtgttgcaagcctgtggtcccagttactcagcaggctgaagcagaaagatcacttgagcctggaggtcgacg

SEQ ID NO: 673194 - DNA, 841 bp, Homo sapiens
cggaacacatttacgggtaacaccttctgtgcccacctttttataagcccaccaagtttttcgaagcccttcgatagctctcccccctattttaatacattcttgagggagaaaattttcaggaacacaaccagagtttgttttgaaagaaaacatctatcatacctccgctccattttcgtttacccacagaactcacaccccacttttattcccctcgttgtgtatgcaacctccaagcccgcacaaccttctacatctctggtaaaacttcaaggagtttttcttaaattgtcatccctgctttcacaaatgtatagtggtccccccaaaccccctttttccacgggttcgaccctcgtgcaaatctaccccccccctctttctaattactctccctaatcatatggtataatgttctccctcgcacaaacactgtgtgagctgtagaacaaaaccacatgttgggctagctcatcttctgctttctgcccccccccaacatattctactgccagaagccacctacgcaaccattttgtcttctgtggttattagaaatatacgtggggcaaaattaccatgtgcgcccacacgacaattctccacaaaatacactctgcaacgatgcacacgcgcactatggagagagaaatcatttattcgagaaaaaagtagtctcacctagactatccccccagttcaaccgtctttatagagatgtttattccacctttagagctccatggtatagtgtctttcttgtttagatgaatcccccactgtctggcgtcgacatagaagctcttcccccataaaacaaaaccaaacccacaaaaca

SEQ ID NO: 673195 - DNA, 230 bp, Homo sapiens
aagaccattgaaaatttgagaggaggctgctgagatgggaagggctccttcaagtatgccttgggtctttggataaaccttaaagcttgagcgtgaacgttggtattaccattgatattttcttgtggaatttgaggaccagcaaggatctattgtactattattatgcccaggcacagagagcttattaaaacatgtgtttcaggggcatcttgggttgctgtgcggtg

SEQ ID NO: 673196 - DNA, 589 bp, Homo sapiens
  misc_feature (27)..(27): n is a, c, g, or t
  misc_feature (421)..(422): n is a, c, g, or t
  misc_feature (468)..(468): n is a, c, g, or t
  misc_feature (485)..(485): n is a, c, g, or t
  misc_feature (516)..(516): n is a, c, g, or t
  misc_feature (573)..(573): n is a, c, g, or t
ctgcaggaattcggcacgaggctttgntcttttcgctgaggaatgtcttggatatatgggctctttcttggttccatataaaatttaaagtattttttctaattctgtgaagaaattcaatggtagctcgatgggaacagcatagaatctataaattactttggtcagtatggccgttatcacgatattgattctttctatccatgagcatggaatgtttttccatttgtttgtgtcctctcttatttccttgagcagtggtttgtagttctccttgaagaggtccttcatatcccttgtaagttggattcctaggtattttattctctctgaagcaattgtgaatgggagttcactcatgatttggctggttgtctattattggtgtataggaatgcttgtgatttttgcacattgattnntgatcctgagaccttgctgaagttgcttatcagcttaaggaggttntgggctgagacagtggngtttctaaatatacaatcgggtcatctgcanacagaggaactggcagaacttcagtactgtgttgataggagttggcttgtgcagttntcaaagcaatgcttca

SEQ ID NO: 673197 - DNA, 381 bp, Homo sapiens
ggctgcaggaattcggcactgtagcttgattcttctgtgagctttatagtgaagcagccgacacgagtcgttgttcataaaacagctctcgaaagctgttagcacacccctgatgaaccgactgtgcttgcttacgtctggatcatgacttaaaaatcgagtacaggtgatgaaatcttggcagcgttaacaaaaaagtagcgtgcatcgcgctatttttatttactgtagaaactcaaccattcgcagagaggaaacaaattttcacacattgaagctcattctgacatgtactttcaacctcaggcgccgcatcacggagacattctctgcccgttccagagtggtgcccgccccagaccaccgtctccacatgcggcg

SEQ ID NO: 673198 - DNA, 248 bp, Homo sapiens
gccacggcgcccagcctagcatgtctactttttaatgtgattgggccattgtatgtaggtaatgctcttccttagaaatatagaatgttttcctagggcctagggccccaaggtccattggtgttgttaaggtgaaaataacctttgattgttaagggggttcttttttttgtcttttgcggaacactggagatgattagacttcctgaatagagaaagcttatgtgcttgttaaattggggaacaac

SEQ ID NO: 673199 - DNA, 936 bp, Homo sapiens
cagggctaaggcgtcttggcctggtctgcctttttggtttacttccgaccgttcttcacctggatatttttaggacgtgttagactccccagcatgtgggggggcgattctccccgagtaccatatgggggggtgtctcctcgcgcccccgggggggtcgcgccgtcgttgatgattttgttcatgcttctcgtgcttattaggaccacactgggtctgcggtggctggtttttttggtcagacgactgccgccccgacccgactgggggtcgaatgttttttttctttcgcgggggggtgagaagtacacatccttctcgcacgaacgtcgtggggccctccatcgcgggcgctcaactagcatgggcgtcccctctctcttatgttggtggcgtgcggtcgagattccatccccctcttccccttctttctatgggtggggtggccgccccccgtgttgttttttctcccgcgccagggtctcctatgaactcccctcgcctctgctcatcattcgtgtggtggtgggaacaccccctgtgtgacttactcgttgtgtggcgtatcaaacacgccccccccccccctgcttgcttcctcttgggatgcaggggcgccccaccaacccactccagggcgggcttcctctagttatgcggtgcgccccccccccccgcggcggtcgtccccctctcccttttgtattttttatgctcgacccctcctccctgcgcggtgacctcctttgccgcgagttccttcttgttgcaccctctgggaggggtggcccaccgctgctgcgtttgtgttccccccccccccccccccacgcttgtttgatggatgtggtggcgccgccttttttccgggggggcccccccgcaacccccccgttttttttttttccaaaaaaaacccccctcccccccccaaca

SEQ ID NO: 673200 - DNA, 377 bp, Homo sapiens
tattggccaggccaggcgcggaggctcacgcctgtaatcccagcactttgggaggccgaggctggtggatcacctgaggttgggagtccagaccagcctgaccaacgtggtgaagccctgtctctactaagaatacaaaaaattagccaggcgtggtggtgcatgcctgtaatcccagctactcaggaggctgaggcaggagaattgcctgaacctgggaggtggaggttgcggtgagctgagattgagccattgcactccagcctgggcaacaagagtggaaccctgtctcaaaaaaaagaaaagaaaagaaaagaaaatagcgccaagtccattttcaaagtggttgtaccagtgtacctacccacaagcacctg

SEQ ID NO: 673201 - DNA, 385 bp, Homo sapiens
catatctgggctctgtcctctttgctcatcgtgattgtcggaatatgccatatgtctgtcaactgtccaggtatctcgttccatgcagctccccgtgagaagggttgtctgtaccttgtagcctccaactgcacatgcctattatttcgaatacgctgcactcctctatctccccatccgatgtccagcgaatcgaggccaatgagcctttctatccgatgtctattaccaaagccagactgcttctgacggtgagttgcatgtgagatatgcttggagtttccatgacgtatgtcccattactacattgtgactatggacataggcagtgtcggcaagattgggaagctagaatcattttgctggatagaatgtagagccgacc

SEQ ID NO: 673202 - DNA, 131 bp, Homo sapiens
tggtgcagtacaactaggcttaatagggacatgtctgtaataccccactttagaagccaaggcaggaggattgcttgaggccaggagttcaagaccagtctaagcaacatagcaagatgctgtctctacac

SEQ ID NO: 673203 - DNA, 932 bp, Homo sapiens
  misc_feature (18)..(18): n is a, c, g, or t
  misc_feature (87)..(87): n is a, c, g, or t
  misc_feature (102)..(102): n is a, c, g, or t
  misc_feature (164)..(164): n is a, c, g, or t
  misc_feature (191)..(191): n is a, c, g, or t
  misc_feature (195)..(195): n is a, c, g, or t
  misc_feature (205)..(205): n is a, c, g, or t
  misc_feature (212)..(212): n is a, c, g, or t
  misc_feature (267)..(267): n is a, c, g, or t
  misc_feature (352)..(352): n is a, c, g, or t
  misc_feature (361)..(361): n is a, c, g, or t
  misc_feature (374)..(374): n is a, c, g, or t
  misc_feature (398)..(398): n is a, c, g, or t
  misc_feature (603)..(603): n is a, c, g, or t
  misc_feature (789)..(789): n is a, c, g, or t
  misc_feature (920)..(920): n is a, c, g, or t
cctgctctgcctcttagntgcgtgggttgtgcttcatagacagagtagagatttatcctggtgagcaggaagtgaactcttttctcngataatgttgctctnaatcccaacacgttccatgctcccggctcttagcaggtagttggtggacacttggttatagnagctgggtgccagatgcctgcatctcnctgnggaatgtgtncagggangatgtcaacactggccgggaaaaacatcaggctttcacctcactcatggcctccntaagtgcgagcgctgttgtgtgactgctgtcgtcaggaaaatggtcctgtagcctttctcgtctgcccaggaaccggaggtctgngatctcagngaatgtacaaccnccgcggagaacaccaccaagatgnggcgcgagggactcactggaagcgcttgtcttccgtgtagtcatatctgtgaatgcggaagtcactgcgagttgagcagccgttccactcgtcatcaaggccctgctcagcttcgccgctctagcacctgctcaatgattcggcagctcaggggcacgtaagctccggctgaagacgtgagccatgtctcggggcactttcgagntcgatactgcgccgtccacacgtgggatcaaattcagctttttgctgatggcacgaaaattgctcctcttggccagagaactgaaggcatcagtaatctttcctgcagccttgtcggtcaccagcttgctcactttactctccacggctgtgagggtgtcccgggggcctgctccgttagagccangctcttcgcagattgggagaaggttagcaggtgctcagggccatagctctgcagatactgtgttttcagagatcggtaatccttggggatcaaaccattctcagtgatggacaaaaggcacatgaggcgcngctttctatagg

SEQ ID NO: 673204 - DNA, 432 bp, Homo sapiens
  misc_feature (9)..(9): n is a, c, g, or t
  misc_feature (64)..(64): n is a, c, g, or t
cggcactgntaggatccaaaggggtcccaatacatacctggccggaacattttatccccatggnctgcagaaataccacattccttttttaggcaccatgtatccattcctcaaggatagacccatatgttaggtcacaagtccttaaaacattaaaaaagttgaatacccatcaagcatccttcctctgacccacagtggaatacaactagaaactaataacaagaggaatttttgaaactacaaatacatgaaaattaaacaatatgctcctgaatgaccattgagtcaatgaagaaattaagaaggaaattgaacaatttcttgaaacaaatgataaaggaaacacaacataccaaaacctatgggatacggcaaaagcagtactaagaggcaaattgatagctataagtgcctacatgaaaaaaaaaa

SEQ ID NO: 673205 - DNA, 408 bp, Homo sapiens
agggctaggaaaatgaagttgggacttgcattcccagaaggctattcccagcctctagatgtttacagttaaggaaatggattaataatgtttactaacaaacccaaacttcggagtgtccagatatcccgatatctcgagaacaaaggcattcctaattttgcttcaaagataataatattgattcttgcaaaatttggtaattttaaaaaagaatcctttatcacaaaccctgtagcagagcacatctccccatgatctttttttatcctatatatatacaagcactgtacctagggtggatgcattcctcctcttacttttgggaatgccctattctgtctatggagtagctgttctttcaccacttgactttctaaataaacttgcttttgctttgcaaaaaaa

SEQ ID NO: 673206 - DNA, 306 bp, Homo sapiens
tgcgggagtatttgacaagtgtcatagtctcgcaaaaaatctgagaaacggcgcacctcgggattctttcttttccacttgttgagcaaggcctccaaacccaatacccgtggggccaaaatttttggcatagcaaactttgcaataaagttccccatctttgtcagtgacatgggtggactctagacattgccgacagactgctgaggatgaacaggtcttatgccaaggcttgccacctcccataaccttctcagcagcatagactgacttgccacatcgagggcacttctcggactctccaaa

SEQ ID NO: 673207 - DNA, 218 bp, Homo sapiens
ggacagatataatgtacagtaagaattctatatcaattcaggatcgagatatgaagcgaaataccttagtgaaattgctccactttttggaaaacttggcattttcgtctactgctcgatttgacagcaaagataaaattctgcttacgttggaaaagcatagggggttctagtgactagccagacatcaagagacaccaccatgtatgctgtgtata

SEQ ID NO: 673208 - DNA, 190 bp, Homo sapiens
  misc_feature (30)..(30): n is a, c, g, or t
  misc_feature (52)..(52): n is a, c, g, or t
cacacacccagttagtcaaatgagtgcatntaaaactggtggaatctgaatntggtccgcgaattgtaccaatggcagtttcctggttttgatactgtgctacagttatgtaagatgtcaccactggaagaaactgggtgaagggtacatagaagcttctctgcaactattttcccaaatctacaattat

SEQ ID NO: 673209 - DNA, 228 bp, Homo sapiens
gccctgctatgtaggatacagttctaagtgaccacttcctttaaaagcgatggcaaaggcctggtacagtggctcacacctgtgctcccagcactttgggaggccaaggtgggcagatcacgagatcaggagatggagactgtcctggctaacatggtgaaacccagtctctactaaaaacacaaaaaaattagccaggcatggtggcatgtgcaagtagtcccagct

SEQ ID NO: 673210 - DNA, 528 bp, Homo sapiens
tgaacctaataacgtatatggaggtccaggctaggggtcaaacgggagctgtagccaccggtctacactacagccacagcaacaccagatccaagccacatctgcgacctacaccacagctcatggcaacgccggatccttaacccactgagcaaggtcagggatcgaacctgcagccccatggttcctagtaggattcactaaccactgagccatgacgggaactccggtgccctagttctcaaatgggtggtaccaatccctgtagggagaaatgtggaaggagactttgatggtcaacaaggattttcggggcagtgaaactattctatctgatactacattggttggcatgtgtcttaagggtgttggtccaaacctgtagaatgtccatcgtaattagggttcaaaccctaattaccgccaccagctatcaccaggctcgattaggcctttcacctctacctacaagtctactcactattttgccacatagatgagttggatcttttaacactgtcatgggta

SEQ ID NO: 673211 - DNA, 134 bp, Homo sapiens
agtagggcacaactactcataggtagcttcctctatttcgtcacgtgttccatcttcgtctcttcaactccagaggggatatcctgcaccatgtccgctgcctcacacaactccttgcccctctccatatgcaa

SEQ ID NO: 673212 - DNA, 112 bp, Homo sapiens
ccagtatgactggtgtcttaacaaaaagggaaaacttgggcacagagatgtacataaagacaatgtgaagagtcatagggacaagatgccttctacaagccaaggagagagg

SEQ ID NO: 673213 - DNA, 385 bp, Homo sapiens
attcgcggccgagtccacgagcgagactctgtctcaaaaaaaaagagatggagtctcattatggtgcccaggctagatttgaactcctgagctggcttagatttactttttgagtgttagaatatgtagatatttattagccagcctctttaaaagtatggctcagcgtaggactgttaaaaacttgttaactgtggaagaagtatgactgagacaatcctgattgttttgtaaactgatgtttgcttgtttaagaaatattaatgtttgtaatcccagcactatggaaggccgactgggaggattgcttcggcccaggttatagtaagctatgctcttgacactgcacactccagcccgggtgacagcaagactctgtctctta

SEQ ID NO: 673214 - DNA, 103 bp, Homo sapiens
cacccatgatggtgttgcaactgtgcccgttggtccagctgagtcctcagaagctccaaagaggttttaactctggtttctcagtcccatcttgagcctgtgt

SEQ ID NO: 673215 - DNA, 704 bp, Homo sapiens
  misc_feature (704)..(704): n is a, c, g, or t
gtactcccagctgtgccctaaccactacgtgtctcctcgcgctgcacatgcaggatgctctactgccttacttatactgagggcaaggttgatgccactgagaggcatctgctcccaagaaagccagagcctgcgaggtgtatgactatacgccttcactcaagatagctgacgggcatgggcaaagcgcacacaggtctgctgctgataggaaatactgttccctctccccacccagcaccatggcactgcaacaggcccagaagacgctgagcatgaacaggctgtatgcgatggcggacgtgcagcagaacaacacagagatctttgctgtcgcactctgccacctcgcagagctacacgcggagcagggctgttttgctgcacattctgaagtgttcaagcacttgaaggaacgatttccgcctaatagtcagcacgcccagatatggatgctatgtgatcaatacagtgtgacagagcaatgaatgatggcacatatcatttggctgattcacttgtgacaggaatcacagctctcaatctcatagagggtggttattggacagcggttgtattacaagctcagaacccaatgtcagaggcgcataagcttttacatactgtccggggcagaggtgaactggcgatcttcctccctaccaatgcgctgcccatgctcctgcaggtctggcctcttcggn

SEQ ID NO: 673216 - DNA, 138 bp, Homo sapiens
cactggagtagaggtaaagattcagctccacacaggagaaaccctggtattgcctggggtgctacaatgttctgggtctgccttgtgctacagtgagctccccatcagaactctgcaagcagaggcaaggacatcaag

SEQ ID NO: 673217 - DNA, 430 bp, Homo sapiens
ctcaaaagatttaggtctggttctataaaaggatcgaggtatttccaatccccgtcgaggtcaagatcaagatccaggtttttttcccgaccaagaagcagccgatcaaagtccagatttccctctccaaaaaaaagtcgttccccctcaggaagtcctcgcaaaagtgcaagtcctgaaagaatggactgaagctttcaagttccccccttagggaaaagttattttgtttaccttattataagggatttgtgatgtctgtaaagtgtaacctaggaaaaataattcaaccctttaatcaaaatggatttggattactatgtaaattcccaccagtaaaataatataaattttgttgaatgtattaacctcatatggtttgaaaatgtgggtttttatttggcccctttaaataaaatgtttttaacta

SEQ ID NO: 673218 - DNA, 181 bp, Homo sapiens
caaagaggtagacaaccagttctccacagcagcacatttttcataggaacttaaaaacagaagccatgtcttgggatggctgtccacacctggatccagaaagcattcattcattcattacattcatgcccggctaattttgtaagagacagggtttcgccgatattgaccaagctggtct

SEQ ID NO: 673219 - DNA, 504 bp, Homo sapiens
  misc_feature (173)..(173): n is a, c, g, or t
  misc_feature (176)..(176): n is a, c, g, or t
  misc_feature (183)..(183): n is a, c, g, or t
  misc_feature (189)..(189): n is a, c, g, or t
  misc_feature (260)..(260): n is a, c, g, or t
  misc_feature (283)..(283): n is a, c, g, or t
  misc_feature (321)..(321): n is a, c, g, or t
  misc_feature (403)..(403): n is a, c, g, or t
  misc_feature (483)..(483): n is a, c, g, or t
ttccacaggtcataggctggcattgaacccaacatggggagcagctgggttagcagccatctgcccattctgtcctgcaagtgacctgctagctatggtccagtgtgaaaagatgtgatgagtggggccaatcagattgcctgtcttgggaatttggtgtgaaaataagcacngcnactgccnggttgnagcagatatgtggtgtatatgtagtggcttagaaaggccggaactggtgtgatcgttaatattgagtgtcnacttgattggatagaaggatgcnaagtattgatcctgggtgtgtctgtgagggtgttgccnaaggagattaacatttgaatcagtgggctgggaaaggcagactcacccttaatgtgggtgggcaccatctaatcagctgccngcgtggctagaatataaagcaggtagaaaaaaaaaaacgtgaaaagactagactagatgggcctagcctcccatcctacntcttcctcccctgtggaaaag

SEQ ID NO: 673220 - DNA, 349 bp, Homo sapiens
  misc_feature (14)..(14): n is a, c, g, or t
tctctgcctcccangattcctatgcggcactgcccgcagcgtgtcacagggtcctttgcgcgccacctggatctcccgcccgatggtacaggccgtggcctccatgctcgcacgcgctgcggtatgtgacgccgtcgctgccgcgggtgcggatcttggtggtcgtagcaaatattcaaacgagacctttgaaggcctgaagtgacgaaggtgtcccattgtgaacatgcaagttgaacatgggtcaagtcggccctgagagatgggcgcagcgccgtaccgaatggccggggcgatgccatccggttgccatcgggctgatcgaaagggagtcgggttcaagatcccc

SEQ ID NO: 673221 - DNA, 440 bp, Homo sapiens
acgcgtgggtttttaagccggtctgaaaagcgcaatattcgggtgggagtgacccgattttccaggtacgtccgtcacccctttctttgactcggaaagggaacttcctgaccccttgcgcttcccaggtgaggcaatgcctcgccctgcttcggctcgcgcacggtgcgtgcacccactggcctgcgcccactgtctggcactccctagtgagatgaacccggtacctcagatggaaatgcagaaatcacccgtcttctgcgtcgctcacactgggggctgtagaccggagctgttcctattcggccatcttggctcctccccagacaactttgcaccatgcggacaggtcaaatgagaccagaagtattatgaaccaatgctaatcaggactgtttcctgcactctgagaccaaaggggccattctcacaaagaaaga

SEQ ID NO: 673222 - DNA, 91 bp, Homo sapiens
acccgggccccccctggggggttttttttttgggccttggattatgtttgggggttttaagggtttttacgggccggcttttcccccccca

SEQ ID NO: 673223 - DNA, 1001 bp, Homo sapiens
gagacccgccgacacgagcagagcaacctaaaaacggtccccccccagacgcggacaggaaaaaagggtctggacggcgaagaagcttcacctgcgggctacaagactggaaccgtgggccctaaagccccaggctctcttcgatcagggcggcatatccgagaagcgatgcccacatgcccacggacagcgaagcgtggattgtccaatggggcccaccgaacacgtgagagcaagccagtgcaagaagctggccaagcccccgggaaggtagagctgggaccacagctctgcaccttcacagtgcactgaaggtacctagggctcatttggaccttctgcgcctgctatggggacctgacctggtggtgtcagtcactgctgacaaccactcagagctggaacccaagatcctagatagtccgtagatagcacttaggacaagaatgtgcattgactgggggtggatgactgaggtgccaggcactgggtagagcaccatggtccacgtggattgtctcagggaagccttgaataaccatctggaggatggatgaccagcataagggcccatgtaggacagaaggcaaagtacaggtccaagaattgggagcgatgggagcgagatggcttcccccaactatagggatcgatcgaggcgagagggaagcccttgctgcctgccattcccagaccccagccctttgtgctcaccctggttccactggtctcaaaagtcacctgcctacaaatgtacataaggcgaaggttctgatggctgccttgctccttggcgtcgcgcccactcccctgtcgaggactttctctaggaagtccttccctgactacctgtgcaccagagtgcccctacattgagactgtattagccctcgctatcagatgccagatcatatgtgtctgtctgtgtgtccatcccgccgaccccccagaatgaacctccaggcatggactgaatctggttcatcctctctgacacccct

SEQ ID NO: 673224 - DNA, 354 bp, Homo sapiens
ctatggacttcttcagccaacctggactcagacagaagacaaagaaggattaaaaaaggaaagaaaaaaaaatcagaagagtgagactctgtctcggaaaaaaaaaaaattacagggtaactacagcttagaggacttgaacctggagcagggactcatttatcacccttacgttccccagggttaaagcagccgccttccaaattactctatctcagagataatgagactagaacaggggtcgggtaacgggtcgatggggacctatccggatgacacaccagcaactaccaggccagcaatattacagtgagtgggtatgccggtatgatgtccctgggcagctaaaagtta

SEQ ID NO: 673225 - DNA, 293 bp, Homo sapiens
  misc_feature (6)..(6): n is a, c, g, or t
  misc_feature (9)..(9): n is a, c, g, or t
gcagcngtnaacctccatctggagctcctcgtgcacactgtcgatcttcgtggagaacggggagctgaacagagtcagttcgctttcgtagagtttgaaatcagacagccttttctggaattcggtcttgagttccgcgattttgggaatgttgttcaggccatcgctttcatttctggaagccaatttcagggtgggaaagtgggccagattattcctcgtcaaatgagtctcccagaggcacagttttgctaggaacgcccggatcaggtcatacatctgcgtgacgattt

SEQ ID NO: 673226 - DNA, 463 bp, Homo sapiens
atttttgtatttatgtagagatgggattttgtcatgttgcccaggctggacttgaactactgggctcaagcaatcctcctgctttgccctcccaaagtgctgggattacaggcgtgcgacccgcgcccggcccccccaattactcttaaaggtaacatcactattgtgaacctaagatcagctttttgagatgccttttcaggtgtaatggttaatactgagtgtcagcttgattggattgaaggctacaaagtattgatcctgggtgtgtctgtgagggtgttgcaaaagagattacctggggaaggcagatgcacagttaatctggtgggcacaatcttatcagataccagcgattataaagcaggcagaaaacattaaaaggacagactggcctagctcccagcctacatctttctcccatgctggatgcgtcctgccctcaacattggctgaagttcta

SEQ ID NO: 673227 - DNA, 610 bp, Homo sapiens
  misc_feature (18)..(18): n is a, c, g, or t
  misc_feature (22)..(22): n is a, c, g, or t
  misc_feature (37)..(38): n is a, c, g, or t
  misc_feature (40)..(40): n is a, c, g, or t
  misc_feature (44)..(44): n is a, c, g, or t
  misc_feature (48)..(49): n is a, c, g, or t
  misc_feature (68)..(68): n is a, c, g, or t
ggagagcacgccctgganaganggaatggtttttttnngncctntggnngaagaatccccagcacagnaaaggatataggactaatacgcttccgtgagaaatgttttagatgaagataatgataatgttgggcaacccaatgagtatgacctgaacgacagctttctagatgatgaggaagaagactatgagccaacagatgaagattctgactgggaaccaggaaaggaagatgaagagaaggaagatgtggaagagcttttgaaagaagcaaaaaggtttatgaaaagaaaatagtaactaacttctgtagtcatatctgccttacatttactttttctttgtgggaaaacatttatgaactaaggaggtacttaagtgacagttattttccttcttttgatagttaatgacttttactactgactctttacaaatgagacattgaaacgtcagccttcagtataatagatggaattttttgttgccttgccttttctttcctacttaaagcatctggaaataggaagacagagaaggtagagtaaaaatggatattttttatgtactttgtatattggtaataaaaagtaaaagccataggttgca

SEQ ID NO: 673228 - DNA, 102 bp, Homo sapiens
agagctcggcccttatatgggcacagaaatttgttctgtgacatttattgaactacaccctgcatccaaccaaaagtagggctgaatgactccttttatggt

SEQ ID NO: 673229 - DNA, 1242 bp, Homo sapiens
agcgggcttgcaagaggagtcagagggcaaagggtgagacccttccaccggtccagctgggctctagcctcagggacgtcctgctcctgggggcagtctcaggtaaaaccaaaggaagaggattggtcatggaagactgtgcaccgaaatgattgaaatgccaacatctaccttagaggaaatgccacaatcattttctgcaatcacattaagtaacacagagatgaataatattaagactaatgcacagagaaacaaacttccaatagaggaacttggtaaagtttctaaacataaaattgccactaaaagaacaccacataaagaagatgaggcaatgagctgttctgaaaattgttcgagtgcccagggcgactcacttcaggatgagtctcaagggtctcattctgagtccagctctaatccctccaatcctgaaactttgcatgcaaaggcaactgattcagttctacaaggttctgaaggaaacaaggtcaagaggacatcctgcatgtatggggcaaactgctataggaagaatcctgttcattttcaacattttagccatcctggtgatagtgattatggaggtgtacaaatcgtgggccaagatgagactgatgaccggcctgaatgtccctatggaccatcctgttataggaagaatccccagcacaagatagaatatagacataatacgcttccagtgagaaatgttttagatgaagataatgataatgttgggcaacccaatgagtatgacctgaacgacagctttctagatgatgaggaagaagactatgagccaacagatgaagattctgactggggaggaagaaggaggaggaagaagaaggtgatggtgaggaaagaggatggagatgaagatgaaggaaagctgaggtcagtacgggcaagcgggcagtgaagatgatgacgatgaccgatgtcgataccaagaagcagaagacgacgaggatgactagaacagcaaaaaaggagcagttaagtaaaacaaaaggccggggaaccaataccctcaaatccggttcagaatataaacgggccccttcagaagaaggccggccgccaacgggacaggccccggagatgaaggcgcaccaaaacaaccaaatgaaaatggcacagcggggaacagcagacaatacggccgagaccaagaaccaaaaagaaggggcaaagacaaatacagagacagaggaacagaagaacaccaagaat

SEQ ID NO: 673230 - DNA, 197 bp, Homo sapiens
cccgtactagcccgacagcatggggttggagccaccacaggaggtaccagagccacctgtggtggcacaggagttgccaggcctgcctttgtggacagcagcacgtagagttgccgagagcagacctgcgcgtatcatgtagcaagtggagttgacgcgaacaacctggtgacgacgacgagagttggagcagcctg

SEQ ID NO: 673231 - DNA, 928 bp, Homo sapiens
  misc_feature (737)..(737): n is a, c, g, or t
  misc_feature (752)..(752): n is a, c, g, or t
agcgggcttgcaagaggagtcagagggcaaagggtgagacccttccaccggtccagctgggctctagcctcagggacgtcctgctcctgggggcagtctcaggtaaaaccaaaggaagaggattggtcatggaagactgtgcaccgaaatgattgaaatgccaacatctaccttagaggaaatgccacaatcattttctgcaatcacattaagtaacacagagatgaataatattaagactaatgcacagagaaacaaacttccaatagaggaacttggtaaagtttctaaacataaaattgccactaaaagaacaccacataaagaagatgaggcaatgagctgttctgaaaattgttcgagtgcccagggcgactcacttcaggatgagtctcaagggtctcattctgagtccagctctaatccctccaatcctgaaactttgcatgcaaaggcaactgattcagttctacaaggttctgaaggaaacaaggtcaagaggacatcctgcatgtatggggcaaactgctataggaagaatcctgttcattttcaacattttagccatcctggtgatagtgattatggaggtgtacaaatcgtgggccaagatgagactgatgaccggcctgaatgtccctatggaccatcctgttataggttggaagttcagtgtccagttgaaaaacaccaactcagctagtttcttctggtctgcattacagtattttacctgnctttttatgaaaagngcacgttctaggaaaggatggaagattctcaaagaaacaactttccccttctaaggcagatgaaaacctgtacatgtacctaacattttttcccctttttaaaatataaaatttcacattacattttctgctcttcctttttggaataattaaatgtaacacttctttcataaaaa

SEQ ID NO: 673232 - DNA, 1292 bp, Homo sapiens
  misc_feature (18)..(18): n is a, c, g, or t
  misc_feature (22)..(22): n is a, c, g, or t
  misc_feature (37)..(38): n is a, c, g, or t
  misc_feature (40)..(40): n is a, c, g, or t
  misc_feature (44)..(44): n is a, c, g, or t
  misc_feature (48)..(49): n is a, c, g, or t
  misc_feature (68)..(68): n is a, c, g, or t
  misc_feature (1112)..(1112): n is a, c, g, or t
  misc_feature (1140)..(1140): n is a, c, g, or t
  misc_feature (1172)..(1172): n is a, c, g, or t
  misc_feature (1187)..(1187): n is a, c, g, or t
  misc_feature (1195)..(1195): n is a, c, g, or t
  misc_feature (1201)..(1201): n is a, c, g, or t
  misc_feature (1224)..(1224): n is a, c, g, or t
  misc_feature (1235)..(1235): n is a, c, g, or t
  misc_feature (1253)..(1253): n is a, c, g, or t
  misc_feature (1288)..(1288): n is a, c, g, or t
ggagagcacgccctgganaganggaatggtttttttnngncctntggnngaagaatccccagcacagnaaaggatataggactaatacgcttccgtgagaaatgttttagatgaagataatgataatgttgggcaacccaatgagtatgacctgaacgacagctttctagatgatgaggaagaagactatgagccaacagatgaagattctgactgggaaccaggaaaggaagatgaagagaaggaagatgtggaagagcttttgaaagaagcaaaaaggtttatgaaaagaaaatagtaactaacttctgtagtcatatctgccttacatttactttttctttgtgggaaaacatttatgaactaaggaggtacttaagtgacagttattttccttcttttgatagttaatgacttttactactgactctttacaaatgagacattgaaacgtcagccttcagtataatagatggaattttttgttgccttgccttttctttcctacttaaagcatctggaaataggaagacagagaaggtagagtaaaaatggatattttttatgtactttgtatattggtaataaaaagtaaaagccataggttgcataaaactttggtctttttaaatttttttccaaagattatggagtactctgcaagtataaccaggcaaagtacatgaaaacatgcctcttttcattgttactgaagtaattctgtaagcagaaccaggctttaaaaaatgcagccattacataatggcgttttttttctagtaccttagatgtgagctttgcaatttcacttactacttttatccttcaaaacttgggaagattggttccaaatgggtactgaaaatagattcaactaggctgtagaagagaaatgttcaccatgtagggaatgttattttgtgttccacatctgcaatttactgtatgtttgaatttaaaagtaaaaaaactcaaaaaacttgacctttttttcaaactaaagtcctagctgattattttaactctcagtgtgctgtctttatattaagaatagagaaacgaccataactttctcaaatggcattagttttgccttaagttttttttgaccntcagatggaaagtaagcaagttggttgncaagtttgaaagttccaagattcctgggcctncccatattccagganggaaaccnctttanttcctcccagtttttaccaaagnaatcctttccnggtaatttcccggttccnaaaaaactaacttttaaagccccctaataatggcncctt

SEQ ID NO: 673233 - DNA, 139 bp, Homo sapiens
acctcttaagcactgggacaataacttgaagtgccgctaattcttcctgctacaactggactgattcacctgcaatgactgtgtggcgtggagccggcagccgactggcaaaggtgtcgtggtggtcattaagctggag

SEQ ID NO: 673234 - DNA, 2017 bp, Homo sapiens
  misc_feature (753)..(753): n is a, c, g, or t
  misc_feature (772)..(772): n is a, c, g, or t
  misc_feature (1837)..(1837): n is a, c, g, or t
  misc_feature (1865)..(1865): n is a, c, g, or t
  misc_feature (1897)..(1897): n is a, c, g, or t
  misc_feature (1912)..(1912): n is a, c, g, or t
  misc_feature (1920)..(1920): n is a, c, g, or t
  misc_feature (1926)..(1926): n is a, c, g, or t
  misc_feature (1949)..(1949): n is a, c, g, or t
  misc_feature (1960)..(1960): n is a, c, g, or t
  misc_feature (1978)..(1978): n is a, c, g, or t
  misc_feature (2013)..(2013): n is a, c, g, or t
agcgggcttgcaagaggagtcagagggcaaagggtgagacccttccaccggtccagctgggctctagcctcagggacgtcctgctcctgggggcagtctcaggtaaaaccaaaggaagaggattggtcatggaagactgtgcaccgaaatgattgaaatgccaacatctaccttagaggaaatgccacaatcattttctgcaatcacattaagtaacacagagatgaataatattaagactaatgcacagagaaacaaacttccaatagaggaacttggtaaagtttctaaacataaaattgccactaaaagaacaccacataaagaagatgaggcaatgagctgttctgaaaattgttcgagtgcccagggcgactcacttcaggatgagtctcaagggtctcattctgagtccagctctaatccctccaatcctgaaactttgcatgcaaaggcaactgattcagttctacaaggttctgaaggaaacaaggtcaagaggacatcctgcatgtatggggcaaactgctataggaagaatcctgttcattttcaacattttagccatcctggtgatagtgattatggaggtgtacaaatcgtgggccaagatgagactgatgaccggcctgaatgtccctatggaccatcctgttataggaagaatccccagcacaagatagaatatagacataatacgcttccagaggctgattcagcgcataatatttctgctcacagaatgagaaaatnaaatgcatactatccaggntgcactcacttgcatttatatgtgcatacaaacagtgacttgtatcaatgagaaatgttttagatgaagataatgataatgttgggcaacccaatgagtatgacctgaacgacagctttctagatgatgaggaagaagactatgagccaacagatgaagattctgactgggaaccaggaaaggaagatgaagagaaggaagatgtggaagagcttttgaaagaagcaaaaaggtttatgaaaagaaaatagtaactaacttctgtagtcatatctgccttacatttactttttctttgtgggaaaacatttatgaactaaggaggtacttaagtgacagttattttccttcttttgatagttaatgacttttactactgactctttacaaatgagacattgaaacgtcagccttcagtataatagatggaattttttgttgccttgccttttctttcctacttaaagcatctggaaataggaagacagagaaggtagagtaaaaatggatattttttatgtactttgtatattggtaataaaaagtaaaagccataggttgcataaaactttggtctttttaaatttttttccaaagattatggagtactctgcaagtataaccaggcaaagtacatgaaaacatgcctcttttcattgttactgaagtaattctgtaagcagaaccaggctttaaaaaatgcagccattacataatggcgttttttttctagtaccttagatgtgagctttgcaatttcacttactacttttatccttcaaaacttgggaagattggttccaaatgggtactgaaaatagattcaactaggctgtagaagagaaatgttcaccatgtagggaatgttattttgtgttccacatctgcaatttactgtatgtttgaatttaaaagtaaaaaaactcaaaaaacttgacctttttttcaaactaaagtcctagctgattattttaactctcagtgtgctgtctttatattaagaatagagaaacgaccataactttctcaaatggcattagttttgccttaagttttttttgaccntcagatggaaagtaagcaagttggttgncaagtttgaaagttccaagattcctgggcctncccatattccagganggaaaccnctttanttcctcccagtttttaccaaagnaatcctttccnggtaatttcccggttccnaaaaaactaacttttaaagccccctaataatggcncctt

SEQ ID NO: 673235 - DNA, 859 bp, Homo sapiens
  misc_feature (214)..(214): n is a, c, g, or t
  misc_feature (230)..(230): n is a, c, g, or t
  misc_feature (243)..(243): n is a, c, g, or t
  misc_feature (276)..(276): n is a, c, g, or t
  misc_feature (303)..(303): n is a, c, g, or t
  misc_feature (332)..(332): n is a, c, g, or t
  misc_feature (345)..(345): n is a, c, g, or t
  misc_feature (352)..(352): n is a, c, g, or t
  misc_feature (361)..(361): n is a, c, g, or t
  misc_feature (367)..(367): n is a, c, g, or t
  misc_feature (410)..(410): n is a, c, g, or t
  misc_feature (416)..(416): n is a, c, g, or t
  misc_feature (433)..(433): n is a, c, g, or t
  misc_feature (436)..(436): n is a, c, g, or t
  misc_feature (443)..(443): n is a, c, g, or t
  misc_feature (446)..(446): n is a, c, g, or t
  misc_feature (463)..(463): n is a, c, g, or t
  misc_feature (471)..(471): n is a, c, g, or t
  misc_feature (481)..(481): n is a, c, g, or t
  misc_feature (488)..(489): n is a, c, g, or t
  misc_feature (508)..(508): n is a, c, g, or t
  misc_feature (518)..(518): n is a, c, g, or t
  misc_feature (534)..(534): n is a, c, g, or t
  misc_feature (622)..(622): n is a, c, g, or t
  misc_feature (633)..(633): n is a, c, g, or t
  misc_feature (635)..(635): n is a, c, g, or t
  misc_feature (637)..(638): n is a, c, g, or t
  misc_feature (644)..(645): n is a, c, g, or t
  misc_feature (652)..(654): n is a, c, g, or t
  misc_feature (664)..(664): n is a, c, g, or t
  misc_feature (682)..(682): n is a, c, g, or t
  misc_feature (695)..(695): n is a, c, g, or t
  misc_feature (701)..(701): n is a, c, g, or t
  misc_feature (705)..(706): n is a, c, g, or t
  misc_feature (709)..(709): n is a, c, g, or t
  misc_feature (711)..(711): n is a, c, g, or t
  misc_feature (714)..(714): n is a, c, g, or t
  misc_feature (717)..(717): n is a, c, g, or t
  misc_feature (734)..(734): n is a, c, g, or t
  misc_feature (737)..(737): n is a, c, g, or t
  misc_feature (739)..(739): n is a, c, g, or t
tagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttggcncttctgaggctaaatntgtctggctgaanattggatgtggtccctccttaactatgcgtccngtaataataggtacggtacggggctcngtgtaagtgtcgtgggggtaggacctatntttaaatactgtncctaacnttccatttnactagngagaaatcttggattccatttaatccttggtaattctagacantagatngtagtttagccataacngangtttttnaanaggggatatattttctngcacagtngttcaaaaangagacanntttcagtcctcaaggctgnccttggtttnacgggtcacaagtttnctagctcagacaacttttgaaaactctgtcagactattctcaggttttaactcgaagaccctctgggggtaggggctgttcctaagtnacgggcagatngngnnctgaanntggtccnnngtgccagacnggtactgagctgacagangggattttctgtnctaaantgtnnctngnttncanacgttaccgggcttagntcnancaattagcggtcgaattctcttaaaaaacaatatcacataaaacaccatttgttggggccgtggcccgaaaaaatttttaaacacatttgtgggggcggggccaaggtatattgaacttg

SEQ ID NO: 673236 - DNA, 226 bp, Homo sapiens
atcgtagcttagtggtaagtgctgaagatcaggaagcgtgatattacaggtttttcaaggtgattgggctgttgggtgttcctggcgtttccatatgaattggagggtggattttcctatttctgcaaaagacatcattggtattttgataggaattgcattggatctgtagatcactttcggtggtcttgacatcttaacaatattggtcttcctatccatacgt

SEQ ID NO: 673237 - DNA, 393 bp, Homo sapiens
  misc_feature (1)..(1): n is a, c, g, or t
  misc_feature (239)..(239): n is a, c, g, or t
nattcggcagagtcttgatctgtcacccaggctggagtgcagtggcgtgatcttggctcactgcaacctccgcctcccaggttcaagcgattctcctgcctcagcctcctgagtagctgggattacaggcacacgtcaccactcctggctaatttttgtattcttagtagagacagggtttcatcatgttggtcaggctagtctccaactcctgacctcgtgataccgcccgcctcagnctcctaaagtgctgagctgggattacaggcatgagccactgcgcccagcctgaaatcagcttttttagtgagtgatagctccttctggtttgctttgatttattaataatggagagagatgtgttggaaatctcctatccaaatgggtggggtt

SEQ ID NO: 673238 - DNA, 500 bp, Homo sapiens
cggggcgcttagaaataatagactttacctttcgacctttctcactgtggcgttgtgaaatcggcggcatttcgggggctgctgaagctcggaatgaacaagaggaacagggggggaacagtgagatcaagaggaggttaacccgaaaggtcattcaaaggcccacggtggaagaacttccggaaaaaaaaaatcctcatccgctttaagggactaactggagggggctgacgctcaggacttataacgcagggcaaataacccggggaccccgcttacccgtggaaaaaaaactggcatccggggacctaagtgaattcccccttggatggaagttcatgaattggagtggacacttaacaaggtttaaccgcccttccatccgatttccttttggagtgctatgcctggcttccccctcaccctttctcctccccccgcacccccgcctttatctctactcgctagtcctctcccggtcctcttggcccctcttctcg

SEQ ID NO: 673239 - DNA, 110 bp, Homo sapiens
cggccgaaacaatgtgaactgggcaggcggtgcctctaatactggtgatagctagaggtgatgtaaaaaggtagaacaggcggggtaagattagccgagttccttttact

SEQ ID NO: 673240 - DNA, 845 bp, Homo sapiens
cacatccatttcccccgcttcctcattaacttaccatcacagaattttcgttggatatgtaagagaccgcaagctgccaatctgcaagcagttattaatgaagtttgcaggcacagaccgctgaatttgggtccctttgtggtacgtgctttccttcgtagttcaacaagtgaaggtttattactgaagattgatccatccgtgcctaaagaagtaaaaaatgaagaaagcgaacaacaagatgcctacatgcggtgaattgtgaaactatcttcactggttttaagaaccaatggacataatgacgctacagtataatttttacatttgatgcctccggttctgatcatacttcaaagtagaactttaacatttaaaaattgtacattcctcttcatgaataattaaaatatatttttatactttgtctgcaactcccaaaaaacaaaaacaactgccctttattgaccccttcggtaatagccctccagacggtatcctttacggcaggatttttacatgatcctcagacactcatatttataaacagacgcctacgaataatcagatttgctattaccaactcttaaaagttttcccgcttgcggcagaaaacaactaaacgcaacctctccgacaaacaaattgcttatccccctgctcatttaatagataaaaaactcactataatgtcctatcaatttgtattaatataatggtaccacccgtacagatcaggaataactcaattcgctttcacgccgcatcacgaaagaatttattcatcacacactccacctacctaattcattactcctctatatagtacttcgcatcacctcacc

SEQ ID NO: 673241 - DNA, 479 bp, Homo sapiens
  misc_feature (19)..(19): n is a, c, g, or t
  misc_feature (68)..(68): n is a, c, g, or t
  misc_feature (234)..(234): n is a, c, g, or t
  misc_feature (245)..(245): n is a, c, g, or t
  misc_feature (297)..(297): n is a, c, g, or t
  misc_feature (450)..(450): n is a, c, g, or t
caaggtttttcttccaacnctacacccctccaaggtcttaacttacagacagaaaccaaagtagccantttaaagcgttagatatcggatacaagacatacactggggagaatgcttcaccatctgaagctcacaccacaatggcccagtggacagctgtgcactctgcttgtgcttaagtccctgggtgtggctgaggggaaggcgtgttttcagaacagaagaacagctgtntttcacaagtnctgaagcatttacgactcgcatcgcgcgcgcgcgcgtatatattttcatgtngaagcggaagaggggaaatcagcaaagtccctcccacagagcattacgcgctgccttgcagagagcacggcacgaaaagcgcgacttctccttgctcacgctcgcgtgaattctctgcacgaccttggcagcgtccttcagcacgggtgtccnctgaactggcgccatggttcaccggaaaa

SEQ ID NO: 673242 - DNA, 121 bp, Homo sapiens
gcgtcctcgtggaagtgcatcgttttaaaccctgcgtggcatcttgacgcacgcggtatcccagggaagacagcgcgccctggaggcccaccctactccctgaggatcacccacctatggg

SEQ ID NO: 673243 - DNA, 485 bp, Homo sapiens
  misc_feature (72)..(72): n is a, c, g, or t
  misc_feature (84)..(85): n is a, c, g, or t
  misc_feature (87)..(87): n is a, c, g, or t
  misc_feature (108)..(108): n is a, c, g, or t
  misc_feature (117)..(117): n is a, c, g, or t
  misc_feature (129)..(129): n is a, c, g, or t
gctttcttagctgttagctgagaggaagtctctgaacaggcggcagcggctcttatagtgcaaccatggcanactattcaacanngnctcccccctcttctggctcanctggtggcngtggtggcggcngtggtggtggaggagttaacaacgctttcaaagatacactacagagagcccaacaaattacagcaaaaattagagataataccaaaacatcactaaattcaaataactataattataaaaaacaaaaaagacctttagaacataaatatcaaccagatactaagaaacttactcctcaaaataactcttttaaaacacacttaccaccaatacatcatcatcaaagcatatctataataacaaaagaatacaaagtgccacataaaataattaaattcataattaacagagaaaataaacatatctcacgcatacaacagaaatctgaatacaaaatacatatatctcctcacagt

SEQ ID NO: 673244 - DNA, 364 bp, Homo sapiens
  misc_feature (361)..(361): n is a, c, g, or t
ggctccattcaggggggagcagctggggcaacatatcaagacccatgtctacaaaaaaaactatataaaaagacaggcatgggggtgtgcactggtggtttcagctactggggagatggaggggggaggatttacttcagccgggttaaggctatagtaagccataatggtgccactgcactccagctggggtgacagagtgagatccggtctgaataaaggtggtacattgcgagcatgtgaagtgtatccacacggtgaggcaaaatacctctaaaagttttacatctggtaaaactaaaactcagtacacattaagtaacacgggcccattttaccctctcttcagccccgtgagggnagc

SEQ ID NO: 673245 - DNA, 130 bp, Homo sapiens
aatggagctgccctgctgcgaagtagggtgggctctaaatccaaggactggtgtccattatagaacaacattgaagacatagatgagacatggacaaggaagatggtggtgtgaagagggagtgcagcag

SEQ ID NO: 673246 - DNA, 135 bp, Homo sapiens
tcagaccctttcagcttgtgttgatgaagctcatgcgactcgatgaaaagtttggggcactgacaagcggctcaaagcggagctgtgccccacctgctgcccctttctaccccagatccaccaccttgcagtccc

SEQ ID NO: 673247 - DNA, 121 bp, Homo sapiens
atggaagacaagaagctttacaatttggaatgcaattgatggacagaggcgagagagatacttttcatctttatggtcaaggtcactggctaggaacttgatttgctacagtgtacagggt

SEQ ID NO: 673248 - DNA, 942 bp, Homo sapiens
gcagcaaaacgcgtccataagttcgttgtgcttggattccgcgatcgtcaatgttaaagtggaaacttcttcaacgtgtccggagcctctatgtactgctacactgctagatagtgagaagagacgcggacggacttgtccgtctagagtctcctatggcgagcaggagggcctacgtgtagagtggacagccaactctttgtacctgtccacgcatgcggacacatgctacagtcgtcaatacatgagggaatagagctgactgcgaatcataatattcgatatgagtcatccaagagggcatctctcgggtaggaaagggcttctaggttgttccgggtgcgcggcacacttggttggctcaccttgataaagacgcttgttgtgactgttcagggtgttgagtactccgttccacgcgtatactacgctgggccgagagtggtctgcgtgccctgaactgtgtatgactgggtgccatcctggcgagaccaactgcgcaaattgacgtgggtcccggctttcgaaaatcgcatggcattgcctctcgagcttaaaaaccagcgatgcaggataggcaacgttaccaagggaacggcctaccgtgctttacctttggcttgggtttctgagcttggcatcgcgccccaaggtggcttggcaattcgatcgcgaaggcccccatccttcgcccttgggcaattgggccgagtcatatccagttgatgtggccaagcccttaagccttaccggcgagtctgggcggcctcgcgtcgttggaggcaaccaaggtaatttgcctgctcggtctttgggctgtcggtaatctgggtggggaaccatgttgtggcccagttcgcgctaggtggcccaacggagaagcgagagtcggacacgcttctaccggtccacggtggggggtccttggagttggtggggctg

SEQ ID NO: 673249 - DNA, 107 bp, Homo sapiens
ccaagcttatggctattgttgaaactgtcattgtcccgggaaaaaagagaactatgtttaacccggggagggaaaaaagagaaacttgtatgttttaaccgcgggca

SEQ ID NO: 673250 - DNA, 719 bp, Homo sapiens
ttcctcctctcctccatccaccccctctctcctctcgctcgccggtgttgtctcctctctctctttgtctcgccgcgcggtgtgtgccccctctctggggggactttctccgcgggtggagaggagaaatgttcttgcgcgccctctctcccctctcttgtgataaacacccctcgttggagggtctcccacggcgggagggtttcccacaaaagagagagaacataattttgtgagaatatatcccgcggagccctcagagaggggagatattttgttttgtgcgctctctctctgtggagacgagagagagaaactaataggcctctctctctgtgtgcggcacgagttgtttggcgcctcccctctctccccaaagaggccctttttccctcttaaataatccacactcttctcccccagaagaggagaacactctaaaggggtgtgttcacacacccagtggtccccagagagagtgggccgggtttcctcgatagatagacacttggggggacacaccccccaaacctcttccgcttttatcaagagagagagagattgggccacgcggagaacacctgcgggagagagaaggggaaaattttctcttttttgagaggggtaatgggaccccgcgcgggggtttaaatttttttttttttttttttaaatttgtgtgtgtttaaaaaacccccttctcttttttaaggggggca

SEQ ID NO: 673251 - DNA, 200 bp, Homo sapiens
gcagaaaatcacggtgggcacaaaattttggacacgatgttgggagcgtgagagctattgttcacgaatccagggccagaccgtggtgtctgtcttcctttaaagcacctgggatggtacataaaatgttccagaattgattttcttgaaactcaataaattcatcagaacaggcgttgctgtagacagtaatgataaga

SEQ ID NO: 673252 - DNA, 280 bp, Homo sapiens
ctaaatggctgttacctaaatggctgtacctaaatggcaactcgtgatcgccaaatccagcagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccattaggtaacagccatttagggtacagcctgtgag

SEQ ID NO: 673253 - DNA, 1217 bp, Homo sapiens
  misc_feature (565)..(565): n is a, c, g, or t
tcctcactaccgccagacaccccggtggaagcatttagaggggaccacggtgagggatcaagggcttctctgtccgcccgtgtcacaccttccaggccgtcacgttcacattaggcacatcacacaacacgactggtcacacagcaggtgatccatccatccgttcagttcatatcaagatatttatatgagcacgctacatatgtgcccgagcaccgtgattactaggcgactgggtcattacgcatagcagaacaaaatagacagaatacatctgccctcatgggaaggtgacgtacccaggagagggcacctacacagtcgcgcaaacacacactaattacactggcagggcactccgcgagcccactcctcctggctgagcagtactctgtggctgacaatgactgagcagagtaacacagagcccccttctgactccgcttcctcctggccagaccaggcaacaccactcaaccgtgctccatcacatcactctaggtctcggagaccatgggagggcatcagtagggggaggacacatcatacatgcatatgcctcagnatgtggccccgtaccgcagcaccctttccacttgcatcgtgggaacagccactccaattgtctgcccaaacacgcatcttactatcctttccttcctgtccttctattgctatccttccattccttcatggaaatgatctagcaccccagattctggccaatatcccagtttctttactataaccatgtccttccatgtctttgagggtagtgcccctcagttctgtccattaaccactttccttaccaggtccggacagattcttttactgacaatccgggaacgaaatctgggacaggataggcccaggctggaattgcacaggtgaaatcttcaactgaacttggcacctgcagcttcctgaggttgacgtgaatctcagggccacagacaccaggagtcactggcgcatgaagacacacgccaacaagccaagaaacaaggagccgactcagaccgggtcaccaagtatggcacggcgggctagaaacagcgaccgagaacaggagccccagcacccaagcgggaacaggagtcctcgccggcgcaccgcactaaaggcgatcacggcaacgcctcgcgaagccgcgcacaccccacagaggtcgcccccgccaagagggaaaattacaccgggcaggagcggccccc

SEQ ID NO: 673254 - DNA, 648 bp, Homo sapiens
tctgccgagagggcaggtcctgggggaagctccggactcctagagggtgctggccaggtgggggccctggtgaccatgtgacatgactgtgtgtgttttttaactgtaaaggagatccgcggtgtgatgtgtgaccccctgggtcctgcactgcctgcctggtggcatgtgcctgggccatggttggtgtgctcactgccccctgtgcatgtggcctgcctcagtgtgtgaggtggctctgagaacgactttttaaaactgcagatgaaaagctccatttcttcccgatggacctacatgatgcagcccttgtgcccatggaatggcatgtgagacagaagggccatgtgaatgggtccaggagggtgtcgaaaaattgttccttgggggaccccttggacgcccagcaggcacgagccatgtggacagcagcgccacgcgcgattgggcatgcctttggagtgtagccccacgtgggccttttgcgacgtaagcacgagacagcaaaacttccccccttggatgaccccccatagtaggactggaggtaaagaaattgtgccaggaggaaagacgcgtggtcacttggggactacgatgccttgtgtgcacacaattggcctatggtgcctttgacccatcgttcca

SEQ ID NO: 673255 - DNA, 319 bp, Homo sapiens
  misc_feature (57)..(58): n is a, c, g, or t
tctagaggatctccgtaaagaggtatctttactataaaagctatgtgtaagctagtnntacagccatttaggtaacagccattaggtacagccatttaggtaacagccatttaggtaacagccatttaggtaacagccatttaggtaacagccatttaggtaacagccatttaggtaacagccatttaggtaacagccatttaggtaacagccatttaggtaacatttaggtaacagccatttaggtaacagccatttaggtaacagccatttaggtaacagccattaggtaacagccatttagggtacagcctgtgag

SEQ ID NO: 673256 - DNA, 614 bp, Homo sapiens
tctaggagttcccaagctgtacgaggatattagaggctgggaagggtaagaaggaggaggcaatagggagagatttttaaaagtatacaaaattagagctagataggaggaataaattctagtgttctacagcaatgtaggataactacagttaacaataatatattacatagtttcaaatagtgagaaggaggatattgaatgttcacaatacaaagaaatgataaatgtttgagatgatggatatgctaattgctctgctctgatcaccatacattatatgtatcaaaacatcacgatgggcagggtgttgtggctcacgcccataatcccagcaatttgagaggccaaggtgagaggatcgtttaagctcaggagtttgagaccagcctgggcaacacagcgagacctcatctctaataaaaataaaaaaaattagccaggtgtggtggcatgtgcctgtagtcccagctactcaggaggccgagttgggaaaatctcttgagcctgcaagatacgggttgcagtgagctgtgatcacgccactgcactctggccttctggcctcggtgacagagcaagacctctcttctcgttagcttgggtacgagtcg

SEQ ID NO: 673257 - DNA, 594 bp, Homo sapiens
ggcggggcgcggtggctcacgcttgtaatcccagctctcagggaggctaagaggcgggaggatagctgtgagcccaggagttcgagacctgcctgggcaatatagcgagacccggtcttccagaaaagggaaaaacaaaaaacaaaaaacaaccaagaggcacaaaaaacaaaaaaaacacaaaaaaaaaaaaaacgtgtgggggggcacactgggccacaagaaaaaaacttaagaaacacaacgggggggagcgcgcgcgggaccaccaagaggggcagagacaagtgggccacaacgacgcgtggtcacccgagggagacactcctggggaacaacaaacaaggcggcaggggatcttcaccaacaaattaaaaagagggccgccggagggggacaacacacgaggagcgttcttttgagcagacaacaaactatccacacaagaagagagggagagatatcaagagaggcggcgcacaaacacaagggggaagacctaaatacaaccacagagaggacacaccacaagacggagccatcagaaattctacaaatattatccccccgagatgttgtggtgtggggatgggg

SEQ ID NO: 673258 - DNA, 232 bp, Homo sapiens
agatgcatacaccacatgaaacgtcctattatctgtaggctcattcatttctctaacagccatttaggtaacagccatttaggtaacagccatttaggtaacagccatttaggtaacagccatttaggtaacagccatttaggtaacagccatttaggtaacagccatttaggtaaccatttaggtaacagccatttaggtaacagctactagtgcagccattagtacagct

SEQ ID NO: 673259 - DNA, 899 bp, Homo sapiens
tacggcccccccttttgtaataacccttctctatttccagaaatctcctccggggctaaaaactcctgggttctataaaagaccccagaacagctgtccaaaatgggaccacacttttgggcacgtcgttgatactcccctttttcgcgccaaataattctcgtaattgtagaggaccctcctgttcacccccgtgtgaccggaatcttgcagtcacaacgtgtctctcgcccgtgcccgaagatccctctgtccccaatcattggtagttccaaacccctttttattgaaaccttaaaggagtttaataaactcccccccccctgtcaaagattcataaaaaggtccgggaccccattttccaccttatgaagttggtcccccactataccccaacagtttagcctgtggggacctccccggccccccccacaatagtagtagtttttattccaggaccccgctaggaagggacaatttttcaaaaaaaaaccatgtttctgtagtatgtaacaccccacacacacacacattggtcttttctcttcttcaccaagaatcaccccgctctcgttcctctgcaacccaacaaattggttccttttaaaagaatgtgcaagtaaacgccttccaattagcccatcagccctaaatacttttctccttcctggagtttaagagtattcttttggtcaccacaacaacacaactatgggcaactatgtttcttttctctcccctcataaatgctgtgtattccccccatatccctgcatccgttttaagaaagatccccctcgtccgccgtattacataacttattctcacccacatatatagtatgaacaaagaacactgggtttcaccccccaaaaaaagggctttttttcaaaataaca

SEQ ID NO: 673260 - DNA, 306 bp, Homo sapiens
  misc_feature (33)..(33): n is a, c, g, or t
  misc_feature (93)..(93): n is a, c, g, or t
tcaacccaaacacaggcaatgctcataaggcanaaaggttaaaaaaagtaaaaaaggaaatcaggcaaatcttatccccgcgctgtttaccanaaaacatcacactctagcatcaccagtatatagaggcaccgctctgccacagtgacacatattaggtaacagccatttaggtaacagccatttaggtaacagccatttaggtaacagcatttaggtaacagccatttaggtaacagccatttaggtaacagccatttaggtaacagccattaggtaacagccatttagggtacagcctgtgag

SEQ ID NO: 673261 - DNA, 326 bp, Homo sapiens
gcacggaccagaatagaaggtctaaatttaaactgtgactggaggcttcagggagccaggccggccagcaggctctccaggcgggtagctctgccccgcctgcagccacaccctcctgcgccctcccagagtggaaactgtttcatttctggctgctgagaactggtttcctcccaaggaaattatgtctcaccgcagttgtggcaggagctgccctctggaatttccctgcagcgatgaaacacctcctggatgagctgctgttagatgggacacgcccagagcctgctagtgcacaacccagagggagacacacccacacacag

SEQ ID NO: 673262 - DNA, 129 bp, Homo sapiens
ctaaatggctgttacctaaatggctgtacctaacatttaggtaacagccatttaggtaacagccatttaggtaacagccatttaggtaacagccattaggtaacagccatttagggtacagcctgtgag

SEQ ID NO: 673263 - DNA, 366 bp, Homo sapiens
tatctgaactttttctatacaaattaaatataatactaggagtcttcatgagaagccaatagctagacagactacattaattggtgtataggagcctccttatcgataaccaggtccaggttgtgtattgccctgaccaaagggaggacggttacgcgcataaggattaggcccacttggaggaggggtcatggtacttccaggaagtgaagtaaaacctggtcttggttgataggccccaggttggcttggagccattccaggttgagaggcaggagccacagtataattagtaggctgagaagtttgggcagtgtcagtttgtgcaggataattgctcgcctggtactgctgtggcggctgagc

SEQ ID NO: 673264 - DNA, 403 bp, Homo sapiens
tgatctagaggatccctactaaatggctgtatctaaatggctgctggatttggcgatcacgagttgccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccattaggtaacagccatttagggtacagcctgtgag

SEQ ID NO: 673265 - DNA, 429 bp, Homo sapiens
  misc_feature (216)..(216): n is a, c, g, or t
ttcagaggccccagtctgtagtcccggaagaatgaagatttaaatacgaggccatggctaaacatctgaagttcattgccaggacagtgatggttcaggaggggaacgtggaaggtgcctaccggaccctgaacagaatcctcaccacggatgggcttaccgaagtcataagtcgacgacgctactatgagaagccttgccgccgccgccagcggnagagctatgaaacatgccggagatctacaacatggaaatggctcgaaagattaacttcttgatgcgaaagaaccgtgcagacccgtggctgggctgctgaggcttggggctaggcacccacacacccatgtccaactcctttctttatccagccaagttctgttacttttctctataataaaaactccatcacaggtgaacaaaaaaaaaaaa

SEQ ID NO: 673266 - DNA, 396 bp, Homo sapiens
agatgcatacaccacatgaaacgtcctattatctgtaggctcattcatttctctaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccattaggtaacagccatttagggtacagcctgtgag

SEQ ID NO: 673267 - DNA, 107 bp, Homo sapiens
actctagaggatctctgcaagcgttatttccattgttcacacataaaggttcactgggaaacacactcaaccacagcaaggcaggcagcttaccaattcaaggaaag

SEQ ID NO: 673268 - DNA, 324 bp, Homo sapiens
tgatctagaggatccctactaaatggctgtatctaaatggctgctggatttggcgatcacgagttgccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagaatctaggtgacagccatttaggttcagccatttattacacattatac

SEQ ID NO: 673269 - DNA, 344 bp, Homo sapiens
  misc_feature (1)..(1): n is a, c, g, or t
ntcccaagagcacaagcaacagcgcaaaggagagaagccccggtctgcagtcatttaggtaacagccatgttaggtaacagccatttaggtgacagccatctaggtaacttccagtttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccattaggtaacagccatttagggtacagcctgtgag

SEQ ID NO: 673270 - DNA, 412 bp, Homo sapiens
agggcttgaatatggaactgcccgagcgagaaacttatagactacattgatcagacgaatatatgaactccaggagcacattgatgagtatattgctttgttgacttgatttgctgcaaaatcccaactcctcgcccagtaggctgcctctaagacattatgactctggtagaaggactttcaaatttagaaagatgatctctcaacataaacagttgtactgcagatctttgtttacatatttattacaaagcctaaacccaaaaatatttataaagaagcaaggatttaatgtccttttaaggatcatcatcttacttactgaagtgacctcagtgttcattattactacacttgtcctgtatactaatacttaacatgatacagtataatatttttgctattaatattt

SEQ ID NO: 673271 - DNA, 347 bp, Homo sapiens
gagagacctctagaggagcctgttctgtaatcgataaaccccgatcaacctcaccacctcttgcacagccatgttaggtaacagccatttaggtgacagccatctaggtaacttccagtttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccatttaggtaacagccattaggtaacagccatttagggtacagcctgtgag

SEQ ID NO: 673272 - DNA, 1341 bp, Homo sapiens
ccacgcgtacggacccacgcgtcgaccccgacatcattaccgggttttcctcttaaaaaaaaaaaaaaaaaaaaaaaaaaaaaaaaaaaaaaaaaaaaaaaaaaggggggacgaccacgaaaagattccccacagagggggccccacacagacacacacaccccaatattacagtacgaacaaaggggagaccacagaatgaggggacagttaataacacgcacaagaggcaggggacgccgcgtgtatcaaacaaggggcggagacaggggaagaaaccggccgacacaagagaggacacaattggagaaaaagaggaacaccataacaaggagagggagagaaacacccaaacgggagagacacaacacaccccaccacacgagacattataaaaacaactacactaaagaagaaaaatatataaacaattatcacaacaacagtacatatataacgtgcgtgtataacacaaaactacgcaaaactaatgtcacagcacaaaccaaaaaaaaacacatcaacaataacaccacacacacctatgatctaaatccaaacacaaaatatatattacacacacaagagagcaataaaaacgaaacaacacaaaaaacaaacaaataaaaataaaaaacaacaaacaaaaacaacaaaaacaaacacaaaaaaaaaataataataaacaacaaacaaacacaaaaacaaaaacaaaaaaacacaaacacaaaacaaaaagagaagaagaagcaaagaagagaaagagagaaagagaagagagagaagagagtagagaagaaaagacgaaagaggaagaagaagaaagagaaaaaagaagaacagaaaagagagaagaaaagagagaaaggaagaagaaggaaaggaaaaagaagaacagaaagagagagacaagagaaggagaaagaggagaggaagaacgagagggagagggaacagaagagtaagaagaaagaaagagagggggaagagagagagagcgagcagagaaagcaagagaagaaaaaaaaagaaaaaaaagagagagagaagacagacagagacaagaggaagagaggaagagaaagaaaggcataaaaaaacattcatacagaaacaatcaagcatacacacaaaacaccaaaaaacaaataaacaacaacaaaaaatcaaaagacaacataaacacactcaagaaacaacacaaagaaacaacaaacaaacaagcactaaaaacaataacaaaaaaaaataagaaaaaataataacaataacaaaaacatattagacaaacgaaaaagaaaaagaaacaatcaaataagataatacctagaataccaaatt

SEQ ID NO: 673273 - DNA, 997 bp, Homo sapiens
gcagcgtctgaggttgctggtgttgtgggcaatgtgcccccagtcctcgcggaaatctgctagtatatgtgcttccgacatcagacgacatgtctcccagatggtctacgcaccagaagactctgtcacagaagcagaatacgtcgcgtctgttgagggtaagtagccaaacgataaccaaggagaataacagaaatgtccatttggagcactcagagcgagagatcctggtgtcatcagcaggtgacaccgtcagcgagacgcgaccaggtggtgtgaggagaaaacttgatagcctcagcccttgtcttgctgcggagtgggtcgtcagtctgagttgagaggatgtggccagcgagccagctacggaggaggagggggacactagagccttgccgggagagcctccatccaggtcagctcggtctcttagacgggcagggtgccatatctaagcagcgtttgcctccaggaattgctcctgatagagaaatccccacgaaagtctccatcctaaaggaaggtaactagggcacacaagcttgcatgtccgacctggtagtgtctccagccaatagtggggttgaaggagtccgagtgggatcaggatgatgatcaagataactcttccctgacagctttctcagaacattgtgtcaggacgtgcctttcgtacagctgagttcagccagagtaagcgcggattcacgcatatcgtaaacgcaggttggcttcactgatgacagtcagcactggtggtgccgggcgtgcctcggaggtctggccgagcagaggccggtggtggatagcccgtgggataaggcccttgcagtgaggggggcggaggccctcccgggtttggggtccgcgtgccctggggagacacgcctgtggacctcgcgggtcggagccgggttcagccatgaccttgtggggcccgcggtacaccttttaaaactcgttctgcgcaaggttccctccagcctctggtggacgc

SEQ ID NO: 673274 - DNA, 227 bp, Homo sapiens
cccttaattttcaaaagggaaactttggtttaggggggcaaaaaagccctgggctaaaagtttagggccccccggtgaaaagcaactaaaaaatcaaacccgggaaaacggggggggattggaccacccttccccccccatcatggttttcacccggccttttccagggtttttttcctgggggcagggggttccccattaaaaaaaaaaaaaaattttccctttta

SEQ ID NO: 673275 - DNA, 436 bp, Homo sapiens
tgagaagaaaaggctcaccgcaacctccacctcctgggttcaagagattctcctgcctcagcctcccaagcagctgggaccacaggtgcacggccactgcccggccaaacctctttgtatttttagtagagacggggtttcaccatgtcggccaggctgatttcgaactcctgacctcaagtgatctgcacgcctcagcctctgaaagtgctaggattacaggcatgagcaccatgcccagccctctgttcccattctaatagatgttctactatggattctacattatggcctatagagttagccttcgactgacgtaaaactcagggaataccttgaggaaatctaagtgagcagaacaagggccaaagcgagctgggaagtgcagaacatacgttcctggtccaaattatagggacaaaagagaaaaacagtg

SEQ ID NO: 673276 - DNA, 166 bp, Homo sapiens
tctagctcgcacaccactagcccgatggagacagctgagcctaatgctggcaataacgtccagcgctaagtacacatagtagatttgtgcactctcatctatcccccgctccgagataaggtaaccgctcccctgaatatgacctccaggagacagacatgagctt

SEQ ID NO: 673277 - DNA, 898 bp, Homo sapiens
  misc_feature (290)..(290): n is a, c, g, or t
  misc_feature (346)..(346): n is a, c, g, or t
  misc_feature (369)..(369): n is a, c, g, or t
  misc_feature (384)..(384): n is a, c, g, or t
ctggctcctatggaagctgctaaggttcgaattcaaccagcagtatgcacacttgagggatcagtccaaatgtataaggaaaggctaaagctctacaggggtgctctctctggtgagacgatacataaccagatgaattgcctgcttgaacgtctgtgaagcatgtacaagttgtgggcctaagcccgcaggaatgtcaaagccagagcagctggttgtaacatgtgtagcaggttacatagctggagtctttgtgcaatgtttctcaccctgctgattctgtggtatcngtgttgaataaagaaaaaggtagcagtgcttctctggtcctcaagagacttggatnaaggtgtatggaagggatgttgnccgttcatcatgatngtaccctgactgcactacagtggttaatcgtatgacctccgtgaaggtctacttcagacttcctcgccctcctccacccgagatgccagagtctctgaagaagaagctgggttaactcagtagtatagatcaaagcaaatgtggactgaatctgctagttgatcagggttgaagaaagtgcacaaggaacttctatatagtcggacaggtaaggaaattgtactattacctgatagtactcaactgtagtacctctggcttaaggcacagagctctcaccattaccgttgaaatcaacccaatcttcctgacaacaaagacaaacaacagctcaagtcatgttacttacggtggaatggtgttaactttcgagcaccaaaccgagtgctcatcatcctctctccaagaggacgcatcatagatttcttcgtcgcattgtgcccctcccgcctttaagaatacacgagacatccctcactagttgtgcaccggcgcgtatctcgcggctaacttc

SEQ ID NO: 673278 - DNA, 281 bp, Homo sapiens
gcgagccaggacatcgaggctgcagtgagccgtgatagcctcagtgcactccagcccgggcacagaacaagacgtcggctcctgaaaaaaaaaaagaaagaaaaacttaaaggcacattttggttattttagtccctaatagaatgagtttccccattatagactatagtgatttactaatcattttagtatcacttatcatatccatattttagattactccattgactggcatcaataatttgcagctggtatattacgtttatcctcaggactccgat

SEQ ID NO: 673279 - DNA, 94 bp, Homo sapiens
gctgccccctccccgccccctgtttggggcagggggggaaggttttttcgagataaagccccggccccccaaattaaagttgtgaggttgccca

SEQ ID NO: 673280 - DNA, 342 bp, Homo sapiens
catgacagtatgccaggcttagagcacatctggcctgggtttctgacccattgagactgccgtgccacaatgctcggtcacctcctttatagaagcaaccctagcgatttgaccaatgaagtctggcacaggctcagcagtgtgaaggaagagtaagctttcaggaaaccacgcagggaagagtagtagggtcctgacttgtctcagggtctttgaaaagttgggtgtggcctccaaggtgagaagatagtgtgtgggccaccccgaggccatgacaggcgggcagtattgcacaggcttctctctacagtctgtcgtgcgtggcatctcctttgagggtca

SEQ ID NO: 673281 - DNA, 687 bp, Homo sapiens
gcccactgtctctctctcttcggccctctatagctgtccgcggtctgatagaacggaacgggggtttttgcgtctttcacgtggacattaatctgggggcacctgaggacgacctctgaggtggacctggacaagccgttctggcagattatccatccgacttacccaagcggcgctgctgagcccgcccagtgctgccgcggcgtacgatgagcttaaaagttgctccgcgctccaatacgcacacgttgtgcaagaacgaaggcgcgcttgagacacttctgagatatcatgaagcgatctgcctaatgtaccacaattgtcattttatggacatcagatctgcttgagagataactggaaggatgcttgcgattaaggacactgttttgaggcgttaggaaactggatcttgaagctttagaatgaaaagagctgtgtgtagttcaaatgtgcaagcttttggaggctgattgccatgtaacactatctggtaattgacgagggatgatacttgtaagactaaccggtttctagggggggcttgtacagaattgcacgattatttggcttaagttgagagctgaccaggacactttttctggaccggccggcacataatataatttgccggaccgaattaagggcaattttttgtcacgcgcctgggataacatgggttgctgg

SEQ ID NO: 673282 - DNA, 238 bp, Homo sapiens
gaaaaaaaaaagctttgttttttttttccccatatgggggggggggtttaccccccctgccaatgccttagccctggggggcttttttcaatttggtggggaaaggggggggggggaatgaaagggccaaaaaaaacatgtttttaagaactggggttttttacaatagaatgttttttagcagaggcctcttgtttttatattttaaaattttgcaaagccctttggggttctgcca

SEQ ID NO: 673283 - DNA, 882 bp, Homo sapiens
ttcagttgtatgaagtacatttatatgttatgcgaccatcatcaccatccatctctagaacttttttcgtcttgcaaaactgaaactctatatccactaaacaatcaatccccattcccctagcccctgagaaaaccaacattctaccctgtctgtgattttaacatacctcaatcatgcagcatatgccttttgtgactggcttatgcacttagcataatgtcgtcaaggttcatctatgtagtagcaggatttcattgttaaggcttgataatattccactgtgtgtatacaccacatttgcttatccattcgtcaatggacaggttgcttccatgttgagctactgggaataattctgctatgaacatcggatgtactaacactatgttaagagacactggattggcactaattcatcggatatgacactaacggcaaggcaccctcaacgaaaccgacaaaccgactttataaccactcctcaaccccatgctgcatctaacagacattatcctatgatcactaccattatcctatgatcaattaaccaggcaaccagcagactcaggagaacactcttcgccactgtctatctgacgcaggatgatcatcctgatacagagagaatctaaaaaccaacaaggagaaccgatcaacaaaggcacggctgatagactcccaagagacaccaggaatgaagagccgcctatcatgcgaaggttcaaacgaatcactaaccagacgaggtcacaccacacagggcgctgcgcaggactccagggggagcagacccggaacatgacacaaacagaaggcactggacaagaaacaacagaacacgggaagacaacgaacaacgacgccccgcccgcgccccga

SEQ ID NO: 673284 - DNA, 4440 bp, Homo sapiens
ggtgcctgaggttgcagccgagagtgtgcgccagcccgcggcccagccgaagctctttcccgccgcctctccgcgcctcgcccaggttcagccccgcctgaccctccgcttggcacggtcccctgaccctcagtccggcccggtccggcctcccagccgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgcagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcctacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagtggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaagagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataataaacttgtggtttcgcgga

SEQ ID NO: 673285 - DNA, 418 bp, Homo sapiens
cccgccgtacaagtgcggcaatcgggggcttaccctatagtctaccacggaatcagtggactccctcactagtatcagtgcggggaaggcttagttgaagtctgtcactacctgggtgaagtcttccactcccttgttggagtcttagttgataggggtagtgttccatcctaagtctacccggtcgaagtctggttgttacttgttgggttcaccaagcaactgctaacgagactgatcctaagcatagtaagacttaaatccgtgctgctgctactgatgctaggtattactagtatggtgattcggggaaggtattatcagcactttaaaccaaggtaaaatcctttaactcgctaccgctattagctcactgacgcgacacattagtagcgcaactggtacggcggggtaccga

SEQ ID NO: 673286 - DNA, 760 bp, Homo sapiens
gcgcaagcgtgcggagattggaggcccgcggtccctggtctgggcatgcttggctgtgatgctcggtgagggagactgttgttcccggagatgcggcgcgcaggatgaaatctacattgctccttcaggagttgcaaaaggaacgaatcagcctgaagacatgtagtggggtgatatcattgaaaaggacatcagtggaccttcgtcatcgaatgaagctaaaaaaaaggccagtgtactcctctttacatgaatgcttacacaatgagaggagcaggtgcagtgattcatacccactctaaagctggctgtgatggccacccttctctttccaggacgggagttaaaattacccatcacagagctgataaccggacatacaagacacatgtacttccggaagcgtataatagataatgatggatatgtaagcggtaccccattattgagaaatacacctgaggagaaagaccttcaaagatagaatggtcagtgcactgaatgaataccccagattcctgtgcagtacctggtcagacgtcatggagtaatatgtgtgggggggaacacatgggagaagggcaaaaccatgtgtgagtgtaatgactatgaatgtgatatcgcgtatcattgaagcaacgtaggattgatccttccaaaggtcccagtgggagaacactggaattgtactaaggcaaagaacggtttaattatatacagagataaagtaaacggaaattactattttaatggaacgctt

SEQ ID NO: 673287 - DNA, 211 bp, Homo sapiens
acgctctctctgatggggcaggcgggagtgcagtggcccatcacagctcagtgcacgtcgggaaatcctaggctctagtgtgatcctcccacctcagactcccccgcatagctgggactacaaggtgagcaccaccacacccagctcatttttcaatttttagtagagccagggtctcactatgttgcccaggctggtctcaaactcctga

SEQ ID NO: 673288 - DNA, 405 bp, Homo sapiens
agtatttctcgcgaagaccccccctccccattgacccctccatgtttcccacgtgggccgccaaaaacgaacaacagggtgttaaacggggccccagcccgaggcccccttaaggaggcctgggctacaaccaactgggtgacgacgaccttaaggaaacgggcttccccctttcccccccgaaccaaggggccttttccgcgggccccgggttcaacctcaagtttttaaggtcaaagtggaccccgtcatggggaaaaatcaaccggggccccaggggtgggtacttcggctggaacttcgattaaactcggaactccttgttttactttgtgctccatgttttgtttttgtattttggtttgtaaatttgtaaaattaaatcattttccttgttgtggagga

SEQ ID NO: 673289 - DNA, 812 bp, Homo sapiens
  misc_feature (43)..(43): n is a, c, g, or t
  misc_feature (73)..(73): n is a, c, g, or t
  misc_feature (81)..(81): n is a, c, g, or t
  misc_feature (117)..(117): n is a, c, g, or t
ggtcgcgcaattggggcccgtggtgatccggtggacaggaagngaaaaagggtgtccgaccagtgggatttcnttttgggntaggttatccccagggccggcccgcggccaaacggnttagaaaaaagcgcaaccgcggcttaaccaccaaagggggggcgaggcggtggcgcgcccaggcccccacattagggaacaagggcctggcgcacagagagaggcgagcaacattattcttcgagggccccgtaggaagacgggcccggggaggggcaaaaacacccgggggaggacaataaacccgattttttctcaaaagggaggggcagcccaaagttttacagaggcctcaccacacaatgagtgtgcgagcactacgatttccaaatatttcctccaaaaaacggggagaactcgccgcccgtggggtggcgcgccccctgggggtataggacgagctcgagagcttcttgtggacccacagccgcatgattccggggctatcgaagaaaagaggcggcgcatggagcggacttacccattgccaccccggggcgggcgggcaacaatgtcccgccggtgtatgaaaaatttttccccgggagagagacatttctatagataagcacatggctaaattaactcgggtcgccgtgaggtcgataaacacgagtggtagacaagtggcccatattggggattttgtacccccaagatttatagggagccccccggagttctcgcacgtaaacagggagtcggagacccccaaatgtttcatccgccaaaacctagtagacaccgcatgggtg

SEQ ID NO: 673290 - DNA, 1000 bp, Homo sapiens
  misc_feature (261)..(261): n is a, c, g, or t
  misc_feature (648)..(648): n is a, c, g, or t
  misc_feature (669)..(669): n is a, c, g, or t
taaattaacttgaaaggacaattttttttttaaacagagctcaagggggtaaccagggttatcatcagaagtgcttccaaaggaaaaaagggaggaggagccgaaggagaacacaatcaagcggcactctcccacacttttaaacggggttgtgactctacgcgtgccagtgtaacaacattaggggtgccgtctggtgtggaaaactccagagggaggttaacacaaggtgtctcagtgccgcatgtgagggctctctcnagtgcatctcggcttggtgtctcgtgtgtgtaatctcccatatacgccgtatagaggctctgtggtcactcgagcacaaactctccaaaattaaacttctccccccagaaatgtggaacagaaactctccagcgttacccagttatactcatgtagacccagcagagggctcatataaggcaccatgtgcccagtatacgtgaacatctcccaacatgtcttataatatagtctcgtgtgatctctcgtgggatctccaaaaacaggcaagaaatgtgcggccacgggtttctacccacctttttatttatataagtctctctcgagaaactcgcgtgtgtgtggcttctcgagagagaaagtgggagaggagaattatgtgaaggnccttatctcggtggagagccncccgagggaaaaaagtggccattctctatacgccaaagatgtggcctacagtgtgctctctatcggaagagactctctacaggcgccgtggtggacaattttcccccatgtgtggtgttgtggggtcttacgcgaaaaagccccacaatattaaacaacgcgcccaccaccaggttgtggcggcggggagctaccatttggggaggaaaacacacgtcgtcgtgggggtcataatacttccaagaagaaggttgtggcgcccatacttctgggaaaactgttgtggggcgcgccggtattaccacccatatataaggcggtattatccccc

SEQ ID NO: 673291 - DNA, 411 bp, Homo sapiens
  misc_feature (402)..(402): n is a, c, g, or t
ggccacacaagttttaaaggaatattaaaacagccagccccccagagtgatccctattctaggctagcccttggcaacggggggctacaaactttacatcaggccacccaagatcaaggaaaggaagagcgtcatcaagatcgtgctctgcccatcaacaaacaagtactcagaaacttcctaaaggacagcaagaggaacgtctcagagaaaaggcagagcaaaagaaacttttggaccagcgggcccagaatgtgggcaagcccaaaaatattcgtatgttaactggcgagactgaagcaacaaaagagaagaaaagaggtggtggtggtggccggcgttctaagaaggcaggagagtttcatgaatttgacaatgagcctctgatgatgacctgcctanacccccccc

SEQ ID NO: 673292 - DNA, 274 bp, Homo sapiens
tctcccagcacaccacgatgcccttgtcgggttgaggacaggcgttcgcgatcagcctagcccaccgataggtgaacccccatctctacctaaaaaactacaaaggttagccgagtgtaggtagcacacacctgtactcccagctacctaagagtctagagtgcacaagaatagcttgcaccgggaggcggccgtcgcagtgagccgagatcattccactgcactccagcctgggtgacagagtaagactattttcacaaagaggcctggcaca

SEQ ID NO: 673293 - DNA, 307 bp, Homo sapiens
  misc_feature (125)..(125): n is a, c, g, or t
atcgaccaagagattgcacaaataatgaacagcttagacgaagcagctattgtcacttccattactggtatttctaatcgtttgggtagcgttattctagccgaaatcaatcacattaataattntcagtcacctgatcagctattagcttttgccggcttagaaccttctgtttatcaatctggccagatgaatgccacgggtaaaatagttaaacgtggttcgacatcattgcgttgggcgttgtgccaagcagctgaatatgcttctcattggtcgccgactttacgtcaataccgtcaaaaga

SEQ ID NO: 673294 - DNA, 416 bp, Homo sapiens
cccggggggggggccgttttaaaaaaaagggttcccccgggcccaagaattttggcccaagggaagtttttttccattaaaggggtgggggtttttcagcaattttttgggggcccccaaaaaaatgggaatgttttttttttcaaggggtaaaaggtttttggggggggggttttttaaagtattttttgcccttaaaaccccgggtttttttaaaaggggtgtttaagaaaaagtttaaaaaatagggggggtttaagtcttttgaaaaaaaaaatttttatcccccccccccaaaacaaggggcagttttttcccttttttatcccacctctttggggggccaaaaggggggggtccttttggcccagaaattggccccccccccgggtaaaaaaaaaaccccttttttttta

SEQ ID NO: 673295 - DNA, 116 bp, Homo sapiens
gatccatgtctatgaggcagttacaattttctccctgaggagataagcctactatcataatatactcataatgtctaatctcccattgtagacatagtaactctactcatctgaca

SEQ ID NO: 673296 - DNA, 957 bp, Homo sapiens
  misc_feature (550)..(550): n is a, c, g, or t
cgcggaggccgcacggtgcctggagttactgtaaaagacgtgaaccagcaggagttcgttcagagctcttggcaagccttcctcaaaaatgtccggggaagcttgaaagggtccccgaagtgggtgggataccctgtcaaagcttggccaatgcacaaaaggatgctttgctcacctacgattgaggaactgtttctacacgcgaggcttgtttccacaggcgcgggaacccttgtaccctccgggggttggccgctgggggggttggctcccatgaccccaagatctatgggggcgacgtcagagagaaaacggtgcgtcattgcccacaggccacttttcaggccagaaggctcccaagatgtgtggcccctgccggggttccatccaaagcccttggagggggccttgaaaaattgtgtggaaaaacgggccccaacaggattgtgcggtgctgaaaaacttgaacacccttcaggtgacacaaacggagatcttggccagaattcgccggaccaggttgggctgttgcccaaacaaagtaaggcantttaggaaacaaaaaccccattggctggggttaattaagaattggccttccatttccggtagtcacgacagcatcatccatactgtactatcaacaacacacaccagtgtgggctggccacgcactcaggccccgctcagaaagaaacgtttctaacgaaccaagttagttagtgagagcagcgagccacgcgagtagtagtcactggacaacgggtcacagcacgtgcgccacaagaacacccgctgtcaacacaacgcggtgggtgtcccccccaaaaaaaaaacgccgggggcagcaagcagcgggtctaaccaacccacaggagagctcggaggccaacggggtcataacaggggagccacgaggccattaatgccgccgcgccacactagagagacacgacg

SEQ ID NO: 673297 - DNA, 431 bp, Homo sapiens
ctgactctagagtgatccccttcattacggcaatatacagcgatactcaaggtaggtcaatgaacgaacattcgtggatagcaacgcccactgcacaaccagaagatgcgacctgatcagcatcccccagacaaaccacagacacggccagtgtgcaaaatgaagcctagttggatgagattttaaaagagatcaaatctattaaagacacaatctgcaatctagatcagcgtatatccaagttagaacagcagatagcatagatcgcagtcctgaaggtccctacccccatccctacagaataaatgggagccagaacttgtgcttgggagctggttattggtgtggtcctagggagggcggacagggaggctctgccctcctggagactcttccatttccgatttgcctttccttaagggttccgagct

SEQ ID NO: 673298 - DNA, 345 bp, Homo sapiens
  misc_feature (67)..(67): n is a, c, g, or t
  misc_feature (74)..(74): n is a, c, g, or t
  misc_feature (109)..(109): n is a, c, g, or t
  misc_feature (139)..(139): n is a, c, g, or t
  misc_feature (178)..(178): n is a, c, g, or t
  misc_feature (184)..(184): n is a, c, g, or t
  misc_feature (206)..(206): n is a, c, g, or t
  misc_feature (238)..(238): n is a, c, g, or t
gaagtatcatgtcatggcaaatcataatagtttgcccattttgaaagccggagatgaaatagatganccaagtnagagggaaaggctccgaacagtctctttagaactnttcggagcctttccctctcacttgctccgnaacagttctaaagagactgggaaagctcaggtgcatgcntgaganttgctccagtagcttcaccagnctcatgggatatctctaccatgtcagaaaatntggcaaaggggctgcagagctggaaaagatgaccctgaaatgtcaccactgtggaaaaccatataggtcgaaggcttggacttgcatatcacctgaggtcagagcat

SEQ ID NO: 673299 - DNA, 514 bp, Homo sapiens
  misc_feature (315)..(315): n is a, c, g, or t
tcttagaggatccccagcgcacgtagctatctctaaaataggataataccaccacagatggagttgcgtgaaaagatcaaacatgatcaagttggtaaagtacatggtatttcccaaagatgggggaaatgttttcatttccgggggatactttttttggaaaaaaaaaaaatttttctttgaaatacaaggtttttaagcatgatgaaaattacttaacggggccgggcgcaggggctcatgccggtaatcccaacacttggagaggctaaagtggggggatcacctggggccaggagttcaagaccagccggnccaacaagttgaaaccccatctctactaaaaatacaaaaattagcggggggggggggtgtgcaccggtaatcccagttacttgggaggctgagacatgagaatcatttgaaccggggaggtggaggatgcagtgagctgagatggagccatggcactccagccggggcaacagagcgagactcttgtctcaagaagaag

SEQ ID NO: 673300 - DNA, 322 bp, Homo sapiens
  misc_feature (322)..(322): n is a, c, g, or t
aggaattccttcctgtcatattttagccattattactggttatatgcctcccttgcagcaagcactactatgtagtgtgatcttcatattgtgaatagcttagaatactgcaaaggataagctaattgaatgcctattaaattattatccactgttcagatagttcaatctttttttcagtttttatttattgttggcacttgattgcagttctgtgatggcttgagcttttcatacacctcacctgctttggcaagcctattttagtagatatggcagcacggatattacactatgcattaaaagcactttttgtaatacn

SEQ ID NO: 673301 - DNA, 323 bp, Homo sapiens
cacaacggtacccaccgagtacatcccatactgccttcgacaacttctccggatgaatttgacaagctgaggactctctgactacaccaacacagacatcttcctgctctgcttcagatgtcgtgagccccatcatccttccagaacgtcagtgcagaaatgggtgccggcagcttcgatgccactgtcccagagcccccatcatcctagttggaacgcagtcagatctcagagaagatgtcaaagtcctcattgagtaggacaaatgcgaagaaaagccagtgcctgaagaggcggctcagctgtgcgccgacgcctacgca

SEQ ID NO: 673302 - DNA, 206 bp, Homo sapiens
gagtgactttattgatttgagcagcatatgctgtgattggctgccctgcaaatttgtttcccttaagggaccctcaccaacctatctctgctggatttggggaggttccgcatctttttgtggggagggcaaggagtattggcaatctacaacccggtggtcaggtttttgattaactctgaagccatcgcgatatggagagaaaa

SEQ ID NO: 673303 - DNA, 397 bp, Homo sapiens
  misc_feature (345)..(345): n is a, c, g, or t
ctagaggatccacctgggatcacaggcatagcactgtgctcagcctggctgtaccctattgatcttatctctaatttctcagttacaagaaatgacatctcccgtaacttctatctcggggaggtgacgtaagagcctaatatttgagaccaagctctgtttgctgtgtctttaaaaaccatttcctgtagggtctgccgtgaacgagctttcaaccggttcatgtcccctaccccatgcatttttgagacccagtgttttggctcacacctggtgtcccagcacttttggggaggctggaggtccggcaaatcccgacctccaggagatcgagaccatcctgtncccacagttgtgggagcccctctcttctacccctacgcgggggtcccccttt

SEQ ID NO: 673304 - DNA, 861 bp, Homo sapiens
cgtggtggcgcgtgcctgtaatcccagctactcaggaggctaaggcaggagaatcacctgaacacttgaacctgggaggcaggggttgcagtgagctaagatcgtaccactgcactgggtgacagagcaagactccatttcaaaaaaaaaaaaaaatttaaagataaagaaattctgaaacaaattttttaatttatgtgaattaagggtaactctccagggtggcagaagataaaaaagaattataaagctaaataaggccggaagccatagctcacgtgtgtaatcccagcacttgggataggcatgagatcaggcaaattcacttgaagtcagaagtttgagaccagactggggcaagattgtgaaaccccggtctttactaaaattacaaaaattagccggggaatcgggtgggaacccataccgaagtcccagactactacataagggtacggaaggtgaatggttcaaacacaaggaggcggaggtagaaagtagaagcgttgaaattgcatacgtgactctagccgggggtacaaggaagaccctgttcaagaaaaccaagaagctacaggatcagttttaacattgcagctggcggggaggataaagaaagttagtagaacaaataccttaagagggggggaactgaactatgaaggcgctaggaataacgatgtgggaaaaagtcatagtgctccctttttgggacaaagtgatgggatcaatgtaaacaggagagctctaaaaaatgtgggactatagatcggagtgtccggattatgcgggagcatgggtagtgacgagaaaacagggaataggagttgaccagtgatcagggtgatagagaagtgaggg

SEQ ID NO: 673305 - DNA, 142 bp, Homo sapiens
  misc_feature (57)..(57): n is a, c, g, or t
  misc_feature (128)..(128): n is a, c, g, or t
ggacgacgaggagatggatccgcagacgatcgacagcctcattgagctgtccgccanactccacctgccagcggacgacgtggtcagcatcatcgaggaggtggaggagaagcggaagtagagaagantttcctcccgagcc

SEQ ID NO: 673306 - DNA, 1088 bp, Homo sapiens
  misc_feature (1080)..(1080): n is a, c, g, or t
cgtgcaatttccccgttttccctctcccttggctatgtgagttccctctgggtgataatggcttcaggcaaaacatgaggggttctttttctttggggccctgttcagaaggctgttgacgggtgtctctgtgaacattgttaggcctggttgtgctcacagtcctcaaattcgggagctattcaggctgccatcagggcaatcttgcaggatagggtcatcctcaagaaatgttgaaagcttgttttcgagaattatatttggtgtcaaatgtttggggacccatcttaggtattccctgctcccctgaagaatgattacacgtgttaacagaagactgacaaagactctttttatttgggagccagaggacgggaacgtgttacttgtgctataactgcttttgtgctaaaatactgaattgtctcaaaattagctgtgtaaaactacgcccgggttccctggctcctgctgaggtcccctttccttctgggctgtgaattccttgtacatactttctctactttttgtatcaggcttcaattccagttactgttttaatgttgtctctgaagatgactttgttgtatttttttttgcttttttctaaaccatgaagaacgtcctgtttagacagagcatgctctgcattgttggtttcaccagcgttctgccctcacatgcacagggatttaacaaccacacaatataactaccacttcccttgtgagtctcctaatatataaagtagagtacccttaggtactctgccctcctgtcagtagtggcaggatctattggcatatctcgggagcttcttaagaggcgatgaggttcatttgaacacagtgacaacttgtagaatcttagtgaacctttctatcgcatagcagtttattgactgttattgctaagaagaagtaagaaagaaaaagcctgttcggcaatcttggttatttccatctaagatttctggcagtgtgggatggatgaatgatagtggaatgtgaactatcggcaagctataaatggacagccgtcccatgttcttaccttccctgttcactatcacgcactccnttctcgct

SEQ ID NO: 673307 - DNA, 325 bp, Homo sapiens
caagcagacagcctggtgccacaccctgggcctggtagttaaagactgacccctgacctaatcggttatgttatctatagattacagacactgtatagaaaagcactgtgaaaatccctgtcctgttctgttccaacctgattaccagtgcatgcagcccccagtcgtgtaccccacttgctcaatcgatcacaaccctctcacgtggacccccttagagttgtgagcccttaaaagggacaggaattgctcatttggggagcttggttgttggagatgtgagtcttgctgaagctcccagccgaataaagccattccttcttta

SEQ ID NO: 673308 - DNA, 514 bp, Homo sapiens
ggtctcaatgactagagcagaatactgacagcatgcattactgagtatatatccaaaagaatagaaatcattctattataaagatacatgcatacatgtatctttcatttcattgcagcactattcacagtagcaaagacatggaaccaacctaaattcccatcagtgatagacttgataaagaaaatgtggtacatatacatcatggaatactatgcagtcataaaaaggaatgagatcatgtcctttgcagggacattgatggagctggaagccattatcctcagcaaattaatgcaagaacagaaaaacaaacactacatgttctcacttataagtggcaactgaatgatgagaacacatggacacacagaggggaacaacacacactggggcctgttggacggtgtggcgggggaggaaggagagcatcaggaagaacagctaatggatgctgggcttaatacctacgtgatgggataatctgtgcagcaaaccacaatggcacgtggat

SEQ ID NO: 673309 - DNA, 846 bp, Homo sapiens
ggagagaactagtctcgagtattttttatttatttggtaggtggtaggtgggttatttttaagaaacggattttaactcttgtaacccaggctgaaaaaatctggaaggaatgtttagaaggataaaaaaaatgatgatttttttttctcgtttctcgaaaacagaagttcctcgcgtggtgctcccccaggcgtggagttgcacgtggctgcggatctcaactcaccaacaacctcgtgtatccccgagtgctcagatgtgaatcctgtggggtgccatcagccttatccgaagattagccgggaatcaacgaggcgcccaaccaaccaaaccgcgggctaaacttgcgggctatctcaagtataaatcacctttgtgcgagaacagcgagttcttacacctcgtgttcggccccccaggcctgcagtgtcccacaggccgcagggatactcctcgaagcctccacgtggcacacacctcgatgccatcccgcgggatccagagccacattcttctcgtgcctacgagcccccccagggtatacctgtggcgccacttcacggggcgcctttcggcgccaacaacagcccgcgggccatcaatcggggcaccatccacacgacacacacctagtgggcgccctattccagcccatctgttgttgccccccagccgcctaagcttttggaacaccccctttaaccactgagaatgtgaactcccgcgtgtgcctgtagggtccacccacccaacaagttgttggcgcaattcaacaggggcgagttcgaccccaactgtgcgcgcctagtggccctaaatatggcgcacacccaacgcacgaccca

SEQ ID NO: 673310 - DNA, 85 bp, Homo sapiens
ggcaatgcgtgatgacgacctagggttcgcgcctccccgccggtccccgcccgccgatcctctccccgccgcgccccgaggatcc

SEQ ID NO: 673311 - DNA, 251 bp, Homo sapiens
ccagttcagtgtacagaaaactgggcacagtcagaagacagctgacgatcccagccaaaatggactacgctgggaacgtggcagaggctgagggctcttggtgccctgagcagccaggagacgggctcaagcttcccgcatctgacagcgccgaggccagcaacagcaggaccgactgctcctggactccactcaacacccaaatgagcaaaccaggttgactgctcacccgccgttttaaaggctttgga

SEQ ID NO: 673312 - DNA, 414 bp, Homo sapiens
  misc_feature (27)..(27): n is a, c, g, or t
  misc_feature (46)..(46): n is a, c, g, or t
  misc_feature (48)..(48): n is a, c, g, or t
  misc_feature (277)..(277): n is a, c, g, or t
taggtgcagggtccacatcttcagacngatggactggatggtggcncngggctgtgagcatctgctggcaggccaggagaggtgggcgacagagaagtcaaagccccggccttgtggtgcaactctgggcgagtcagttcacctctctgcgtctcagcctcttcccctgtgcccagagagctgctggagggtggattcatgacgacaaaaggtgcccaggacagggcctctccatgctgagggctcgctgcaagccacccttctcaccccgtttgtngttattcttactgttccagcccaggacccagcacaagcctggcatgtaagtgaggataacccgacattgaataaaaagagaaaggaataaagctccacctaagatgtgtggggacatacagggacagaggcctccca

SEQ ID NO: 673313 - DNA, 507 bp, Homo sapiens
tagtgtcactcatatctttttattatctatttcgctggttaatacagtgacataaactgagttttggaaaaagcgtctcgtgcatttgaggatctaacccctatgatgtctgtctcggatatgcagagggagctctgcattaccaactgtgtgataaaaacaaaaattcaaggtggtccccacacccagaacccaatatttcatgtaagagcctcgacatggcttccaactgtcctcagaagctcaacccaccttcaatttactcccacactgttgcagagcccatctgtctgccccactagtcatcaagagctaggcagctagggcctttgcctcctgggagctggtgcccagtatgcaatcaaaaagtgtttgatgaaataaacaaaggaaacaaacttagaccatattcacaagcctctccagaggcaattcatgccaagactcctgggtcaggatagagagctggctctaaagggaaatgaggaggtgctggggaggccctga

SEQ ID NO: 673314 - DNA, 845 bp, Homo sapiens
ggtgtcgtgaaaactacccctaaaagccaaaattgggaataggaaatagacggtcatatcaacattgtcgtcatctgtgacacgtagattcgcggcacagtccaccactgactggccactctgtatctataacatgcgcgtgagcatctgcactgaaagtaaccgattgaagaaaagtctcgaaggaaggagagcgtgcatggaggatgggaacagggcgtcccttcaacgatatgccctgcgcgatcattgggataaactgaaaggctgagtcgtgaacagtggtatcaccattgatatctcctttgttggaaatttgagaccagcaagtactatgtgactatcagttgtatgcccctaggggtatctacacgtagtacttgattcagaaaagcgagtgcacttacatgggcaacagtctcaggcgtgagcgtgatggcgtgctaccgtgactatggttctgcgtgcctgggtgttgagtcgaattgtgagaagcctggctagtcgtccaaggagaatggggtcgaggagcccggaggagcactgcccgttctggctttgacacactgggtgtgaaacaacgtaagttgtcggtgtggaacaagatgggcattccactgtagccaccctacagccagaagagcatctgaggagcttgttggaggatagtcagcacctgactttactgagagatgggcctacaaccccggatcacggttagcatttgtggcaatctctggttgggggtggtgacaacgtgctggcgcccagtgccaactggccgggtccggggggcgcccccgtagggtggccggcggggaccgcggctgaggcggggggtccac

SEQ ID NO: 673315 - DNA, 587 bp, Homo sapiens
  misc_feature (135)..(135): n is a, c, g, or t
gatgtagacaagacgtcgtattaagggatgtcctgtgtagctttcttcaatgaagtagtcgatcaattgctttatgtgaagattttagaaatgagtgaaaatctcctgtttagacttgggtggaagcatgaatcnaaggaagcagggcctcatgtcttgatgggtcacatgtgctgaaggtgagtgagaagaccttaaacatccgtggtcatcaatcgtcttatctcaatactgagcagcttggggattaacatccatgccgcttgcctgtgcagtttgctctcacaatattacgcaggcccatgctcagctgctttcagtgattttgaaagcagtcattgacgatcatctgtataagaccattcatctgtatggaagtcatctatgacatgagtagtggagaaatcaagtaagtgggggaacagattagtatgggggggaactcaagggctggagatggcatcatagaatccacaacttagagttaaacgtactttcttctccagatcgcaaggcaggctctgggatctaacttgtcttataaatgagaaagttttaagtgattgctgtattgatatatcaggaca

SEQ ID NO: 673316 - DNA, 357 bp, Homo sapiens
  misc_feature (29)..(29): n is a, c, g, or t
  misc_feature (91)..(91): n is a, c, g, or t
  misc_feature (99)..(99): n is a, c, g, or t
  misc_feature (105)..(105): n is a, c, g, or t
  misc_feature (122)..(123): n is a, c, g, or t
  misc_feature (126)..(126): n is a, c, g, or t
  misc_feature (132)..(132): n is a, c, g, or t
  misc_feature (135)..(135): n is a, c, g, or t
  misc_feature (141)..(141): n is a, c, g, or t
  misc_feature (144)..(144): n is a, c, g, or t
  misc_feature (156)..(156): n is a, c, g, or t
  misc_feature (158)..(158): n is a, c, g, or t
  misc_feature (167)..(167): n is a, c, g, or t
  misc_feature (172)..(172): n is a, c, g, or t
  misc_feature (182)..(182): n is a, c, g, or t
  misc_feature (188)..(188): n is a, c, g, or t
  misc_feature (198)..(198): n is a, c, g, or t
  misc_feature (246)..(246): n is a, c, g, or t
  misc_feature (308)..(308): n is a, c, g, or t
  misc_feature (319)..(319): n is a, c, g, or t
ggatctgtgataatatagccaagattaanagattacttgttctagctttcctggatacaaatgaatgccactcttgtgtagaataggtgcnctgtaggnacaagnaggtaatccatgagagnnggngctgcngantacagnttntgcccacataantnagtattggnaacanaacttctganattgtnagggattgantgtgccctggtgaatgtcaacatttgcctactgcatttgtctcaaaanagatgcacttatttactgtctaattgatagggtctcttatacaatcttaaatcctatatgtnatttaactatngtgtgattcttctcttgttcttaatttttaagattctt

SEQ ID NO: 673317 - DNA, 205 bp, Homo sapiens
  misc_feature (150)..(150): n is a, c, g, or t
atgccaaatctgtcaagatcaagaaaaataaggacaacgtgaagaaagcgatgcagccagatacctttacaccctggtcatcactgacaaagagaaggccagagaaactgaagcagtccctgccccccggtttggcagtgaaggaactgnaaatgaaccagacacatgattggtaactgtcattatattaaatcactaaaaatcc

SEQ ID NO: 673318 - DNA, 708 bp, Homo sapiens
agcaagaaacggaccagccccagaacaaacctggaagtgaccatggccgccgacatagttctgtattttgtggcgccttccttttgaggaaagcacggaatcacgaatagcctttcctatatctttaaaacatttgtaaaaagcgcctacactccagggggggtcatctgaagggccagcagtaagactgttttcatgggacactcaagtcctggacatagggatcttgattcaccccatagacctttctttggatagttctgcccagtgggtttttcaaagtgggtactagagttttccatacacacgcatgcttcacagcattttgcagcagacaccgaaaacgtttttgtgaaaacttgatttactaggatttgttatttattgcagctgaaaatgaagactggggtaacttaacagaaagatcagttttcggaattttagacagagttttggctcataaatcattagccagagaaataaacgacttgtttcctaagttctggagcccgtacaaaaaatgcccactattttttctagaaattgacaaacacttagaagcctccgcttttagcagtggggtacccaacccaccgggaaaacaactattggacaaaaatttggtttttttgaacgaaaactgaactcttgctgtccttcttggtttcagaaggttgtcgcccgggttaaaacggtagacttgaagag

SEQ ID NO: 673319 - DNA, 228 bp, Homo sapiens
cgcatcatcaggaagcggatatgctctttgcggaggacgatggctgccagcgcgtagagggtgtcagccaagaacgccctggtaggtcctacgccttcaacatgaagtagcgccgtggtaggatgaggggctcaagggcaaggatcagccgagcgcggtacatagaagcaaggttctgggacaacgtgtcaacgaggtcatctcgtctggctggacgccaacaccttg

SEQ ID NO: 673320 - DNA, 138 bp, Homo sapiens
agaagctaaaacttgtttccgagactgggaggattagtaggctttcttttgctgtattgttttataggccttctttacctcccagtctccgccaacaagttttagttttttattggtttggagactgcctcgccaaat

SEQ ID NO: 673321 - DNA, 129 bp, Homo sapiens
agccccagtcaagatgttgaaaaacgtccctgtggaaaatttttacccggcacccccgagaaaaatttaaaaaagcccccgcgggaaaatttttttacagacccccccacgaaataaataaaaaacggc

SEQ ID NO: 673322 - DNA, 233 bp, Homo sapiens
  misc_feature (51)..(51): n is a, c, g, or t
aaaaaaccccttttgggggggaatttttttttttgggccccccaccccccnccccatttcccatttgaattcccccctaaaaaaaaaaaaaaaaaaaatgcggcagccccatttttccctttattttttgaccctccccccccgtaaaaaagggactttagttcagttttaaaaccaagggacccccattttatttaattttttttaaaaaaaaaaaccaaaagccttggcca

SEQ ID NO: 673323 - DNA, 187 bp, Homo sapiens
gctggcatccattaactacacaccttgtatgaagaggtggatgttgcagagtagccacttgctccagacaccagggacaccattgagccatgtcgacgcaagctggattcagatccatatccagattcagtctaaaaaaaaaagtaaactatgtgaaaagaatttaaataaaaaatacttgagaaaa

SEQ ID NO: 673324 - DNA, 532 bp, Homo sapiens
ccacgcgtcggacccacgcgtcgcggacgcgtgggtcgaaccaagcgtccgcggacgcgtgcacaatgaaatgtcagtactgatcctcaaccaattaaaatctacagtatgaaacaaaaaaaaaaaaaaaaacaaaaaaaaaaaaaaaaaaaaaaaaaaaaaaaacacacaagagcaacaccaccaaaacaaaaaacatatggacaacaacaaaaaaaacaccagcaaaagaaacaacatacacaaaaaagaacagaaaaaacgagatacaaaaaaaaaaacagaacaaacaatcaacaaacaacaacacaaacgtaaaagaaaagaaaagcaacaacaaagccagagcagctcaaaaaagaagcacaaacaaccaataaaacacgcaaagcaacaacaaaaaataacaaacaccaacaacacaagcaaaaaacaaacaaaaacaaaatagaaaacacacaccacaatcaaaataacaaaaaagtaagacaacaacaaaagaaaaaaaaccaatagaaaaaaaataacacag

SEQ ID NO: 673325 - DNA, 306 bp, Homo sapiens
ggatggggtctgtacggttatgtaaggaggctcctggagctggcccaggctctctgcagcatgcctttatggagtgcctacggggtagcacgatcagatgacaggccaggctgccagagctggggtggagcaaggtaagcagagaggtgagggaaggagggtgctggcttagcaggagctgaatgaattggcctggaggggaaaagctaagggggatggggtggcttgagtggagtaggttaggcctaggttaaggggagctgtggaccttccaggacggacggatgcgagcagtcctgagtgggg

SEQ ID NO: 673326 - DNA, 199 bp, Homo sapiens
cagctcggtccgtgtttgggctcaggacgtccactgacgcatgctggagggcacctcccctttaccacactgctctgtacggggcacgttggcacacatgcacactcatactcacatatcgcctgtagccctgcaggagtggaactgggtctgggctgtgaacgttccactcctgcagggctcaggcgtatatctgagt

SEQ ID NO: 673327 - DNA, 545 bp, Homo sapiens
ggattacaggcatgcaccaccacacctggctaatttgtatttttagtagagttggggtttctccatgtggtcaggttggtcagctcttgacctcaggtgatccgcctgcctcggctcccaaagtgttgggattacaggcgcgagccactgcgcctggcccacctggctaatttcttaaaaaaattttgtagagactggatttcactgtattaccctggttggtcttaaactcctaggcttaagcgatcctcctgcctcggcttcccggagtattgggattacagtggcgtgagccactgtacctggcctggataagcattttaacgtggccatttatttatttaggacagagtctggctctgtcgcacaggctggagtgcagtggcatgatcttggctcactgcagcctccacctcccaggttcaagtgattctcctgtctcagcctcctgagtagctgggactacaggcacgcaccaacactcccagctaatttgggattttagtacagacagcgttttgccccgttgggccaggcgaaactca

SEQ ID NO: 673328 - DNA, 148 bp, Homo sapiens
gcaggttcgtacacttagtcggtattccaaagtatttcggcacgaggattgacaaggggacagacaagttgggacgtcagggaattgaacaaaagggacgcagttttttgggtggatgggggtgtgggagtctgagcaagggtgaggg

SEQ ID NO: 673329 - DNA, 803 bp, Homo sapiens
accagatgtggtgacgctattgattatgtcctgcagcttcaaactttggatcttttagaggttgcctattttgagctgtgttctcatgtcacttaatttactgatacaagtttgatacatgcaattgttgggaggaaagattcctcagaaggcacaaagagctgtattgtgtatattccatttcaaaacaagagaaacgtggtattcatccttgctgatggcattcactgaggtatgacgacatagattggcacagctgaaggttctccacgtctgactgcacccagattggtgggctgttgttcttatagatataatttaaaggaaggcttgtacattccccaggtatctcacatgatgctattgctcaagagtctaaacgagtagttggcagaactttggaacgcaaatgtacctggagacgcaggtattattctctagtgtactttctgcactttggtgtcctttctggaattgcgtcaatagatgtcggtcgtcggctggatgcagttgaacacttacaagtccagttactattcttaatattccattcaggtgagctcattcttatgtgaacaaagcaatatgcgatttcagtcgatcatcataagaaaattatgcagacccaacaatgcttgccaagacgtgtagggacactgtcttacctcgatctagtttaagttgacaaaacaactggagttctgggctttaccgggttctcggagtacggggggttacgcactactattcaataggttaagcttgtccacctggcatgtctccgttttttccattgctctccc

SEQ ID NO: 673330 - DNA, 779 bp, Homo sapiens
agcggagcttccggcaaggccttcaagcgcgggacgcgacgaagtcatggaccgcaacccctcgccgccgccgccgggtcgcgacaaggaggatgaggagtgaggtggccggtggagactgcatagggagcacggtctacagctaaacactggactcttcggcgtcctcagcggactcatccaggatagtcagccctgacaaacaccaaatctagctcagatgatgaggagcagactgacggaggcttgatgaacgataatgcgagaactgaagattatgccaggagctatgggagtagtgtcaagtggcatgaggacgtgcgctgttatttcgtgcaagaggtttagatgctccgtgagtacgtagtatcagtgggcaggtactggcccaaagggtcccaagatgtgcctcggattgaaggaatatttccgtgtcagaccgtggacccagatatcgactgatgagggacacatgagggcaagctgtgagcaggctaggatggtcaaagttggaactggatatccgccgttagatcgcgtacacgagcgtgggagtatagtatagagtggcatttatcacgcgtttggaggaagggtcgtatacccatgcgatggacttgacaaatcgccgtaatatgtccacgattgcacctttgaaagaggggcgcccatcgcctcgcgttcagtttggcgaaattcgaggggagtcaccagcgtggaagtggttggcaatatacgtggggaaaaataagattgagagatagaacgtggcatgcaaa

SEQ ID NO: 673331 - DNA, 306 bp, Homo sapiens
ataccgagatccagctctgtatgcaagttagacagtgctatcaacgtcctttgatacgtagagcacatattccttatggcaggttcaggtctcgactacttatacgcatatgtttcttgaccagaaactttacactcactgtcattatgttccctatcgcgacaaaactactaacacaagtaatatgctgcttcaaattataacagaaatctgtgagagtggcatgatataattgcctttggattgcctgcttttattattatcactactactgtctgctcacgatttctgtgcccgtttccaggt

SEQ ID NO: 673332 - DNA, 377 bp, Homo sapiens
atgtctgtgtactgcagcaatgtgtgaggagatgaatggcacggtgatcagtgcacggggagaccctgctgccgcaccaatggaggagatcaactgagctgaacctgcatgatccatgaggctgactggctgaggtggagaatgccaagtgccagaactccaagctggaggccgcggtggcccagtctgagcagcagggtgaggcgtgccctcagtgatgcccgctgtaaggctggccgagctggagtgtgcgccctgcagaaaggccaagcaggacatggcctgccttgatcagggagtaccaggaggtgatgaactccaagctgggcctggacatcgagatcgccacctacaggcgactgcttggattacaagga

SEQ ID NO: 673333 - DNA, 134 bp, Homo sapiens
catctaaggaccttatcgtgtgcatctgcatctagcacatgtgcgctaatgtctgcagatgctctagagtatacatgcgaaagagagcaacgcaggtctataggcgtgctcaagtatcgtccgttctcactgtg

SEQ ID NO: 673334 - DNA, 152 bp, Homo sapiens
cgcttctgtgggtctacgctgctgcttactttgtcacggcacgctggcggcgcgcggtcacctgcaccgacttccgttactgttctcctctgcccgacgtccctgggtggactcgactcaccacccgggtacccgagctcgaccttcgtacc

SEQ ID NO: 673335 - DNA, 124 bp, Homo sapiens
ccccccagtcagtgttcccggacgttggcaccccgccacgacgggtgtgccacttctcccctccccacgccccggctgcggactggcactggccccccctcactctctccggtgaccgtgctcg

SEQ ID NO: 673336 - DNA, 698 bp, Homo sapiens
  misc_feature (625)..(625): n is a, c, g, or t
atggctgttgctgacaggactggttccgagacgtcttgattcgcatggctgagctgagctgtggctacgctattttgacgatctggacgctatgcagtgcactgcaaagattcaggtgaactgaagtcatgcagtccagaatggaaaggcaagtttcctgaactgatatgtgatggggttgcatccattcgacatggaagctgaattactgaagagtggagagagaagtgcaagcgtacagcattcagacttgacttgaagcaaagactggacttgatatctattgtactacactgaattgaccacaactgaacaggatgagaatagctgacgtgagaaccgtgcgacgttgacacagcccacgataggatagtgaaatggagacatgacattagtataatatgggttagaatataccgcacttggattggatgagatgctgatactagcttgcctagcaacattgacatgctaatgcagtacaagtacattctcagaacgcagtgttatgatactagtaacgtggacatgacactggttatcatattactatcagtgctgtcgacatgacaaggtgcagtgtagcaagccagtacacttcacggtttagtatgggtgggcacgncacagttgtgcgcgccatagaccagtatttatctacatcgccatcttagtccagattagactggtctggctgg

SEQ ID NO: 673337 - DNA, 235 bp, Homo sapiens
ctaggtcggtaccccagagcaagaccccgcctaaaaaaaaaaaaaaaaaaaaaaaaaaaaaaaaaaaaaaaaaaaaaaaaaaaaaatttacccgggcgtggtgtagggcgcccgtaataccacctactcgggaggctgattcaggaaaatcacttgaaccgggaggcaaaggttgcagtgagctgaaattgcaccattgcactccaccatgggtgactgaccaaggtttcacctc

SEQ ID NO: 673338 - DNA, 128 bp, Homo sapiens
gggggggtttggatttggggggggggccccccttttttttcaagggccccttttttttcccccccttggggggttaaaacccccccttaaatggaaaaaccgttttttggccccggccccccccccca

SEQ ID NO: 673339 - DNA, 763 bp, Homo sapiens
gggcgtttcattgatcattccatggcccctcggctgacaattaaaacggcatctcccctagctcaccaggcctggcctcggggcagtgtggcctctaggctatatctagtgtccagtatatggaggctgagtatctaggtatcatgcagacaaagccctgtcctatcagtcttctagaaacagagacaagaaaggcagacacaccgaaggacaggcacccatgtagggcgcccaccctgggctaccacacagcagtgtcccctggccccagaggtcgcagactaccctacagacctaccaatagacattgagctactagtaccagcccggcaagccccattctaggaccggtgctagggttcaccactacccggacctaaggcaccctaccaccgactactaccctgtacacgcgtcatagtacctagtcctaggtcctagaatgcccgtatagtctaggagaacagagccaagcactgctacacgtactctgccgcctagcgtaaaggagagcccctgggctctcacccagtaccccacccgactgcagagagggaactagggcaccccttgtttctgttgttcccgtgaatatatatcgctatgggaggcagccgaggcctggccaaatgcggcccactttcctgagtctgtcgctgctccatggcagcagcagggaccccagaaccagaagacccgcaggtcctcctagctcgggggtctagctctcaggcccggttctttccagcaagtgagcattgta

SEQ ID NO: 673340 - DNA, 88 bp, Homo sapiens
attgtcttctggctgcttctgagtctgttgagaaatcagctattatttatttgcaataatatggctttcccccttctgtcgtcttctc

SEQ ID NO: 673341 - DNA, 283 bp, Homo sapiens
acaggttcccgcgcggctgccggcacgggacacaaccctcaaagacgcgcagcgctccagctgcctacgcagcagtaccacgtctcggcccaccgtcgacttccagctcaggctcctgcaccagtcactggctcatgctctggctccagctcttcctccgtcatccagtcgctcaggaagctccagcacctcccgcatctccagctcttacctagcccttctagtgtctctcctcacgttcctttttcggctgcagcacccttactcacagtgacgcgctccc

SEQ ID NO: 673342 - DNA, 168 bp, Homo sapiens
gatattctgtgttaccacgctgcaggcggacacctcaaggataatcactaaattctgccaaaagaactgaggaacggtggctggaaaagggcaagaatatcacggcatgggaatgagtagcttgaaactgctgaagtatgtcctgtttttcttcaacttgctctttat

SEQ ID NO: 673343 - DNA, 247 bp, Homo sapiens
gctgagaaggagcggcgactcagggtcgccgcccctcctcaccgaggaaggccgaatacagttatggccacccaggtaatggggcagtcttctgaggaggagggctgtttaccagcagtggcaacattggattagccctgcctaacgacatgctatgacttgcatgacctttccaaagctgaacttgccgcacctcagcttattatgctggcaaatgtggcttaactggggagtaaatgcagctcct

SEQ ID NO: 673344 - DNA, 244 bp, Homo sapiens
gagtatcccgatgactcttgaagcctggcggtgttacaatgtgctcgatgggagagctcttgagtccaggaaaaggaaatccacaggattaatcactcagttaaggtggggcaagaacaaatcacaatggtggaatgtcatcagataaggcggggcagggccttttcacttcttttgtgattcttcagtaacttcaggccatctgggcgtatacgtgcaagtcacaggggatgcgatggcttgg

SEQ ID NO: 673345 - DNA, 1137 bp, Homo sapiens
  misc_feature (482)..(482): n is a, c, g, or t
agcggatcttgccgagcttctgttgacacgtgcctggagcaccagaacagccggagagtggttcttcatcacagactctgctcttgcttaggcttaaggtgggtggtgggggaatggacgatgaggcatttggtttattgcaagactatagatctcggagacgccgatgtagaataactggtcccgtgcgtgtagctcacaggctaacatgcgcaagatgtctcttgggttgcacctaggcagtggacaattggatgcactcgcgtcgtcttggtgtgtacccataaccagacgctccaggtgtctctgggcaagattgtgaagctgaagaacatgttgaaggtgcgcagggtgggcatggagatggaggaacgatggggagcatcacagtggcttgggatacttggtgacgaggggccaaggaaagttaacgcagggagcgaagggtaggctcgaatcgaattatgtatcacacttgtccnagggacatctataaagcatggacttaggggtcgcgggatgagcgtgtggcaagccgttaggtgggatacggattaaggcgcaccctaggataaccaaagcgcgagagagggcgctggagacagaatggagctcgtagcgctgtaacgtgggtcataaggcggtacagggggaaaccgggcttggaccagccgctgtaaatctcgatcgcttgattcgtcgcaagaaccccaaagcgggattcgcatttgaacatgaacaggtgggagttccaaagcgcacgcggtgttcttccttgactcctggagggtcctggccccgggttggccctgagtctatattagtgccccataggcaccgactcatggtcctgaagggtggacatggggccaggcacagtgcaacgacgggcacccacatggttcatgtgtacgggctaggcttagataatatgtgcactggggcacccgtgaggttcgaatgtgcgcatggggcaatctaggaccggccacaggtagaaataccgtcaaggcttaagaggaatcaccttggtttgtgacaacccccaggaagtctcgtatctgggcacaattaagccggtatttaggttgggaagcgaacggccttgaagggctcccctttgcctgtagtacttga

SEQ ID NO: 673346 - DNA, 700 bp, Homo sapiens
  misc_feature (41)..(41): n is a, c, g, or t
  misc_feature (43)..(43): n is a, c, g, or t
  misc_feature (60)..(60): n is a, c, g, or t
  misc_feature (62)..(62): n is a, c, g, or t
  misc_feature (69)..(69): n is a, c, g, or t
  misc_feature (77)..(77): n is a, c, g, or t
cctgttacttccttcgtctacgctaccacacacgccgcccncncttgcacaaccatgaanantctctcnggtgtccnccggtggtggacgctctagaactagcggattccacgaactgcacgaattcggcacgaggcccagactcagacatctaaatttgggggggtggcgctaggtactcctgaccacacacaccctaggctatggaaaaacgcagtatatggctgtggtgctctgcctgtgccacactgtgaccatagggaagggctgcgtgcttctgagctacatagcacgagacagttacagtgagtgcttccttggagcttgttaggggaaacaggagacttttcactgacctggaggggtcgaacgacatactagactgtgtggccatccttgaaccaaagtcttgatacaatgaggaggaaatgtcactcactgctcaagtgcaaggaccaacccaagaatttaagaagcggaccaacgtgagggtaaagacgaagacaggctgctctttgacacctcggacgatcaatctactaaccaggggagacaggtgaaaatccaggtcgctttcatgggcgttttactcacctggaagaatgatttcccctcgtttcattcacgatcccacaagtaaatggattggaacatggataagtctgtttggcgggtggctcaggtatttatttccccttct

SEQ ID NO: 673347 - DNA, 337 bp, Homo sapiens
cgcgcccactcttgccatcacactggaacgccaatcacgccccctttaaattaaactataagccctctatctagagcccaatgggagctttaacccacccaacaccttagttatacacgctatagcacccctaatcacaactggcttcaatctacttctcccgccgcccggggaaaaaaggcgggaggaagccccggcacggtttgaagctgctttcttcgaatttgccattcacatatgaaaatcaccctcggagctggtaaaaaagagggcctaaacccctgtctttagatttacagtcccatgcttcactcagcccttttacctcaccccccca

SEQ ID NO: 673348 - DNA, 263 bp, Homo sapiens
cactgaggtggagagggctctgcacactttagccccaagccactggacacccgggcctgcttcctcatctataaaatgggcctatttatgcacagcggtctcataaggaccgtgagccaagcgaggagcaacaaacatgaactactgtaatgcctgtgatcatggctagtcctaccactgccatgtgcgttaacgactgctggcacgggtggcacctgcatcctcttgggtcatctgcaccatggccagtaagcccattttat

SEQ ID NO: 673349 - DNA, 362 bp, Homo sapiens
  misc_feature (237)..(238): n is a, c, g, or t
  misc_feature (240)..(240): n is a, c, g, or t
  misc_feature (247)..(247): n is a, c, g, or t
  misc_feature (261)..(262): n is a, c, g, or t
  misc_feature (281)..(281): n is a, c, g, or t
  misc_feature (330)..(330): n is a, c, g, or t
aggaagaccctcaatcttcccacccggtaaaaaaaaaaccttccaaaaacgtttttagggcccccccccaagccccttttaacagcccgtgtctccccggggggggaaaaacccccccccccggggggggccccaaaagcggccccaaggagaacctttttttttttataccggggggttcccccccccaaagggaggaaaaaataggggccccccccctcgcggtttttttaaaannanacttttnccccccccccccgnnacatttttttatttttttntgggggggggggggccccccccccaccccccttttaaaataaaaatttngagggggggggcgcccccccttttttatttag

SEQ ID NO: 673350 - DNA, 708 bp, Homo sapiens
  misc_feature (47)..(47): n is a, c, g, or t
  misc_feature (81)..(81): n is a, c, g, or t
  misc_feature (98)..(98): n is a, c, g, or t
  misc_feature (101)..(101): n is a, c, g, or t
  misc_feature (106)..(106): n is a, c, g, or t
  misc_feature (108)..(108): n is a, c, g, or t
  misc_feature (394)..(394): n is a, c, g, or t
  misc_feature (532)..(532): n is a, c, g, or t
  misc_feature (573)..(573): n is a, c, g, or t
  misc_feature (607)..(607): n is a, c, g, or t
  misc_feature (610)..(610): n is a, c, g, or t
  misc_feature (615)..(616): n is a, c, g, or t
  misc_feature (669)..(669): n is a, c, g, or t
  misc_feature (677)..(677): n is a, c, g, or t
  misc_feature (685)..(685): n is a, c, g, or t
  misc_feature (692)..(692): n is a, c, g, or t
  misc_feature (699)..(699): n is a, c, g, or t
acgctctcctttagaattttacagactaaagcacaacccgaagcaantcacagtctcaatcattaccacactacctaaggngcctgcctactctccanccnccccntngctgaagtttgtgacatgccactgtaaatgtaagtattattaaaaattacaaattgtttggtgattatcttgatgacctcttgagcagcagctccccccaagaatgcagcaatggtatgtgcgctcagcagctccatatcggcaaaattcgtggacataatcatctttcaccattacagataaacatattcctgaaggaagccagtcagacaagacttcaactttcctatatcttcttcaacttgatagtcagatactcctggatatctaccctgttgtctatganatctatcaacagcgcgtaacattaagtacaacactatttcattatctggattgtccatgccagacataatttcatccttgtcaattgtatccaaaccatattcttcagctaaggatcgacatcttaccactcgaaganatgcagaattgctgcagagtaattctaattctctctctganatggactctggtgcctggccaatggactgcagcnatntggcnncatgactacccacagcggcagcatctctctctgcgttctcacggtacacgccntgcagtcntatatatntgcctgnatctgcnatcacatca

SEQ ID NO: 673351 - DNA, 363 bp, Homo sapiens
tctagaggatcggacgtcgacttctgctctttctggaggctggatgagtcatgtgtagacaaaaacagatgggagttgggaggtcagccctgagcagcgacagactgaggatgttgtggttggggatacagtgagtatattgttcatgaactaggtaaggaactaactcctcacctcttgtgctcctggaggaaggttgacattggtcaggagagcagcatggagagagacagctcaatggggttcttggagcccctttaagcacaaggtttgggctatcctcattgatttggctttccccaagtccccctggagttattccagcctgtagaaggggccaagtctagagcagaaggtcgacgc

SEQ ID NO: 673352 - DNA, 849 bp, Homo sapiens
atggcacatgcagcgcaagtaggtctaccaagacgctacttcccctatcatagaagagcttatcgccgtttcattgagtcacgccctcataagtcactggtacctctatcgtgcttcctagttcctgatatgcccgttttccctaaccagcgtcacaacgataacgtagactacatgactaacatcgtcagacgctccggaaatagaaagccgtctgaactatcctgccctgccagtcatcctatgtcctcatcgccctccgcattccctacgcagtcctttacatagagcagacgaggtcaactgatcgccatcctcttaccactcaatatcagtctgggcaccaagtggtactgaaccgtacgaaggtacaccgaactacggcggtacgtaagtcgttcaagctacctacattacttacggccattagttcctagaaagccaggcgaacgctaccgaaatccttgcacgttggacaaatcgcagtaagctactccccgattgaagcctcccattcgtataatacattacgatgatcaagaaggtcttgcagtcatgaggctgtgccaacattaggctgtaaaaacgagatgccaattcccggacgtctaactcaaagcactttgaccgcttacacgaacgagagggtataactacgagtcactgctcgtgaaaatcctgtggagcaactcatcaggttcctcgcccatcgtccctcgaattaatttcccctaggaacctttgacataggggcccgtattaaccctatagcgagcccctctaccccgctctaaagccagacaaaacacacacacgaacaaacaccttgtgtagggcatctgggcctca

SEQ ID NO: 673353 - DNA, 134 bp, Homo sapiens
gtgttgtgttggcgttgggtgctgtgtgtgtgtgtgtgtgtgtgtgtgtgtctgggtggtggggtgctgtgtgtgtggcttggcatgggtgggcacaggggtgtgcgtggggaggcaggcaggaggtgagcttg

SEQ ID NO: 673354 - DNA, 777 bp, Homo sapiens
agctcatctggtgcggctggcgtgcaatgtggggacatgtggctgggtggcgcatcacctggcgcggaggcaggaggatgcagtctcattgttcctgggagccgtcaccacatgtagtgtccctcgtgctcagtcgtgcccagcccctctcagtcctccccaaccccctacaacctgccctgcggctctgagcacgctggcccctgtgcggcgtgcggcagcagctgctagcatctatctccaccctccagccatggaacgacctgtgaccatgtctcctctggtctcgtcctctggacagcccaccccggccgcagcccgcgttcaatgtaccagttcgtgagggagcccgaggactgaggaggaagaagaggaggagggaagaggatggacgatggacagaagacctggaggagctggagtgtgctggagaggaagcccgccgccgggctgatccgcggtcccagtgcccaccgcccctgccgccgggcgtcgccctaatggacttcggaaatgccttcgtgccgccgggcccccgggactcctgccggctgctccccccgtcgtccccggagcggagacgtcttgggacccgagccccggtgtcgtcgaccgtgcccgagccatcccgctgttcgtgttgcgcagtctacgccgtcaagctccctgaggaggacagctccggcgtggcctaccggaatccacgacaggtaaccgcagtgagagcctgaatttccacgcagacctaggcaaacatattcatttggacagtagcta

SEQ ID NO: 673355 - DNA, 145 bp, Homo sapiens
cacaggcacgcatgaggggccgccatgaggcacggcacacatgattgtagaactttttctccagcatgctcaggtgtcaggtcagacactgagtgggtggggagcgggggaaggcccctctgtagaggcgggatccccctgctat

SEQ ID NO: 673356 - DNA, 481 bp, Homo sapiens
ataaatggttcacacaaatctgtccaattgtatctgacctgtgacttttcactgcccagttttggacaacagtatgagtgggtagcgggtaacggtcggagaagcgggagcaagccaggcagagttttccacagtgggcccgtggacaccctggaccttctctgtgacgggcgactaatacttgcgtgtctctttaggttgtggcaaataaatcatgacattagttctagcacatccgcttaagtatgcttactgtagacagccctcaaggcagccaaatccagactcatccctgtgcacccctggcctgtccctgccctttacaccgagctcatttcctgtcctcttggctcatctgctccttccactccaacatcaccatcttagggccacctgtgcagaaagtgtgcttctacctcgaatcttcatctactttgctttgggcagcatgacaacgacattccttaatcactctccagcc

SEQ ID NO: 673357 - DNA, 1414 bp, Homo sapiens
gagaagaagaagcagaaagagcaggaggctgacaatgaggtagacgaagaagaggaagaaggtggggaggcaagcaggcaggcaggaagaagaaggtgcatggtgcaggacagaggcatggcagatgcacagatgcaggcacagctgcagtccagctcacggcgcaagctgtcggcagctgcaagcatgattgcacggatgactgcatgtcgataccacagacagcagaacgacctgactgaggatgactatgacagcaaacaaaggaaaacgttacactaacagaaaaaacaatggccgccgtgacctattcaccctccacttcccgtctcagaatctaacccgtggtcaccttcgaagtagaagaggcccgacccgcccaccgctgggccagctgccacccgccagatgacacgacgctctccaccacccaacccaaaccatgcagaatctgcaacagggagagcgaacacacgcacccaaccacttccaaggcccctgacattcttcctaaacacgtaccctaacaaaagcgaacattcgcacgaactatcatacattaaccactccatatacttcaggctaccttactggcaacgggtcacgccatataatacatgactctcgcgcatgaccaaacacagcctatcgagagcagttcctctgtcctaccattctgacgtacaccattgtagcgagtgacccaatagtcatacaataactcctcacaagggagaacacaaacaaccccttggtacaagaacaaagccacacaatggacagacacgaccacaagcgcgattccttaatttacctgaggccatatcgcacgcaacaacataccgacatgctggattgctacgcttcggcagttccctctaccagcatcatctggcatcggcaccgacagcctgcggcgtcacagcgtgccacagcacgtcacaaagggtcatatgctatcatctcaccttaaacttgacatcaacacacctactctactcctcacaccaaatgccccactgaaaatacagccataactccaaacaacccgttacttcaaacaactaaaaacgaaacatccacactactcacacaacgtctacctacaacagacaatacacaccaacacaaaacctgctcacaccaacataaaaccactcatctacggatcagacacatacaatactcatacagtatactttacaactacctccattatctcatcactaaccaacactccgccaccacaaactacgcatatccacacacatctatctcactatctcacacaatctcattgcacactacactcacaacctaacccactcatataatctatcaactacacacctacctaaataacacagccaaaccccaacttatatcaatcatcggatactaagtgatacactaa

SEQ ID NO: 673358 - DNA, 1180 bp, Homo sapiens
  misc_feature (490)..(490): n is a, c, g, or t
  misc_feature (535)..(535): n is a, c, g, or t
cttccctcatggtgggcccggtggatgaggtgcgcgaactgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgcaccagcggccactctggatctgggcgagttcatcggcgtactaatgtgtttgaccgtgacacaacagggtgctccgaggtgccgctctagttccaagggtcggcgcacacagaaacagaggagagtccagagcaggaggccctgccagcggccctcccacacacacccacacactcgcccgccactgtcctgggcgccctggaagccggcggccaagcccgacttgctgttttgttctgtggttttcccctcnctgggttcagaaatgctgcctgcctgtctgtctctccatctgttnggtgggggtagagctgatcccagagcacagatctgtttcgtgcattggaagaccccaccctaagcttggcagccgagctcgctgtatcctgtgggctcccttcatctccaggagtcccctccccggccctaccagcgcccgcttgggctgagcccctaccccacaccacggccgtcctcccgggccctcccttggaaacctgccctgcactgagggaccccatctgaccagcttgggccacagcctgggctctgccaccctacctgttccgtgtacccgggcccgttcgacggatgaggccgtacagaggcctgacggactgagctgcaacggagtgacgaaggcggacctaaatcccccacctttgttggatgccctggacaggggatggctagcttgggtgcactgataccagtccccagggggccaatggtcttgcactgcacgggtgagcagtacggcaactcgccgggggatgcgtgccaagccccctaccctccctccaggcttgcacccatctcttcttagtacctcaacacgtagcggcacggcattgacatcgcaccccagctttcaccacatgcatcactacaagctcggatggcctccgggcccctacaccttccaaccacatcactcacatca

SEQ ID NO: 673359 - DNA, 792 bp, Homo sapiens
ctagccccccctctggtaggagtcggtgaaggtgagagtcagtgagggaatacaaggtagtggctgtaagggagtggaggggtggccaatctgtccttactggtgcagttggtcgctgggactttcattgagaaagatgaccccagcatcggaagagtttctaccgcaaagagatcgacacgatggactcttcccctgcatccgatgctggcacagttctggacagcgcaaggaacatgagcacgtgttgacttccagtgagacgatctctatgattcaataaatcgggcaatggtttcgatccatggtttgactatgcgatgagttaattcaacatgtcttttcaggatatcaagccaagtgagagatcaaatcgtcagagtgaacgcagatatgaaaaagtcgccactaatcgcgtagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctggcttggagaactttacaacctgggttgcagaactgagccttggtaaacctgtctctattacagcatgttgccatacatctatttaagtgcatag

SEQ ID NO: 673360 - DNA, 497 bp, Homo sapiens
  misc_feature (35)..(35): n is a, c, g, or t
  misc_feature (93)..(93): n is a, c, g, or t
  misc_feature (95)..(95): n is a, c, g, or t
  misc_feature (98)..(98): n is a, c, g, or t
  misc_feature (110)..(110): n is a, c, g, or t
  misc_feature (121)..(121): n is a, c, g, or t
  misc_feature (182)..(182): n is a, c, g, or t
  misc_feature (217)..(218): n is a, c, g, or t
  misc_feature (226)..(227): n is a, c, g, or t
  misc_feature (238)..(238): n is a, c, g, or t
  misc_feature (242)..(242): n is a, c, g, or t
  misc_feature (269)..(269): n is a, c, g, or t
  misc_feature (278)..(278): n is a, c, g, or t
  misc_feature (297)..(297): n is a, c, g, or t
  misc_feature (302)..(302): n is a, c, g, or t
  misc_feature (306)..(306): n is a, c, g, or t
  misc_feature (322)..(322): n is a, c, g, or t
  misc_feature (372)..(372): n is a, c, g, or t
  misc_feature (389)..(389): n is a, c, g, or t
  misc_feature (396)..(396): n is a, c, g, or t
  misc_feature (398)..(398): n is a, c, g, or t
  misc_feature (436)..(436): n is a, c, g, or t
  misc_feature (482)..(482): n is a, c, g, or t
ccgcccccccccccctttcctaaatcacaggggtnggtttccaagctacactcttacttctaatgccttggaaccctaaggagaactaaagcncnccngcggtggctgcnctggaagtgcngggtggggggggcggggcaatatcctgtcccaggctagatacagactctgagccaaaagcngactctgtgacatggaaagggaccacacaattttnntttttttnntttttttgtgncagngtctcgctctgtggccgtggcccaggntggggtgcngtggcacaatctcggctcnctgcnagcnccgcctcctgggttcncgccattctcctgcctcagcctcccaagtagctggaactacaggtgcccncccccccgcctggctanttttttntnttttttgtagagacggggtttccccgtgttagccaggntggtctcgttctcctgccctcgtgctctgcccgcctcggcctcccnagagtgctgggatta

SEQ ID NO: 673361 - DNA, 1261 bp, Homo sapiens
gggtgtcaccttgggccgtaagcggggtcggcgcgcactcgtcaaccggagccagagggccgattggagtcgtgcggatcggcggggaacgggcgtagtggccaggggccgggcaggaattagacggcgtaatccccagtaaccttcccctgatggtcctgtcaaaggttacctagtgatgaggggccatggtcggtgattggtgacggctacagtattgctgtcctagggctccctggatcctaggtgaatgaacccggatgccggtttggaccgggagtggaatgaggtgccgagtagcatcgaagaagtagcataataccctatgtcgttcacatttcgccttcatccagctgtactctggaaagggcgggaatggactctgagcgggcactttttagcatgggggactggaacggtggtgcggaccttgctggggctggttcgaaaggccgttatcgctactagccaactaatctcccggccttggggggcattctttattgtcccgtggggcttgttgtttggaggtcgggcctcgaactatgggcgggccttgccatgtgatgagctcccgcgcccatggggatttatacgtgtcttgataggaggcgtgttcgaattttgggacagttggtagcccggcgaggtggttggccaaactagcgatgcgcttgtgatggtgggcagatacgactcgaggtcccgacacggtgggggtcctttactaccggtgaatagactggggcccgagttgggcccgttttttcccaagatttgacccaggtgcccgttgggacttactaaaaaaggtgggtcgtcttaaccggcccattggaattttcgagaagtcacgccgcggggacatgaagggcgttgttcaccttcatacaacccttgattggacggtggggcgcttgggtatttcccccgattacccattgggcacttcagagaggccggtccgactcctggtccaaaaatggttagccccaggattccgccctactattaaatgtccccccaaattcccaatatgcggagttcactataacagtggggcacctcaacgggcattaccgttcctgcctgggaaacacgaccattccgttggtggcccaacttatactgtgggggcccatagaacttgagaatccaagaggagggagacattgggtcacacaaaactgggatgacacttcaattggccctgggtggggtgcaatttgggccaaaaggaaccccggaatttccaggaaca

SEQ ID NO: 673362 - DNA, 159 bp, Homo sapiens
atttattcatcagtcagggtgtccgattgggtcctagaacttccaaaggctggcttgtcatagaagccattgcatctataaagcacggctcctgttaaatggtatctcctgtctgaggctgcctactgaaaaggcatttggttacctcaacctctatgt

SEQ ID NO: 673363 - DNA, 608 bp, Homo sapiens
  misc_feature (442)..(442): n is a, c, g, or t
cttgcccttgccgtggggctgcagtgggccttccaagtgggttgaaagccttgtgccttctggagaagatccgtcggcgccttgtacatacccagcaagttttcagatgccaattgctgcttgggacgccttttgttaataatacatggccaaggagttccaggagggttttgcattggccgtggctccccgtgttaaggcccacaaaagccaggtctttttgtgggtgacccttgcttaaaaggggtgctgtgggcgctgtgggccaggtttcgggggctccgggaggttttgcctgccaggggaagttggaaccagtagcaaggagcccgggatcagccctgaactcactgtgtatttttttggagccttgggtgggcagggagggcccaggtacctgtttttttgggaaaaaagagggacagggccaagggcaaaaggntttaggccagagcaaggccaatgttaaagacccccgggatggggcttcacatttgccccccccagaaccagttcacttggccagagtgggttcttgttggccagggggcagccttgatgacccctgccgttgcccctggggggtggaataaaattccccccccaga

SEQ ID NO: 673364 - DNA, 533 bp, Homo sapiens
  misc_feature (48)..(48): n is a, c, g, or t
  misc_feature (169)..(169): n is a, c, g, or t
  misc_feature (172)..(172): n is a, c, g, or t
  misc_feature (185)..(185): n is a, c, g, or t
  misc_feature (188)..(188): n is a, c, g, or t
  misc_feature (190)..(190): n is a, c, g, or t
  misc_feature (192)..(192): n is a, c, g, or t
  misc_feature (194)..(194): n is a, c, g, or t
  misc_feature (198)..(199): n is a, c, g, or t
  misc_feature (204)..(204): n is a, c, g, or t
  misc_feature (219)..(219): n is a, c, g, or t
  misc_feature (224)..(224): n is a, c, g, or t
  misc_feature (227)..(227): n is a, c, g, or t
  misc_feature (238)..(238): n is a, c, g, or t
  misc_feature (468)..(468): n is a, c, g, or t
  misc_feature (479)..(479): n is a, c, g, or t
  misc_feature (482)..(482): n is a, c, g, or t
  misc_feature (486)..(486): n is a, c, g, or t
  misc_feature (499)..(499): n is a, c, g, or t
  misc_feature (507)..(507): n is a, c, g, or t
  misc_feature (509)..(509): n is a, c, g, or t
ttggtaaaacgggaaaagcgcccccaattctttaggtttggggatccngcccttgtttatttggtttccgcccaccccccgggtgttgggaggttttccccacacccccccttggggggcttttctgttttggaaaaaaccacccccatttggggggggtttcttcaanccntggcccaaaaggnttntngngntggnnaggtnccccagtttgccccnaaagnccnaagggttaatnaattttttccctaaaacccgccccccccctttttatccgtgggggaaaaacggtttccaaactgtttttttccattggcccctttagttttgtagttaaaagctggtttattattcccatgcctcgttaacccctccaaaggaaaggagaattttttttgggcccccttggtttttttttttggggggggccgtttttagttttttgttttttaaacccggccttttttntgggaaccccnttncccnaaatttttccccnaatttttngncccctttaaaaagttttattggga

SEQ ID NO: 673365 - DNA, 172 bp, Homo sapiens
agacggacagagacagaaagagagggccggaaagagcgagaagggagagagagagagagagagagagagcgagagagagagagcgctgtgagagagagacagaagtcgtcacacagacaggcactgtgcgcgctcacacacagacacacagagactgcacccccccaaacaa

SEQ ID NO: 673366 - DNA, 328 bp, Homo sapiens
taactcctgaagcatatttatactgtggaacggtacggaacagacaggagtatctgcagcggctgcagctgcgaagacgtggacccattgtctgtgttgatgtgttagcaacacgctgtgtcgacgatcactcgtgacagctgtgaagaagctggtctcatagtactaaatggtacgtcaacgagctcgctgggcggatagcacccgggcatattctgggactggatgaggtctggcaccctgagcagtccaagcgaggacttgggcttagttgagcaattttggctaccaggatagtatgcagcacggttctgagtctgttggatag

SEQ ID NO: 673367 - DNA, 900 bp, Homo sapiens
taacgcggacgccggatcggttctcgcccagctcggacccccccccagaagggccgactcaaaccaggcggccaagaatgtctgtcccgcgccagcaccaggaacgggaccagccgagacacgacaccccgaaagaaaggaccgaattagactcagctttgggcacagacactctcaacccaatcacaggagagccaccccggaggaccccatcctccggaatgtggcagaagcggtcatacaagctccctgaggaagaagctccctcgactgtctgtgcccagaaccgttttcactccaagacacggaaattcagcacctgttccgcgagcctgagaagaggccccccaccgtggtgtccaatacattcactgccctgatcctctcgccgtcgcttctgctcttcgctctgtggatccggattggtgccaatgtgctccaacttcactttgtgctcctgagcacgattatatttcacctgggacatgctgctatgctgggactcatcgtatgtctactaggactcagcttcaacatgttccagaccttgaaagtacctaggccatcttgggcagtgtgacgtttcctgggctggcaatcggatgctggcccagcaggcatgtgcacagaacgaacagcacattagttccagaagacagatggaaattctgaacaaactgaatgtcaagcaaaggagtccagaaccattcacagtatgagaagagaaatggacaataccaaactttactttaaaaaagaaaaaagtccagatctgtagttatacttttgcttgtctttcagtttccccaacacacagccacatacctggtgagctcagatagtctctttctctgacacatgtgtaagaagctgtgaatattcaaatccacccagatgtgc

SEQ ID NO: 673368 - DNA, 445 bp, Homo sapiens
ttctgactgcatcatccaggtattatttttctttaatttatttcttgagacagggtattgctctggcaccctggctggaatgcagtggtgtgatcatagcttactgcagccttaatctcctgagctcaaacaatctgccttcctcagcctcctgagtgcctaagactatgaggcatgcaccaccatgtccagctaacacccagattttctttttttttttgagacagagtttcactcttgttgcccaggctggagtgcaatggcgaaatctcggctcactgcaatctcagcctcccaggttcaagcaattctcctttctcagcctcccaaatagctgggattacaggcttgtaccaccacacccggctaatgttgtatttttagtagagacggggtttctccatgttggtcaggctggtctcgaactccgggtctcaggtgatct

SEQ ID NO: 673369 - DNA, 341 bp, Homo sapiens
  misc_feature (145)..(145): n is a, c, g, or t
gcactgatatagaggcaggcgcggtggcggaggcggcaacactgtggaaggcggatgcagaaggggattgggattcagggagcggctagtggataggctgaaaaaagggaagagaaccgacgtgtggtcaaaccgactaaagccnatatccacttacaggtgggcccacgagcgcggctagaagccttgatcaaccacaacgttgtaattcttgggagcttagaaactgtagagatggggatagtttcattttattgtttttctttacttttcttttagtatataagtatagggcgatagaaggctatagaaaggataagtttctatgttctattatgtta

SEQ ID NO: 673370 - DNA, 141 bp, Homo sapiens
gaaaaaaacccgggttcccccttttttggggggggggggggtttccccccccaaaaaaacccccttttttcccccccccccccccccccctccttgggccccccccttgggggctttttttgggggggtttttggggggga

SEQ ID NO: 673371 - DNA, 240 bp, Homo sapiens
agagacgagatgcaggtggcaggacatgagacagcaatggttgtatcaactatgaagcgttagtgaggcatatcctgtctggggtgagcggtgcccatggcggcggagctcgtccgtatggtgctgaatggctgatgatcttcccagtctccccagagtccgtgcctttcccttgtgtgaatttggtatctagcctaaagtttgcgtatgctttcttgtctcagcgacttaccgatctcg

SEQ ID NO: 673372 - DNA, 421 bp, Homo sapiens
  misc_feature (421)..(421): n is a, c, g, or t
aggtggtacacaaacccaggggagcaccacctgttgacccacgcgctcctcacaagcaccttgaaggcccatatgagccccatagcctgtacgccaagggtctcccattacaccctatacaagtcctgtgagttggacacgaacgcagcgtatggttctacagcacagtactttggggaagcaccacgttatggcgacttactgagattcccccatgagtgagaccggctgtgtgctagattctgtgtggagggccatgtgccatcaccatgagctccacattgagacccaatgcagaaccaagtggctttgacagagagggaaccctattgtgcaaccggctgccttgtaacttttgtgagttgtgccgagcgatgtgggccagggacatgggacagattctggtgtgagactctgcctn

SEQ ID NO: 673373 - DNA, 193 bp, Homo sapiens
tgactctagagtgatcccccacactgccatgtaatctgtatgcctgtgctgtaaatgatgtgttttatgatcaccccctccccaataaatgctaaaactcacctgagttgtaaaaaactccatgatgacacaaaatatgactactgattgactatgtgtgtgtgtttgtacctgagctctgaattctgtaaat

SEQ ID NO: 673374 - DNA, 109 bp, Homo sapiens
ttctttttatgtggtacatacattaacatacattttaccattttaataatgtaattaagtgtacagtgaagtggcattatagtacagtataaaaaaaacattttcatta

SEQ ID NO: 673375 - DNA, 294 bp, Homo sapiens
ggcgtgcctagaaaaaaaattaaattttcacttttcttacacagtcccgggcttacaacaagggcaaaaattacatgcaacacacggatacactcataagtggcacatatgccccaggggtctttattagataacaataaaggctagcacttggtcacggccatcagattttcttatagtcttagagtcatgtaaataaaagttcataagggaattaaggaaaattaatttttctaatcttagatcagtcccatagaaacctattaatttttttaaggtaggccgtagaagggc

SEQ ID NO: 673376 - DNA, 701 bp, Homo sapiens
gacaagcagttttcaggaaacttgataaaccgatcaagaacatctcagagaattgtgtcattgacagtcggtgctgtttctgactgggcacgtgggccggtccccagacccatagtagctgtgagctgtctaaggaaatcatggcattcacacacgcccatacacagccacgacagtattatccaagaggaacgattttgccacagtttgtattatatactatgtagtggcactgacaagcaagtgctgaggagtatttgaagtacgcaaaacacgtaatcgaatgctctacatacacctcgtgtcacagagcttacacatacttgcatactactgtggagagcctagttgatccaatcacaaaaagcaactgtagtcagtcgcaagaatcccctgattgatggggaaattgaacccttgaaggtttcgagaagccggtgtcaccgaggcacgtgttgtctacgcgtgctgctacgtagcgctggctatgaaggtaagtgctccgactgagagagcgaggttgcggatgcgcactgtcgtgccggggcatccgcctggactagaaccaccaacacctggagagtccgtgcaattgtctacacgttcgggatgttgttcaatccaccgtttaccaggggctccaaaaagcacccaagacttcttttgcttccaggtttgaactttaacttgattttcttaac

SEQ ID NO: 673377 - DNA, 239 bp, Homo sapiens
ctttatgatgagcacataaacagtttttttttctttttatttatctacttttacttacttaaattttagagatggggtcttgctatgttgcccagactagactcaaactcctgggctcaagtgatcctctagcctcagcctcccaagtagctgggactacaggaaggagctactgcacctgactcaatttttttttttttataaaatggactttgcctctgtgacccaggctcaaaaaa

SEQ ID NO: 673378 - DNA, 196 bp, Homo sapiens
atgtaggtcatagtgccctcaaggcactgcaaatctgaaaggagtgaatgatatgtgctgggaatacactggcatttagaggatgtaaacagggatattaaaaatcctgcaaatcagcaaggcatggtggcgcacgcctgtagtcccagctagtccagaggctgaggcaggagaatcacttgaacctgggaggcgg

SEQ ID NO: 673379 - DNA, 204 bp, Homo sapiens
tttctaaaattcccttttgattagctcgaatcagctcatctaattggactctttcctgtaactggtgttggaattgagacctggtgattccattcatactgtttgtcatattactttattgccctgaagtctggtatgtgtagtctagtgcccttcttttcattttccctttgtagcacctccaaaattcaccttaattctggt

SEQ ID NO: 673380 - DNA, 115 bp, Homo sapiens
ttggctatatccatcgcgacatcgaaacacagagagaactcagatggacgacatgttggtcagatgctcagccatcagcagcctgcccgagatcgtcttcaccatcaatggagtc

SEQ ID NO: 673381 - DNA, 153 bp, Homo sapiens
atcagacactatgattgttccataagtgccattatccatcaccaccgtgggctcgtgctatcctcacatgtggaatcaggcaccagccacattatgttccagacaaagcctggaagggtgtggacccagacgtggagtggagtgattctcttg

SEQ ID NO: 673382 - DNA, 348 bp, Homo sapiens
gctcgactttaggccaccatgtggaactgaacctttttggaggtttaaaatgtcaaaataccttgccgggcgcagtggctcatgcctgtaatcacagcactttgggaggccatggtgggcggatggcaagttcaggagtttgagaccagcctgaccgggatggtggaacccatgactactagaaatgcaaaaaaaaatggctgagcgtggtggtggggcgctgtggtcccagctactcgggagacagaggcaggagaatcccctgaactgggggagggcgaagttgcagtggagcgagatcgtggcattgcaccccagcctgggtgaacgagcgagacttcttgttcc

SEQ ID NO: 673383 - DNA, 981 bp, Homo sapiens
aggctgcggaagaggggactatgctatttcgaattgtggagtaatgtgcccctagatccttccgtgtgcatggatgaatcgggacggtgaactgaggtaatgtcgtaaatcatggatatgaagagttgagaagatccccaacaaacgtatctgaagaatgagtttagtcttaacccactctactacaaacaggtagtgggcttgcgttgatcaagggctcgggaagaggatgcgggaatcatgagtgttgatagctatcgagaaggaggatgtcggatgggtacatggtgagctcatgatacaagcgtgttgatgcgtcgacaccccgagtggacccactaaaaggatcctcgtgtggcacgacttggcaaccatgacaaggaagttcctcttggctgtttaatgacacacttcgcgtagcgcaggggctgtgatcgctggggcagcggcactgacttgaatgagatcgtaagtcgtcgcccgtgcgttcgatactattcgcgtgggtaagcctcgggggcgactccaatacgcgcatcgtctgtatgtgctacgtggggaagtttctttggcgtaaagagaattcctgtaggggcacaggaaagagggcctttaaaatctcaactcgtaccgattatagtcggggatggggaccttcgtacttgaatccacctagtcgcgtagaactctcctggatttaaacctatcttgactgtgttcgaacgacatagctggatcgcggccaccaggagtcatgcgtcgaagactaggcggttgttgctttgttgcgattcaccgagggggactgaatccgttgcatggcctcgtgggcgaacctccccttgtgtacttaattggttcgtaaatgaaaaggccccatgccttggacccaccgtgaagccatttggtgggaaccaccaaaggaatgagattacttgcccagcaaccccgaatctttagaaaccagaaggggttggggaa

SEQ ID NO: 673384 - DNA, 1646 bp, Homo sapiens
  misc_feature (399)..(399): n is a, c, g, or t
gcgtcctcgttgcctccgctgattgtcttgtgggtcgtgccattatgtctgttggctgagggcgtcttgcttctccgcgctgtttcttgttcccccttcgcgggtgtgtgtagttgtgagaccacggtacactcggtgtgtgttcgcggcgcacactgtctcagtaaacacagcggcgggggacgagcagcgactacgcctggtgtttgtagcaccccacctgttgtggggaccttgtcctctcactcaggtgtcctccggggtgagcttatgatggtggtcttgcgccgccagtttggcccacgggccgccacaacgaatattttttctgagatgccagcgtagtgctccgggtgttttcccgccgcccccagggggtgacctctcctcctggggccnccttgggtaccttcgacaggctgcgcccgcttccctggttatcacagtggttgtccttggggtgtttctcttttgccccccgttaggttgagagccccgagtgtgttgtaaagggccctttaatttgtgtctcaattttggacccttgttggtttttttggggaagcttcggccttattgtgaatgacgccgtcctgacgccccacccccggatgaacccgtggcccccggggaagaattttccccctcggtggtggcccacgcgctggcgccttttttggaaagcccacccctttccctctcccagttaaacactgtttttcgcccccaacccctttattgtgaaaatatggcgccccgtgtgagaaatatagcgcctctctggttgaaaatattgtgatcccctcccccccctctcccccttttacatttttacccttcggccttctggagacgagacatattctgtcgccctctttgggcacccccatgaagaatccctcttataaccaccccgctgtgtttttgtttgttgttgtatatagtgtcaaccacgcaatatgctcgcccaatatctccagaggcgtactctcacgaaaacatatggtgtgttggcataaattttcagacatatataagtgtgtcttcttttgtgttttataacgacacactttaattttttcccacacaccacctctaataagggggccttttttttggaccacttctcttttataacacctgctctttcttggtgttttttctttgtttaaagttttctctttataccacacttttaaatagagttttttttggaaagaccacacttctcaaggtgttatagccccacagagcgccacaagtggccactcttgtgtgtcgcctcttaaatcttggcgggcgttgggagaaggggagaaagagagggtgactctggcgcacacactaagtgtgtcgctcttgttaaactccgcacctctgttctttgataatatatccgtttgcaattgttgttaccttgcgtacccctgaggtgacctttccaggaagacctgaccttataatatttccggggtgaggtaaagtagttgggtataagatcttgaaccttttcatctcgccgagcgccaagaaaaatatttgaccttgtgacttgactgtgtgaagatgatggttccctgtttttaggtttgtataagtttccctctttgtgataagatgatttaataaatctcctttaaatatta

SEQ ID NO: 673385 - DNA, 83 bp, Homo sapiens
tgctcgaattcaagcttctaacgtttttttttttgatgctcgaattcaagcttctaacgttagaagcttgaattcgagcaaaa

SEQ ID NO: 673386 - DNA, 267 bp, Homo sapiens
ggaataataaaaggaatgatgttagataaatgtgactatcataaagaaaatgggggctgctcttccactatcttagtggtcaaccactgagcgtcagcgttgattggatagaatgatgctaattattgatcctgggtgtgtctgtagaccggtgttcgccacaaggacattaccatctgagtcagtggacttagactagctgacgcacccttaatctgggagtggcaccatctgttctcctaccagtgcagctcgcccctgagttgc

SEQ ID NO: 673387 - DNA, 482 bp, Homo sapiens
ccggctctgaacttaggacagtcttccatctatcgcttacagaattagtgtctctctgagggctcaaagtatgtaggagtgttagataggggattatagggttgacaagcagggtaatataaacatgggaaaatggggcaaggcaaatcactgaacaataagggcacaaaacatagagtcgggtcttccgttgagggcgggaaatgatccaaagggagtaaggggaagaaaatggaccgtaggaccgtgttcctcccactgtgcctgtattggggccctttctgttgccaccagtccggggcttggatagagagagatctgggtgaggtagcacagcctgttacttaggatgtgtgtgatcttactgttctgtgccacagtcgttgcaaccaagctcattgggctgttgtgaggatgacatgagattgtccatatgatgcttaccacagtgcctggcctgaggtgaggtctctgatgttcat

SEQ ID NO: 673388 - DNA, 128 bp, Homo sapiens
aaatggggtaggtggagttgagggagatggggtaggtaggagttgaggcaactgggcatggcacccacacagtccatgactaggcactcatgtagctgcatccctaaacatgtcacggacttgccgga

SEQ ID NO: 673389 - DNA, 460 bp, Homo sapiens
agtgcagctcttaatcgcgttcctcggtcggtacacccaaacgtgctgggatatacaggcgctgagccaccgcgccggcagaaaacaggatcttgtaaagacataagcacatccatatacatagcaacatcatacacaatcatcaagcgtggaaacacctaacatgtccatggacagatgaatggataagcaaaatgtggtatatacatacaatggaatattactcagccttacaaaggaagaaaattctgacacatgttacaacatggatgaatcttgaagacatttctgctaagtgaaataagccagctcacaggaagacaaatactatatgattccacttattatatgagacatttaaagtaatcaaacgcatagaaccaaaagtagaacggtggttgccaggggctgggaggaggggacaatagagagatgtcaacagatgtcgagtttcagtcat

SEQ ID NO: 673390 - DNA, 876 bp, Homo sapiens
  misc_feature (2)..(2): n is a, c, g, or t
  misc_feature (68)..(68): n is a, c, g, or t
  misc_feature (92)..(92): n is a, c, g, or t
  misc_feature (127)..(127): n is a, c, g, or t
  misc_feature (147)..(147): n is a, c, g, or t
  misc_feature (149)..(150): n is a, c, g, or t
  misc_feature (154)..(154): n is a, c, g, or t
  misc_feature (156)..(156): n is a, c, g, or t
  misc_feature (260)..(260): n is a, c, g, or t
  misc_feature (262)..(262): n is a, c, g, or t
  misc_feature (366)..(366): n is a, c, g, or t
  misc_feature (370)..(370): n is a, c, g, or t
  misc_feature (378)..(378): n is a, c, g, or t
  misc_feature (432)..(432): n is a, c, g, or t
  misc_feature (435)..(435): n is a, c, g, or t
  misc_feature (439)..(439): n is a, c, g, or t
  misc_feature (492)..(493): n is a, c, g, or t
  misc_feature (499)..(499): n is a, c, g, or t
  misc_feature (543)..(543): n is a, c, g, or t
  misc_feature (545)..(545): n is a, c, g, or t
  misc_feature (555)..(555): n is a, c, g, or t
  misc_feature (593)..(593): n is a, c, g, or t
  misc_feature (616)..(616): n is a, c, g, or t
  misc_feature (663)..(663): n is a, c, g, or t
  misc_feature (665)..(665): n is a, c, g, or t
  misc_feature (671)..(672): n is a, c, g, or t
  misc_feature (686)..(686): n is a, c, g, or t
  misc_feature (693)..(694): n is a, c, g, or t
  misc_feature (719)..(719): n is a, c, g, or t
  misc_feature (731)..(731): n is a, c, g, or t
  misc_feature (741)..(741): n is a, c, g, or t
  misc_feature (744)..(744): n is a, c, g, or t
  misc_feature (750)..(750): n is a, c, g, or t
  misc_feature (752)..(752): n is a, c, g, or t
  misc_feature (754)..(754): n is a, c, g, or t
  misc_feature (760)..(760): n is a, c, g, or t
  misc_feature (767)..(767): n is a, c, g, or t
  misc_feature (777)..(777): n is a, c, g, or t
  misc_feature (780)..(780): n is a, c, g, or t
  misc_feature (784)..(784): n is a, c, g, or t
  misc_feature (787)..(787): n is a, c, g, or t
cngccaagcagatttttcagcattgatgagaccgacagagctgcatttctactatgatttttgcttcngttcagcagcagattgtaagtganttagaataaaatgaataagcaaaagatctataacntggtaaggcataatctatcnannagcngntgagaaatttgaaatgaaggcatttgttaatacaagatgcaacgcacagcactctgtctgaggctttggtaaaaagtaaaggggaagaaagaacttgacagatntntttcaactcaaattaatggtaacgatgatgctgtttcaccaagtatattttgaattggtttctacacatttccagtagtatggcagtacagtgctctgttcatngcangctggcanatttatgtagctatgtggaatgatatgtcataatgtaaaattagataaattctnttntctnataattaatataacatttctggacttgaactctggcaagagatgccaaaaggnnttggtnccgtgttatttgtttatatgaattactttttaacaaggaatgtntnttattcattnaatgaattcaacattttctctgtaaaaacaatagagtntcagtacatgaactatagaaaanaatctatatataatgtacataaatgttacatttgtaaagaaaatgtnanaatgtnnctatagcatatganttgcttnnactgtgctgcattgttggatgacanctctttttgtcncagttagagnatnaggttnantnatgcanattatgnattgagtccncanaggnacncaaaactctttgtagttctgttacatcttttatggagatttatttatggtcagcctaccaatttaaactatttcgcttggcaaaaaaaa

SEQ ID NO: 673391 - DNA, 388 bp, Homo sapiens
ccgggacccagttatttctatgagaaggtacagtatctaggtgtcatattgagccacgaggaacacatgtgttgggctatgagaaggaagcaaggccatgtgtgcacttctaacgcccgactacccgatgaccaataggaagttttagacgcagcaacattctgccacatctggattccaagtttttgcactgatggctaagctgttatatgacgccacaaaaggaggggaaaaggagcccctcttttaaaaaactaagccaagaaataggccgtcaaacagatcaaggaagctttaacccagaccccagccttaagactatgagacataactaagtctttctatatgttcatgaacaaaaaacaatgactatcatagaaaatatctg

SEQ ID NO: 673392 - DNA, 180 bp, Homo sapiens
ctccttgaagaaaaagcaactttggactgtaggtgatgtaagtagttcgaggaagaatcaaagcaactgtctgccagtcttcctgcaaatacagcaaatgacttcacggactgctactatcggcattacaggagaggacagacgctcctacttcctgcaaggagcgaggagcgaacttcg

SEQ ID NO: 673393 - DNA, 817 bp, Homo sapiens
  misc_feature (489)..(489): n is a, c, g, or t
gtctacaaatgtaaaacaaggccaggtgcgggggatcacgcctgatcttccagcactactgggaggcacgaggtgggccaatcatgagatcaggagatggagaccatgctggccaacatggcgaaacctcatgctctactgaaaatacaaaaatcagctgggcatggtggtgcactcctgtaatcccgctacttccgaggctgaggcaggagaatggcttgaacccaggaggtggaggttgcagtgagctgagatcgcgccactgcactccagcctgggagccagagtgagactccaaaacaaaaaacaaataaagttacaccagagtcttcatgaaagatctaggctctgttaatgatcctgcttaccatgctgacgcaggacgtcctttttctactcctgcacattcaggtttagaacatgtatgaatggtgctgactagcagcacatattatgttgcgcatgaagttcaggtgctgcataactagnagtccatcctaatgactggaccggctgacctgtccttcaactgtccagcaaacgagtctaactgactagcgattaactgtttgacctaaagcaattgtatatctcttgagaaaacatgttttctgccgcgttaaccatgaataaaaccaaatacaggccgcatcctggaggatctcctgaggcgcttgcctttagagagggtaaataatgaccctcgctaactagatcggtggactcccgcctgcagtttaagcaaccggtctacttacctcaaagctgaataacggttattcacataataccgtgtacttaaggaaaaactgtcagc

SEQ ID NO: 673394 - DNA, 382 bp, Homo sapiens
  misc_feature (148)..(148): n is a, c, g, or t
  misc_feature (179)..(179): n is a, c, g, or t
  misc_feature (196)..(196): n is a, c, g, or t
  misc_feature (202)..(202): n is a, c, g, or t
  misc_feature (319)..(319): n is a, c, g, or t
atcaagctccgttcagtgacgagcagtgaagaggtggatgtccgaagagaagaccttgtggaggaaatcggagaacaggccagcccctctgcatctgctgaactgaacaaactatccagaggaacaggacagtggtgacttggcgacntattttttgaaggggttaagggacgaagacntgcatttattgttactntcgaanatttggcgtatttggcaacgtttatccctgtttacacgcggtaagaccatgaacgacgtggtctagagacagcagcctttgatttattattattggttattttattggattattacntggctaacggatcaggtacatagacccttgtttccatatctggcgcccaggatgggctttgtc

SEQ ID NO: 673395 - DNA, 157 bp, Homo sapiens
ccaatgggtcagtcctgtcaaccaacctacaagacaccacccatcccccaccctcttccatgggttatcaactggtaatgattctactaaccactcagatgttcaggccccaaaaccaggacctatcttgaccactctcttttctttactttcctat

SEQ ID NO: 673396 - DNA, 454 bp, Homo sapiens
  misc_feature (69)..(69): n is a, c, g, or t
gggccgatatccaccatatgatgcatcatcaccatggcacctcagattggcagactcctggggctcgtntcacagagtctcaccttgctgagatattggcaaaggccaaagaatcaggtgaaggtgctgaaggagaaggtagtgaaagagatctgatggggcagattattccaatctacggttatgggatttttttatacatagtgtaacattctatttaagctatcaagggggaaaccaattgcagaggattgagaatgctatactgccatgcttgaaaacacccacatgaaaataaccagttttgagcttgcacaatttgcaagaaaaactgaaggagacagaagcagccatggaaaaattaatcaccagagtgcgacctaaatggtgagagcttgccacctacagtctggatgacgaaactacccaggctataatagacagttatgtctga

SEQ ID NO: 673397 - DNA, 85 bp, Homo sapiens
gtatcagtgaacaaaatggttcttagaaaacatggccttgtggtgccaggtgcccagggcagctcttcccttctgtcgtcttctc

SEQ ID NO: 673398 - DNA, 765 bp, Homo sapiens
cagtacggtccggccgtactgggctcttatccctgaaggacaatgtcttaatgtataccgaataataaattatgatatattggaaaatccaacataattgcacactcagaaataactgaattgtgattattctcccaggcattacaatatatgatataatatgcatgtgtgttctttaagtaagtggattcttagaaaatataatgttctgttatctggttaatacactaaaacagtattgtaggtacctatatctgccttaatagcgtacaaatctgctctaacccctacccatgcataagcatactgatacatgactcaagtaacatataatagtaaactattactagtaggatagaatctatataataaacctataaaaccaacaagatataggacacaatataatcagatgaaagccgtgaacaagataacatagacatgattacatacctatgataacaagaaacaacctatacccacaggaatcttaaacaagaaaaaaatacaataaacaaatagagaaataaaaactccaatactaaggaggaagacaagacacaggacaattccacggaaaatacaatccccacaataagtataccaatagaagaacccgaaaacgagctacagaacaaaggaaaaaaatgaaatacaagacgtttaaatcggacgacaacaggcaaactacccaaagaacataggacgagtgaaacacctgaatgaaagaacacacatacttcggaataaagaaacagaaacccc

SEQ ID NO: 673399 - DNA, 209 bp, Homo sapiens
acacacacacacacacacaacccaatcaaaacaaaacaaaacaaaaaacagccatgtgttgtggcacacacctatagtcccagctactcaggaggctgaggtgggaggatcacttaagccagggagctgcagtgagccgtgatcacaccactatactccagagcaacacacccacaatcctgtctcaaaacaaagaaaaaagacaaacc

SEQ ID NO: 673400 - DNA, 157 bp, Homo sapiens
attctgtatgaggaagggacacaagttgcaagtgtgcaggatcatgacaaaaaccttcaagacctggtggagaccatgtcagaagtggccaccacaaaatttggtaaactttagatatttgatcaagtcccttgcgaaagctggcttcagaccgagc

SEQ ID NO: 673401 - DNA, 1248 bp, Homo sapiens
  misc_feature (1134)..(1134): n is a, c, g, or t
gatcaagaggcggcggaaccctccctgagcctgagggtcagaactgccctgggctcctgtagccggacctcggcgaagaagcacctgggcagacgtgcgtgcttgcggccgtggctgagccgctcggatgactgagagctggaggagctagtgctgcccgcgacgcccctgggtgggcaggctccggcggcacctgctgtggacgtctgcgtgggtggcagacgtgacatgcgggcggtgggggtgtccccaggactggctcgccctggtgtctggggcccccgcggttgcgggtatggcttccatgaaccgtgttcaacagtgtcgagacgcgtccactgtctgcttgtgcccctctcggtggtctcaaaggtcgtcctggtcagatcaagggggtttcccacttgcgacaccggctctcccatggggttctggaagcgcggtgaaccttgggtagtggcacaatctgtctttcctctcgtaaggggaaccttaccttctattcgtgctccagtctgaagcgttaagcccgccacaagggttgcacacatatgacctttagggacgacttaccataggcttgggatactactgggtggtttcctttagcacaggactccttcacacggggggaaccaagtagttcagcgtcattggtcggctcatagggtcgcataacatgacttaggcgtccttggggcccaagatgtcgtccaagtcccaataagcgttacgccatgggctctcattaccaggcacaagacacgatattaccagagagcatcagacgggcccgatagagcgaagctgactataagagccatctccagtttgttaatcaacggcacacttccaagttaacagggcatcgcagaacaacgcaaggtgctaagtattcatctcatcttgctattcgccaacttgtatactacacatgtccaacgccaacgcagggcagattggtcacgcccacccggaatcaggacaaaaacgctcgagagtcacccactggggattcccgttatttccgtgcacacggcaaggcttccagcgcagatcggtcgagaggtggcaaaaccaatagagttcaagtttcacatatcccggggggtcaccgtcagtccacagataccntgcgcagcccgctgctttgacgcgcgggcgtaagtacataacgccccgggtcggacggcaccttatagttacccccaactgtctgctgaacctgctcactgtcagcaagacacg

SEQ ID NO: 673402 - DNA, 717 bp, Homo sapiens
  misc_feature (49)..(49): n is a, c, g, or t
  misc_feature (118)..(118): n is a, c, g, or t
accaggacttccaggagacttatgcggaatctttcactttcagttctgncagtacggagagtgggtgaagtggtcattgacgacaggctgccaccaagaatggacagctgctctttcntacactcggacaaggcaatgaattctggagtgccctgctggagaaagcctatggcaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgagtaggtttttttcccccgcttctccagtcatctctccctctgcggaagggtgtcgtgtaaaacacacaacaatgagatcgatgtcacagtgagttcagcagcacgtcctgtctgcagatcacacagtgtgttcagaaaagagtattaaatggatccaggctgggaaaagcaaaataaaaacccctgggctgtaaaaaaaaaaa

SEQ ID NO: 673403 - DNA, 730 bp, Homo sapiens
gcttactcttggcagacttatggctccctacacaccttttctcactgaattgatgtaccagaatctaaaggtgctgattgagcctgatgtactgttcagagacgaaggacacactcagcgattcactacctcatgctgccccgtgatgcgatgaagaatggattgacagagaaaacagagagtgcagtatctcagatgcagtctgtgattgagacttggaaagtaggtgaatcagtagcaccagaataaaactatttccgcataaagttatcgctttgaaaggacagactctgtggtttatccatcaaggagtccagaagctcttaaagatatcggagtctttggtaggaaggttatcctcattgaggaactcgaatgttcgaacaggttacactgtctacagatggaaccaagtatgggcattcgcgtgtaagagggcagaaccatgatcactatggtcctgtgggaagcgtcatgaagggtagcctatgtaaggtcagtggatgtacgtccatcaagcagttgagcagtgaggagctggagcagttccagaagactgggaccattgttgtggaaggccatgaattgcagcgatgaagacatccgcctcatgtacacctttgatcaggccacaggtgggactgcgcaatttgacatgcatactcgagatgctcaggctttggtcctcttgagatgtcactcctgagcagtcatggtcgatgaaggcatg

SEQ ID NO: 673404 - DNA, 1641 bp, Homo sapiens
gggagtccatggtgcctgggtgccccaatgcctgtgggctgtctgagctccccagtgcatgaccaaacctcagtggaggggcctctgcattcaggcccctgcctggctgacattcttgatgccccccatctggagtgccccagacacagacaacctgcccatgtactttcctctgtggcttgacccaacatgtgggagttctccatgtgcctagtggaacatgtgagatgatgtgcccatgtgcaccctgtgtgtaggtgttgccctgggcgaaaactgccactgcggaacctgctacatgaatgcacaaatgcattgttccaattggcctgtagagggctggccttgccaggggtgaactcggacattatgctgttgatgatggctgcgtgatgtgccatgtggctgttccatggccctcggttgcttgtactacggggaacctccttgaccctgttggtgtggcggtgatgtgcccggtctgtgaactttatcctacgatacacgcaaatgtggtttgacagcacaagtgacacactgtggcgaacaaaaattctacacaacgtgggtgtctcaaaaaacacaccgaaccatacatgtaacggttgagcactgggcgggcagcatgcactatgccaatatgggtattgaaatatagaatatggaatacattagaagagataaaatagcaggagttggaacagattgatatcccaattaagacataaacaataccaagtccacccactttgaaaccttactgaaccatcagcgctaacataggtgggtgcaacttcatttgagccatagagtatgcccatatggcagttggcacaattggggcacaaagacacacaccaaaatacttacaaccccaatttgcaaccaatgagggctgagctcactatggcaatagacaccaccacaatggtgtcgccaccaaagtgcaccttaccagactactgggatcacgacgaaccaaggcggtagagggaccacatggttgggaaacaaaagacacgcgtgcaggagcagagacccccaagaggagagcagtataaacccagtccacacattgaatgcaaggaatagatacaccccatggaaatggaacattcacactaagcacacaaagtggaccacagacaccaagattgagtcaagggcaaacagtcgattgggttaaagaatggaagtggacgcccatgtttacatggtgaaaacatactagacccccgattgaccccaataagcgagcaagccgccacgacaacatcagaacgatagatgcgcatgcagaacgaacgagacgcaaaaaaataatttacctcattagcctatggtgacaatatctagtagccagacacattgtaagaaggaggattacgaacagaacgcccggtgtaaccacaagaaccagaaagcaaagatggtacgagtgatagagcaaagagacacactgaggtagacctagtgttagtgtacacaaaacgagtctgatacatcgaccgcacgatgtagcagcctataataatgaataatacatcaaggaagacacaagcaggtacgcattcatatacacgaagaatacagatacgaagacgatacggattcaaagactaggactcatatacgacgagc

SEQ ID NO: 673405 - DNA, 134 bp, Homo sapiens
  misc_feature (31)..(31): n is a, c, g, or t
tggaggcgctctacgacggatcccagaggtngtggcagggatggataagaggtgtactcttaccgtccccggttctacctcttatccatccccggccaccgcctcatacccatcccctgtgcccaccgccacaa

SEQ ID NO: 673406 - DNA, 884 bp, Homo sapiens
taaaaaaaccccggttttgggggggggggggttttaatactaagtggaaatgatttcttttagggggaaaggcccttgggaaattaggccttttttttttgtgtccttctgcgtaacgagggagaggaacattggaacagctagaaagcaaaaccgcgaactcgggaataaacccgcggttctaaaccccagacatgcagcgtcagggacttaacatcgcgtggcaacaaagcaacaccttaaataagcgcgggcgggccccatgcgggaagtgtccggatccaccatgcggaggctccgaacaccctcaatggtggatagtgagcacactcacaacaaaatgaagaagtcggcgccgtggtaaactccccatgaggggatacactggtgtccgcggtggcgtctcaaagtcattagtggaggactccaacgtgaggagattaaatagacaagctaacgactaagtgaacagcgtgagtgtgcaaccggtctctctaccgccaagtgtcaagccgagaacccggcggagaagggctgcgaggtttaagcgcgacctcgccgaaggggctgcccgccccccaaaccgcgagaacatctattataaaaaaactgcaccagagggtacgggggaaaaccgtatacaagcgagcacccccgggggaggggtatgaggctaacaacagagaccagtgagatgggcgagcattttacacataccacatcttaacaacagcgccccaccaataaaagggcgcacctaccaacgagaacaaatggccggggagaggtacactgcgccccgcgccatcacttaacaaagcggggaacgaagcgcacacacaatccgccccgtgagggaacaaacacaaggagatcaacagaag

SEQ ID NO: 673407 - DNA, 368 bp, Homo sapiens
ttcgaagagtaagccagagctagtacacagcaggacagtgattcatgctgtcttgagtcgagtgctcacagctctcaaggagtatatgtgtggaccccagatctagcaggcagtgagtccttgtctcgaatacaactgggcaaggggtaaggtgcccagaaggagtttaagtgtaacatcaccgggtgggtattctcacttagcaacctaggcaaacgcaattaactacataaaactcattaaataacacactgctctccaacagcactggcagggatgagaggaggagagtcattttttctttctccaaagacaaaagaaagcagcaaggaggtcgggcacggtggctcatgcctgttatcccaaca

SEQ ID NO: 673408 - DNA, 108 bp, Homo sapiens
tgctccagcttaactgatattctggaggtcagcactggtgctcacgtgtctgacgtgaacttgtacagtgaggcatgcacctgcagatggtgaatacactgtctgacc

SEQ ID NO: 673409 - DNA, 348 bp, Homo sapiens
ccgttgatttggagagcaatgggcagccgggggaacaattcaaaaaccacccctcccggggtgggatccgacgggtccttttttctttataacaagctccccctggccaaaaacaggtggcagcagggggacgttttttttttgtccgttatggattagggtttgcccaacccctccacgcaaaaaagcctttccctgttcccgggttaattagttggacggccggcaaaccccccctccccggggtttttcggttgcccgaggattctttgcccgttccccgttttcattctttcccggccccccgcatggaaattaagccccccccccttcccttgggcccttcga

SEQ ID NO: 673410 - DNA, 115 bp, Homo sapiens
ctttctttctttctttctttcttttctttcttttctttctttctttctttctttctttctctctctctctctctctctctgtctctctcccctccctcccttctgtcgtcttctc

SEQ ID NO: 673411 - DNA, 273 bp, Homo sapiens
ggcatgctagacgatacgccaagtcccatcgtcacaccagacgccctgacgtcttctcaaacagacatcgccggctctcgagacctctccaccagcacagtactcaggagtcctgctggtctcccagtgctgttctaagggtccacatgaaggcaggtcatgcgggactccccgggcaagcacttctgtaccacggaacagcacgaggcgcacgtgagccctggacacggccggtcctattggacaacaggaatacttaagacgtgatttggc

SEQ ID NO: 673412 - DNA, 951 bp, Homo sapiens
tcaagcgtgcgcaggccatgacccctaacagggggcctgtcaaccctctgtaatgacctccggcctagccagtgtgatttcacttccactccatataggctccgcagactaggcctactatagacaactgactaaccatatatcacatgtatggacgcgactgtatagcgagcgaagaaagacttggcactaggcaaggaacaccgacacatcgaaactggtccgaaaagagggccgttcggaatttgggggaccttgaggtgtctgagtgttgttaggactctcgagaaatgtgtgtgttgtgtgtcggcgggagttggtgctgaggcctgtgtgtaaccacatccagacctaggctcgcctactcgccctgagatctaggagggtcgactggcccccgaaggagggcatcagcccggttaacaatcacgcgctagaagtcccagctcctaagacacattccgtgattagctcgcatgcaggaggtatcaagtcagcctgaggctcaccataggtctagtagcaaagagcaaccgaaacgcaagtaattcaaggcactgctgatgacgagattgttactgggtctctattttaccctcctacaagcctcagagtaccttcgagtctcccttcaccatttccgaggacatctacggtctcaacattttttgtagccacaggcttccacggacttcacgtcattattggctcaactttcctcactatctgcttcatccgccaactaatatttcactttacatccaaaacatcactttggttcgaagccgccgctgatactggcatattgtagatgtggttgactattctgtatgtctccatctatgatgagggtcttagaaaacaacacaacaaaacaaaaaaagagaggggggggccaaaaacccccgggggcccattcgatccctgtttttaaagggccccaagagggga

SEQ ID NO: 673413 - DNA, 863 bp, Homo sapiens
agcagctctacccctcacgacgacaaacatggcagcggcagaaggaccagcagaaagatgccgatggcggaagggctgcgtcgggcacgactcctgcttgcgcgacagcatgacttccctccggatggctaggccgaggcagctggcttggtagcggcgccgagactgagcgatccggactccttgtgagcatccttctgtggaccatgcagtcgcttctcacggccccgcaaccttggggagagctgtgccattcgtcctcatacgtcaagcgtggtagtactaccagaggcaactatgtgttcggtgttccgtggggcctcatcctgtactgtgtggtgacgtcccctatgcttgctggtggcgtctggcgtgtctttttcggcgcctgttacaattcgtctatctgcgcaccttgggagtccaagtcttggtgctcgttttggccgagaggtgagcccagcgcttcagtatgctctggctggaggctgtctccttccccttcttcgtggctggctggtgcgggctcggccggcttctgggtgctgggagccaccctggtggtcatcggctcccgcgctgccttccaccagattgagggctgtggacggggaggagctgccgatggctccctgtgtgagggtgtcttctgggacctggcggcctcccggggccaggtgccccagccgtgcccatgcctgtcctgcacggctcgtgctgctcgggcccacagacgccgtcccatcacaagcccggggagggatcccgcctttgagactaagctggaatgggatgtcattcaggaaaacacaaagaaaaaaaaaaagaagagatcactcgagaataacccagaagggcgacaa

SEQ ID NO: 673414 - DNA, 196 bp, Homo sapiens
taccattgcttcctccagctctgtcagaaacctggtggctgatatccgcagggatgtcaacgtcgcattcacaggatcacactttcggcacctatacatgcacattggccttgtaatcatcgttccggcccaccccttatgctttaaaagtctggttgtccatcccattgctctcactgagtgaaggcacataaag

SEQ ID NO: 673415 - DNA, 156 bp, Homo sapiens
tttttttttttagctcacatgctattgttagtgttagtttattttatgtgtggcccaagacaattcttcttcttccaatgtggcccagggaagccaaaaaactggacactcctggtatagatggtgtggctcattctgctcatccttctgtcgacg

SEQ ID NO: 673416 - DNA, 371 bp, Homo sapiens
caggatgccatcaaagtctactgcaatatggagactggtgagaccagcgtgtacgcccactcagtccagatgtggacaagaagaactggtagcatcagcaagaatcccaaggacagatgaggcatgtctggttcggagtagagcatgacacgatgtgcatatccagtatcgagtatggtgagacagggctccgaccctgccgctgtgcgcataccagctgaccttcctgcgcctgatgtccaccgaggactcccagaacatcatcgtaccactgcaaaggcaacagagtggcctacatggaccagcaaactggcaacctcacagaagggcctgttcctccagggctccgaagagatcgagatcagtgcgag

SEQ ID NO: 673417 - DNA, 301 bp, Homo sapiens
ggaagacagtagaggatccccgacaggctccccagggacgctccaacgcgctgcctgaccggcttaaaggggctgacataggtgcccggggggtgtgacgcctcccatccggttcagacgcgcttggcgaggaactctgaccttgaggagatgctctgaacagggaaagtttagagtgagggttgacatttcacatttagcatgttggttaacaacttttcacaagccgaccctgactttcaggaagtgaaatgaaaatggcagaatttatctgaagatccactatatagaaatggaaccc

SEQ ID NO: 673418 - DNA, 168 bp, Homo sapiens
ggaattcagccggttcgccgcgcgcaacggagcttcgaagacggtgccgtcgatcagcttgccggtgtagtgaacgcgaacgcggtcagtacgcgccgggatcgggccttcgccctgggtcagaacgcggaactgcaggccagactcggtgctgttcacgccttcgcg

SEQ ID NO: 673419 - DNA, 1002 bp, Homo sapiens
aaattaggctaggtacgaggctgggtttgaatcggccgagggttaacgccggtcggaactgctccggagggcacgggctccgtaggcaccaactgcaaggacccctccccctgcgggcgctcccatggcacagttcgcgttcgagagtgacctgcactcgctgcttcagtctggatgcacccatccccaatgcaccccctgctgcgctggcatgcgcaaagccaaggaagccgcaggcccggcccccgtcaccccatgcggggccggcaagccgagtcccactaggctgccggctagggactccgtgggcctgaacgtccgtggcaaaatccacgttccaagggttcagaccacttcctagcaaacctggcggtgaccgcgtatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccaacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcctggacaacagtgtgtacctgtggagtgcagctctggtgacctcctgcagctttgcaatggagccgctggggaatatatatcctctgtggctggatcaaagaggcactacttggtttgggcccagcgtcctggttcagtttggattccgcgcgaacggttccattacagactctgccgatgctcctagctgaacctatcgacatggtcagttggctccccctatttggtaaacagtcccctgtgccccaaat

SEQ ID NO: 673420 - DNA, 965 bp, Homo sapiens
aaattaggctaggtacgaggctgggtttgaatcggccgagctccgtaggcaccaactgcaaggacccctccccctgcgggcgctcccatggcacagttcgcgttcgagagtgacctgcactcgctgcttcagtctggatgcacccatccccaatgcaccccctgctgcgctggcatgcgcaaagccaaggaagccgcaggcccggcccccgtcaccccatgcggggccggcaagccgagtcccactaggctgccggctagggactccgtgggcctgaacgtccgtggcaaaatccacgttccaagggttcagaccacttcctagcaaacctggcggtgaccgcgtatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccaacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcctggacaacagtgtgtacctgtggagtgcagctctggtgacctcctgcagctttgcaatggagccgctggggaatatatatcctctgtggctggatcaaagaggcactacttggtttgggcccagcgtcctggttcagtttggattccgcgcgaacggttccattacagactctgccgatgctcctagctgaacctatcgacatggtcagttggctccccctatttggtaaacagtcccctgtgccccaaat

SEQ ID NO: 673421 - DNA, 836 bp, Homo sapiens
  misc_feature (836)..(836): n is a, c, g, or t
gccgagggtccaatcaaccctagaacccgcgtcacggtccgggttttcagcaatacccaccaaccggaagggccaagcgagaggggtcttcactttttcccctcctacagtgtataattgtcccggaaagctaaaggctaagaggctatctgggaagctcatcatccagctcaggaagagatgaaaccaggaggcaggagaatgtcaggcatgaccccacacttgtgcaacagccacgtcctgctcctgccattagcatggctcatccgaggcccagccccaggatccatacaaagtgtgttcctgctgctggcttctcatctgctctgcttcctaagggacgtatctgttgctgcgtctgaacccacggtttatcgaaatcccaccaagatgtcctgccagcagaaccaacagcagtgccagccccctcccaagtgtcctatccccaagtatcccccaaaatgtccctcaaagtgtgcatcctcatgcccacctccaatctcttcctgctgtggctccagctctgggggctgctgtagctctgggggctgtggttgctgcagctctgagggaggtggctgctgcctgagccaccacagacaccataggtcccactgccacagacccaagagctccaattgctatggcagtggcagtggccagcagtctgggggttctggctgctgctctggagggggctgttgctgacctggaccaggagcagcaccaaaggaattagtgggcgaaggacccattgcagcctggtgttttacctccttcactctcttgcctttcctttctggagccccatcaattaataaaagcagatcggcagn

SEQ ID NO: 673422 - DNA, 199 bp, Homo sapiens
gagagagagactgtatgttgagtgtcagatcagggtattgaggtgagacagtgacgagaggttcttgttcgcagtgcctcaggatgttatgtgagtggtctgagttattcaagctgatgtggcgagtcgagattcatttgcactctgacagtcatgtggtggcacctgcggtcagttctcttccctcaggtacgagtcg

SEQ ID NO: 673423 - DNA, 131 bp, Homo sapiens
ggtaaaagataatttaatttcagctcctcagtcacactagctgtattccaatgcgctctagtagccacatgttactagcagctactctattggacatgtgcgggtgcggaggtattcctatcaggcacagg

SEQ ID NO: 673424 - DNA, 349 bp, Homo sapiens
  misc_feature (19)..(19): n is a, c, g, or t
  misc_feature (59)..(59): n is a, c, g, or t
  misc_feature (157)..(157): n is a, c, g, or t
  misc_feature (189)..(189): n is a, c, g, or t
  misc_feature (212)..(212): n is a, c, g, or t
  misc_feature (251)..(251): n is a, c, g, or t
  misc_feature (265)..(265): n is a, c, g, or t
cccccttttgggttacttncccctttccaaggaaacttattcttccaggcccatttccngatttcccttaggaatgtatgtgttaccccataattgacccacttcaaacttgtaagaaaaaaaatgttatggtccattttgttatttttagagaccnaagtatttctaatctaggtttgcatacaaccntgaggctgtgagatcattagtcnattgctttaattataagccctgttttttttttaaatctnaaaactaatacccnatctataagaattataacagattattttcttcattaaattactttgtaatcaagttctagattaaatgtttaaacatgcattaa

SEQ ID NO: 673425 - DNA, 1712 bp, Homo sapiens
  misc_feature (75)..(75): n is a, c, g, or t
  misc_feature (296)..(296): n is a, c, g, or t
  misc_feature (319)..(319): n is a, c, g, or t
  misc_feature (323)..(323): n is a, c, g, or t
  misc_feature (800)..(800): n is a, c, g, or t
  misc_feature (1208)..(1208): n is a, c, g, or t
  misc_feature (1241)..(1241): n is a, c, g, or t
ggggcatgcgttgtcggggctcctgggtagtgaggaggtcgccgctgccgagcactgcctgtgcttcatggaggnagagagtgctcgtccgccggtctcccggcgatgcctggtctgggcgctgtctcagaaggccggacaagagtcaggagatggctgagtagccatcgccgataactttatgctagaatgcagtgcatagcagtgttgaaacactgtaaggaacactgatgggaccctttcgaacctgtgtcctgggaaaaggtagaaggcacgcgtctcgtgatacgagcganaacgagatgtcatctacgctagntggnaatgcgtacttggagcctccagatataacctcaacgagggtagtgagtcgcatgcacctggatcatccgactcgggagacttgggaagttgtggcagacacgccaaggcatcctacgcctaggtacatgagaacccacgcataccacatctcattgtcccgtcgcggtctctcttacgttcgaacgtattgcttgtgtgcgatcgtgatccaagtgcagagcctcttgcatggtgttggggccccatggggcagggcccaggggcgcaattgcctaaaacgcgcccaagacaagaaagcccgaaactttccgaggtcaccatggcgcttatccctgggggcttcaacagagtttcttatccaactttttccacgcgccctgggtgggccccttgtatacccggttacctggtatgcaacaaagtgtacgtacgacccactagaagctctttgagccatggaggacgccgacataccncaggtgggaccgcggtttgtgagttgcacataatacatggtgcgcgagaaccgtcgcaagggcatcgtccgcatgtgcctggcaacttgattacttgttccgcaaaaggcacaccgtttttctaaccgggggggtggcgccccaagtggggcgcacctcgacttgggggataagacagcccaggtggcttgtgccccccccttggtgatgggaaccggcctttggcgtgggacattttgggttcgtaacctttaagggcgcccttggttcacaacgccttatgttcaaacactttgtcggcgggacacaaccacgccaattgccaagggtcgctttccattgcccccattgggaaacgcgttctctccaatttaattaggggcacggaacaacaagagtatgagacancttgaacactttaaaaacccccagaggtggtgnacacccacggaccacgtcaattttttgcgccgggaaaagaagaggcctgtattcaaacccaattagcgggcatctgggtggacgcacaagcgatcgtgctcacgcggccgggcggcgacacactattgtttgaccaccctgttctgacggtacgactttcccctattcccctattggctctgtgggtgtgggtacggcaaaaacctatataacttgcgccaggcgtcaacatcggccggccacagcttggggttgtacaaacaccgggcggcctttggcttttacggacaccaactaaaatgcccgtggacatgcgctctcactagtacaacattggcgcattttatatgctacaagcgcagcagccgacaagaaaaatgtgccgaaaattacaaccatgttacccttaggggggcgattgcagcacccaaacaggttgcgacctccgcaccacctggcggagatccatcc

SEQ ID NO: 673426 - DNA, 1080 bp, Homo sapiens
  misc_feature (37)..(37): n is a, c, g, or t
ggagatagttccttcgggggcgcatcccctgttgctngcccaattgcgtgggtccgccgccactcctccgccgccaaaagaattagtcggttgttcttctcgtcacaccacgggggtactctcgctccacgcctccaggaagattgccgcggtttgacgccccattatgtttcccgtgcgccaccataggggcggtgtttgtatagtattgtaaggagataatattaggagagagaatagttgtggccccccgctttggggccccagaaatgggccccacacacacacgcctgctcagtagcgggtattagacgctttctctactgtgatatacttttgggggaaatataacgcccttcttcccgagataaaagagacatgtgtgtcccctctgaggagaaggcttttggtagattactctcagataaatatcacgcgcacctcggggaagtactgtgttcgaaggagacctcttctgtgttgtgctcgagagtagtattgtggggaccccctcttgtgtgtagtattggagagagtgtaaaacactcggtgtggccccccctctggagtgagtgtagacaccctgggtgctcacggggcgctgcgagagtgtgtgtctctctgcgagagtcttgtctctctattagagagggcttcgggccacacagagacacccacctttgtgtgtgtgtgttgtcttttctcgggggtgtctctgcacacggggtgtgtggagaaagtgtcccacacacccgctgaggggagaccccacgtgtgtgcgctctttctctatagctgcagagatgttctcttgggcgccacagagaccacccgctcggcgctcgtgtacacttgcgtcgtgttgaagttggaaaccgcggtttgcactttagcgccccggtaaaaggattcacatttgttaaatttaatgttaagggtttttttgtggacgccacattgtctcgaatttctttgaagagatgaccacaccacaattttggttttttactgtcatcgtgagaaccttaggcccccagccacacgtccttgtgtaaggaaaaattaaagtgctgcccgtta

SEQ ID NO: 673427 - DNA, 94 bp, Homo sapiens
cctcactcccgctgcttgcactcccggatggtgctgactgctccctaagcggcggcggggcgagtcgtgaggaccgcgcggaggctgttcgggg

SEQ ID NO: 673428 - DNA, 719 bp, Homo sapiens
gccactctgcatcaactgaacgcaaatcagccacgtttaacttaagcgtaagcccttacgtagaccaagtgggacgttaaacgccacaagaacactgtagttaaacagtcctagagcaccctaatcaacctgggctgtcaatctacttctcccgccgccgggaaaaacgggcgggagaagccccgggcaggttggaagcttgcttcgttcgaattgtgcgaagttcgaatagtgacaaagtcacctcgagagtctgtgtaaaatggaggccgtatactcactctgctctcttagcatgttacatgtaccgagatgtcttcagcattcagtccgatttttatccctctagcgcgcgcgcaacttgtactggtatcgggcactgaaccccagttatgagcatcagtatcttcttgacaagatcgcaacgaaaaagacgaattcggatagcaacgtgaataacgcgtactttactatcggtgccgcaggtgagtcttggaggtccctaagggcgaacaacgtcttctaaagggcccccatccgtttaatgttcggaagagcgctgatgccttgggtggccagacgcaaagggcgagaccgcggtctcatacagggcttaaatcagaagccgagcaagtccgttatccaaatcccgctttgagttccggtcgaactacagatccccaagtggcaatctctggtaaaattaaattcatgtcctg

SEQ ID NO: 673429 - DNA, 547 bp, Homo sapiens
  misc_feature (28)..(28): n is a, c, g, or t
  misc_feature (41)..(41): n is a, c, g, or t
  misc_feature (79)..(79): n is a, c, g, or t
  misc_feature (106)..(106): n is a, c, g, or t
  misc_feature (123)..(123): n is a, c, g, or t
  misc_feature (126)..(126): n is a, c, g, or t
  misc_feature (207)..(207): n is a, c, g, or t
  misc_feature (230)..(230): n is a, c, g, or t
  misc_feature (316)..(316): n is a, c, g, or t
  misc_feature (350)..(350): n is a, c, g, or t
  misc_feature (402)..(402): n is a, c, g, or t
  misc_feature (409)..(409): n is a, c, g, or t
  misc_feature (426)..(426): n is a, c, g, or t
  misc_feature (430)..(430): n is a, c, g, or t
  misc_feature (472)..(472): n is a, c, g, or t
  misc_feature (510)..(510): n is a, c, g, or t
ggggggggattcccaagaaccctggttnacccggtaggaanaataattaggaggggcaacattaaagattactggatgnggagaattcccatgaacccttggtttnacactgtaaggacagantanttcagcatgggaacatttacagaccactggatgatgaagaattcccatgaactcctggttccaactgtaaggacacattanttcagctgtagcctgaagccgcntccttacatactgtaagtttagcctataggtttctccatacgtagtgaacagtcatctaattggatgtgtggacactgtaacttantcttgaatcagtcacaggcagcagcacttcaaantctgtttcaataagccagacacgagctgtagccaccctgctgtttgcaggcntcacttntgctttttgtgcctcantccnttttctgtccgtaagtctttggccacacagtggcactgggtntttctgagcttattttggtttgagggttccctgattcntgaatcattctttgctcaattaaactctgtaaaattt

SEQ ID NO: 673430 - DNA, 291 bp, Homo sapiens
ctgaaggcgtttaggccacagactctgctgagaaataaagatcgcatgtaggatgcgcatgtcctatgtgttgtcatgtccttacggaatcggcccagcatcttcacagcagatgaggaacagaatggaacacacagttgcttcctattaagtgattttcactcttctagtcacaggcttcacagggttctatatttacacttttctatttgcagcagtcctactatctctggaatgtactggccgtctttacaaatactgccttattttcttcatagcacttaacaatat

SEQ ID NO: 673431 - DNA, 160 bp, Homo sapiens
ctggtaaagtcaaagctgcgtatgcccaaggtcccagtataccttctaggtatatccctagagaagttgttggccatgtgagcaccagaatacatggcataaatatttgtagcagcattgttcataagaatcaaaaactaagaacgactcaggtggtgtg

SEQ ID NO: 673432 - DNA, 240 bp, Homo sapiens
ccacgcgtctttcagtgctccttcaacccacagcctaaactgcaacttgcctcttatcctacttctctacttctggttagaaccttgaagaacactaacaggctgggcgcagtggtcatgcctgtaatcccaacacttggggaggccaaggtgggcaaactgcttgagaacaggattttgaaaccagccttggcaacatggtgagatctcatctctactaaaaatacaaaaaattagcca

SEQ ID NO: 673433 - DNA, 272 bp, Homo sapiens
tgtatcccccgcgggcaatatcctgttctacactggaaactcgcgcacgagaactgcttgaacccgggaggcggagcttgctagtgagccaagattgcaccactgcactccagcctgggcgacagagcgagactctgtctcaaaaaataaagaataaaaaatttccaggcaagagtgcagtagcatgactcgtagctcactgcagcctcaacctctcaggcccaagcaatccttgttgcctcggcctcccgagtttgcttaggataatctgc

SEQ ID NO: 673434 - DNA, 353 bp, Homo sapiens
taggcaatagagcaagactgtgtttcaaaaaaaaaaaaaaaaaaaaaaaaaaggatgagttcatgtcttttgcagggacatggatgaagttggaagccatcatcctcagcaaactaacacaggaacagaaaaccaaacaccgcatgttctcactcataagtgggagttgaacaatgagaacacatggacacagggaggggaacatcacacaccagggcctgttggaaggttggggggtgaggggagggaacatagaggacaggtcaataggtaaagcaaaccaccatggcacatatatacctatgtaaactgcctgcacattctgcacatgtatcctggaacttaaagttaaa

SEQ ID NO: 673435 - DNA, 922 bp, Homo sapiens
ttcccgcagaaataggacgtgtaaaaaccctggtgatgccgcccgacatttggggctacaaacgtctgggagataaaaatcggtggggccgtgttaaaccacccccgcggacgtgcggagagtgcctggggccctgccctgagacacctgccgcagaagggcacgcaacaatgtaaaaggccgtcgctaattctcgtaagggcgccccccccccctgcttcaccgcgccttaggaaattgtcccctcggggccgtaaaccgccaagccagccgttggtaggggctaacaagccaagaaggcccataatacaggggtctttccaagaggcggtgagcaaaaacaaaaaaagcttgctataggatagaccagtccaaaggccaaaaccatcaaggagcccatgtgaacaacaagggagtagcctcgccttctggttacaggcgagaaaacgacggtgcccacactttcaagaagagagtggtcgagaacccacctattaggagttagccaagaagacaggacaggcccacacctagccgcatcattccaatcagcgggcgtcggtaagagctcgatagataagggacccccccccccgaatactaccgttagagacacttctctttaaaatcgatggatcacgaccttgggtaacaccgagcacccattggtacaggttgcgaagactaggagtcttcaaattaatcatcggggtgcaatcttataataaggtgggggatcaaaaatattatagattctctataatattcctaaggactccatgacaaattatggtcgacgagtgactctataagcttaggcaaggataaattggatggacgaattctaaaaggtgctgataaacagcccaattttgaaaacaaagacatagaaaaatatccctaaataaccggcacaaatcaa

SEQ ID NO: 673436 - DNA, 389 bp, Homo sapiens
  misc_feature (46)..(47): n is a, c, g, or t
  misc_feature (115)..(115): n is a, c, g, or t
  misc_feature (149)..(149): n is a, c, g, or t
  misc_feature (153)..(153): n is a, c, g, or t
  misc_feature (169)..(169): n is a, c, g, or t
  misc_feature (195)..(195): n is a, c, g, or t
  misc_feature (218)..(218): n is a, c, g, or t
  misc_feature (233)..(233): n is a, c, g, or t
  misc_feature (267)..(267): n is a, c, g, or t
  misc_feature (276)..(276): n is a, c, g, or t
  misc_feature (283)..(283): n is a, c, g, or t
  misc_feature (291)..(291): n is a, c, g, or t
  misc_feature (295)..(295): n is a, c, g, or t
  misc_feature (297)..(297): n is a, c, g, or t
  misc_feature (303)..(303): n is a, c, g, or t
  misc_feature (331)..(331): n is a, c, g, or t
  misc_feature (338)..(338): n is a, c, g, or t
  misc_feature (341)..(341): n is a, c, g, or t
  misc_feature (358)..(358): n is a, c, g, or t
ctttcatttaccttttttggcaaaaaggagccttttgctctctgtnnccctaagagccccctgcacagggaaaattgccccctccagacctggctcccctcttgatctctcttgncctcttctgctcttttcctggggctcctttttcncggnggggtgtgggtaatanaacaaccgtgggcttttggggacccntaacctttttttctctcttttgnttataaaaaaccctnaaccttccattcccgagaacccaaaatccccccntccccccgnaccctantaaggggnttgngntttgcncccaaccctttctcttttccttctgtcntggtaangcntttaaaaaccaatgagntttttatataaataaagtttttaaagtgtga

SEQ ID NO: 673437 - DNA, 154 bp, Homo sapiens
gtatgtacggaaagaagatatgacctatgcagtgagaaaactggataacactaagtgtagagactcatgagggcgaaactgcctacatctcgggttaaagttgatgggcccagaagtccaagttatggaggaactcggtacacgaagccgttag

SEQ ID NO: 673438 - DNA, 193 bp, Homo sapiens
ccccctaactgcattcatgatgcgaggctgaggggtgtgtcccaatctagcacacaacgccacttggcgaagtcagctccgtccttcttgtacttgggcacagcgctcagacatgccatccaacccttgagtggtagtctcgcgatttgtccctgccagtggtaccacgcccttgtctaccttgatgcccaca

SEQ ID NO: 673439 - DNA, 139 bp, Homo sapiens
cgatactgctctaacgggtcagaaggcgccagagaggaaccagctgactgagccttgctcctgggccctgctcccctcctggctgcagctgcaccaaggttctcattagcaggtgcccccgtctagtgagctgtaatct

SEQ ID NO: 673440 - DNA, 289 bp, Homo sapiens
aagggccaaaaaccggtttgttttttttttttccaattttgggggccccaccccctttttttttgggccgggaaagtttccttttttttaaaccccccccccggggggggggcttttttaacccctttttccccgcccttttttgaaagggggttcatgtgggttccccttcccccccggggtttaaatcatttacgggccaggttttctttgggggggggggatttttggttcttcttttaaccctttggggcctaaataaatttttttaattccccggggggcccca

SEQ ID NO: 673441 - DNA, 190 bp, Homo sapiens
  misc_feature (63)..(63): n is a, c, g, or t
ttcacactgggtcgagtcttagaaggctgttagcaaaggcgatcaaaactgcgtttccttacnacaaccatcatgtgatgacaggtgggctttttgcttggtgcttccaatatgtctagaagaaaacaccccattattaaaattaatctttaaccatctaaaagggattcaccattttaaaggttttttc

SEQ ID NO: 673442 - DNA, 240 bp, Homo sapiens
  misc_feature (74)..(74): n is a, c, g, or t
agatatttaaatgttcttattctgaaatgcaattctgtaaaaactactcctaaagacaagattagaaaatttcngccaggctcggtggctcacatctgtgatcccggcactttggggggctgaggcggacggatcacctgaggtcaggaattggagaccagcctggccagcttggtgaggccccgtctctactcaaaatgcaaaagttgaccgggcgtggtggcacccgcctggtggcca

SEQ ID NO: 673443 - DNA, 436 bp, Homo sapiens
aggttcctgccttcatgtgaaggagtgaaagaggtgcatctcaattctctgtgttgtgtggtttccagacccttgtttcagttctccatgagggcctttaataagttttaattggtaattctttggatgtagaaataacccaacagccagacagggcacagtggcgcaagcctgtaatcccagcgctttgggaagctgagttgggcagatcacttaagatcaggagttggagactggcctggccaatatgatgaacccccatgtctaccaaaacatacaaaaattagcatggtgcgggggtgcccgcttgtaattccagcttcttggaaggctaaagtgggagaattgcttgaccctggcaggtggaggtctcagtgagccgagatcgcgccactgtgctccagcctgggcgtctcagagtgaggctctgtctaaa

SEQ ID NO: 673444 - DNA, 233 bp, Homo sapiens
taattctctactggtttttaaaactggcattatcttccctctatttctctcctcaggctctctccccccacacccttcccttttctggtggctggcccctcacccgccctcggccgagtcccagggtggtagattctgtctggtcgggaagcccaggcaccaggcatgcatgggttttggcacacaggcaggggcatgctggctctgcggccacacaaggtctaatcagggtc

SEQ ID NO: 673445 - DNA, 244 bp, Homo sapiens
ggacagaaatccggtcactaccgtctcaagcaactgcgggtcaggaaggaaagtttttctcccttttgaatccgctatcgatcagtcaactgaatgaatgtaatgttgcaatgaagtaatattggcatgtgtaaaataagcagctgaattggttgcgagcgctagtaaaaggccagcgtttaaatcgttgttcggagctccttctactacttttttcgttgatggatccacagtcgcatgacac

SEQ ID NO: 673446 - DNA, 454 bp, Homo sapiens
  misc_feature (355)..(355): n is a, c, g, or t
gacctgaacaagtactgagaaagctgctagcaaaataggagcttctccagcatgggcaacatggtgaaaccctgcctataccaaaaataaaaaaattagccagacttgatgggagcctgtagtcccagctactcaggaggctggggtggagaacggttcgagcctgggaggtggaggttgccgtgagccaaggtcacgccactgcactccagcctgagcaacagagagaccctgtctcaaaaaagtagctgggtgtgatggctcatgcctgtaatccaacacttaaggaggccaaagtgggtggatcattcaaggtcaggagtctgagaccagcctggccaacatggtgaaacantgactctactaaaaatacaaaaaattcacttggtgtggtggccggcgctgtagtccagctactcaggaagctgaggcaggagaatggtgtgaaccggga

SEQ ID NO: 673447 - DNA, 187 bp, Homo sapiens
tggacatcgcgagcttcatcaccaaaggtttttatttatttatttttagtagagacaggtctcactatgttgcccaagctggtctcaaactcctgggctcaagtgatcctcccaaagtgctgggattacaggcatgagccaccgctcccggcctgtttgtttgtttcttgatggaagcgtcgcgcat

SEQ ID NO: 673448 - DNA, 1706 bp, Homo sapiens
  misc_feature (97)..(97): n is a, c, g, or t
cgacgctaacgggctggcactcgcggtcccacgtggctcaggacaccctttcgggggcgtgtctcccagttctagaggttcccagagaagaggaggngctcactaaccaggcagctcgcccagactccgggcagtgagagggagggagcgccggccgcgggagcgggatggaaaccagcagcccgcggcccccgcggcccagctccaacccggggctgagcctggacgcccggctgggcgtggacactcgcctctgggccaaggtgctgttcaccgcgctctacgcactcatctgggcgctgggcgcggcgggcaatgcgctgtccgtgcacgtggtgctgaaggcgcgggccgggcgcgcggggcgcctgcgccaccacgtgctcagcctggcgctcgcgggcctgctgctgctgctggtcggcgtgccggtggagctctacagcttcgtgtggttccactacccctgggtcttcggcgacctgggctgccgcggctactacttcgtgcacgagctgtgcgcctacgccacggtgctgagcgtggcaggcctgagcgccgagcgctgcctagccgtgtgccagcccctgcgtgcccgcagcctgctgacgccacgccggacccggtggctggtggcgctctcgtgggccgcctcgctcggcctcgccctgcccatggccgtcatcatggggcagaagcacgaactcgagacggcggacggggagccggagcccgcctcgcgagtgtgcacggtgctggtgagccgcaccgcgctccaagtctttatccaggtgaatgtgctggtgtccttcgtgctccccttggcactaactgctttcctgaatggggtcacagtgagccacctgctggccctctgctcccaagtgccgtccacttctaccccgggcagctccacccccagccgcctggagctgctgagtgaggagggtctcctcagcttcatcgtatggaagaagacctttatccagggaggccaggtcagcctggtgagacataaagacgtgcgccggatccgcagcctccagcgcagcgtccaggttctcagagccatcgtggtcatgtatgtcatctgctggctgccgtaccatgcccgcaggctcatgtactgctacgtacctgatgacgcgtggactgacccactgtacaatttctaccactacttctacatggtgaccaacacacttttctacgtcagctcagctgtgactcctcttctctacaacgccgtgtcctcctccttcagaaaactcttcctggaagccgtcagctccctgtgtggagagcaccaccccatgaagcggttacccccgaagccccagagtcccaccctaatggatacagcttcaggctttggggatcccccagaaacccggacctgaatgtaatgcaagaatgaacagaacaagcaaaatgaccagctgcttagtcacctggcaaagcaggtgagcaacctcatcactaatcattcaagcttcgcagccagggcgacttctatcaacccctgctctgctgagaaccatcaagcgcagggaagccacgtgacccctcctagcctcaggctccctcgtctgtgtagtggagataaagaacagcacccatctcttagtgttgcctgagactaaagtgcttagcacagaacctggtgcgtagtagatgctcaataaatttttgctggcacgaaaaaa

SEQ ID NO: 673449 - DNA, 612 bp, Homo sapiens
  misc_feature (31)..(31): n is a, c, g, or t
  misc_feature (304)..(304): n is a, c, g, or t
  misc_feature (375)..(375): n is a, c, g, or t
  misc_feature (428)..(428): n is a, c, g, or t
  misc_feature (474)..(474): n is a, c, g, or t
  misc_feature (517)..(517): n is a, c, g, or t
taatatttttatataacaaatttatattcanattctttatttttctatgtttgtgtgatatgtttagatgtttgcagcttctagttgtctacattaaagttgagatagatatggagaaatccagccccactccctctggaacaggaaagatgactgtggtgaggaaacacaggttagcatgtggaacaggggttacagtggacacgggggtgggctgtttcttcacctcctcacattatgctaacagggacgcagaaacattcaggtgcctttgcagaaagagatgccagaggctcttgaagtnacaaaggggaggagtgaagaaatcctgcatctcagttcctcacaagacagcggtgtcaggcttttcaagcngtgagagaaacatcagagccctgggcactgtggctggacgcagcctgagagtngctccctccttttccacctgagcccttcctcctacacatcacagtngcgaccacagccccgatgaccacaactgccaggacagccaggncagccacaatgcccacgacggggatggtggactgggaagatggctcccatcttagggtgaggggcttcggcagcgcctcatgctgtacatggcat

SEQ ID NO: 673450 - DNA, 1652 bp, Homo sapiens
  misc_feature (97)..(97): n is a, c, g, or t
cgacgctaacgggctggcactcgcggtcccacgtggctcaggacaccctttcgggggcgtgtctcccagttctagaggttcccagagaagaggaggngctcactaaccaggcagctcgcccagactccgggcagtgagagggagggagcgccggccgcgggagcgggatggaaaccagcagcccgcggcccccgcggcccagctccaacccggggctgagcctggacgcccggctgggcgtggacactcgcctctgggccaaggtgctgttcaccgcgctctacgcactcatctgggcgctgggcgcggcgggcaatgcgctgtccgtgcacgtggtgctgaaggcgcgggccgggcgcgcggggcgcctgcgccaccacgtgctcagcctggcgctcgcgggcctgctgctgctgctggtcggcgtgccggtggagctctacagcttcgtgtggttccactacccctgggtcttcggcgacctgggctgccgcggctactacttcgtgcacgagctgtgcgcctacgccacggtgctgagcgtggcaggcctgagcgccgagcgctgcctagccgtgtgccagcccctgcgtgcccgcagcctgctgacgccacgccggacccggtggctggtggcgctctcgtgggccgcctcgctcggcctcgccctgcccatggccgtcatcatggggcagaagcacgaactcgagacggcggacggggagccggagcccgcctcgcgagtgtgcacggtgctggtgagccgcaccgcgctccaagtctttatccaggtgaatgtgctggtgtccttcgtgctccccttggcactaactgctttcctgaatggggtcacagtgagccacctgctggccctctgctcccaagtgccgtccacttctaccccgggcagctccacccccagccgcctggagctgctgagtgaggagggtctcctcagcttcatcgtatggaagaagacctttatccagggaggccaggtcagcctggtgagacataaagacgtgcgccggatccgcagcctccagcgcagcgtccaggttctcagagccatcgtggtcatgtatgtcatctgctggctgccgtaccatgcccgcaggctcatgtactgctacgtacctgatgacgcgtggactgacccactgtacaatttctaccactacttctacatggtgaccaacacacttttctacgtcagctcagctgtgactcctcttctctacaacgccgtgtcctcctccttcagaaaactcttcctggaagccgtcagctccctgtgtggagagcaccaccccatgaagcggttacccccgaagccccagagtcccaccctaatggatacagcttcaggctttggggatcccccagaaacccggacctgaatgtaatgcaagaatgaacagaacaagcatcattcaagcttcgcagccagggcgacttctatcaacccctgctctgctgagaaccatcaagcgcagggaagccacgtgacccctcctagcctcaggctccctcgtctgtgtagtggagataaagaacagcacccatctcttagtgttgcctgagactaaagtgcttagcacagaacctggtgcgtagtagatgctcaataaatttttgctggcacgaaaaaa

SEQ ID NO: 673451 - DNA, 177 bp, Homo sapiens
gtcgaactcctgacctcaggtgatctgcccaccttggcctccccaaagagctgggattacaaggcatgagccactgtgcctcgccatagcatttgactttgatgcagtgtttcctgatttagatcagtggactcctcaactttacgtaccacatttttctcctgatattttgatcaa

SEQ ID NO: 673452 - DNA, 1628 bp, Homo sapiens
  misc_feature (97)..(97): n is a, c, g, or t
cgacgctaacgggctggcactcgcggtcccacgtggctcaggacaccctttcgggggcgtgtctcccagttctagaggttcccagagaagaggaggngctcactaaccaggcagctcgcccagactccgggcagtgagagggagggagcgccggccgcgggagcgggatggaaaccagcagcccgcggcccccgcggcccagctccaacccggggctgagcctggacgcccggctgggcgtggacactcgcctctgggccaaggtgctgttcaccgcgctctacgcactcatctgggcgctgggcgcggcgggcaatgcgctgtccgtgcacgtggtgctgaaggcgcgggccgggcgcgcggggcgcctgcgccaccacgtgctcagcctggcgctcgcgggcctgctgctgctgctggtcggcgtgccggtggagctctacagcttcgtgtggttccactacccctgggtcttcggcgacctgggctgcctagccgtgtgccagcccctgcgtgcccgcagcctgctgacgccacgccggacccggtggctggtggcgctctcgtgggccgcctcgctcggcctcgccctgcccatggccgtcatcatggggcagaagcacgaactcgagacggcggacggggagccggagcccgcctcgcgagtgtgcacggtgctggtgagccgcaccgcgctccaagtctttatccaggtgaatgtgctggtgtccttcgtgctccccttggcactaactgctttcctgaatggggtcacagtgagccacctgctggccctctgctcccaagtgccgtccacttctaccccgggcagctccacccccagccgcctggagctgctgagtgaggagggtctcctcagcttcatcgtatggaagaagacctttatccagggaggccaggtcagcctggtgagacataaagacgtgcgccggatccgcagcctccagcgcagcgtccaggttctcagagccatcgtggtcatgtatgtcatctgctggctgccgtaccatgcccgcaggctcatgtactgctacgtacctgatgacgcgtggactgacccactgtacaatttctaccactacttctacatggtgaccaacacacttttctacgtcagctcagctgtgactcctcttctctacaacgccgtgtcctcctccttcagaaaactcttcctggaagccgtcagctccctgtgtggagagcaccaccccatgaagcggttacccccgaagccccagagtcccaccctaatggatacagcttcaggctttggggatcccccagaaacccggacctgaatgtaatgcaagaatgaacagaacaagcaaaatgaccagctgcttagtcacctggcaaagcaggtgagcaacctcatcactaatcattcaagcttcgcagccagggcgacttctatcaacccctgctctgctgagaaccatcaagcgcagggaagccacgtgacccctcctagcctcaggctccctcgtctgtgtagtggagataaagaacagcacccatctcttagtgttgcctgagactaaagtgcttagcacagaacctggtgcgtagtagatgctcaataaatttttgctggcacgaaaaaa

SEQ ID NO: 673453 - DNA, 357 bp, Homo sapiens
  misc_feature (32)..(32): n is a, c, g, or t
aattatgtgtagtataccagggacagacctanttttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaa

SEQ ID NO: 673454 - DNA, 327 bp, Homo sapiens
gggaaatacacatttgctgctcacatggatggaccatacaaattttggttttagtaaccggatgtccaccatgactccaaaaatagtgatgttcacgattggatattggggaggctccaaagggacaagatatggaacagagctcaccagaacaggctagaggagatgatcaatgagctagcagtggcgatgacagctgtaagcacgaacaggatacatggagtcggggagatacacagagccatcacgacacacaaacagcagagtggtcctttggtcctcctttgagctcttgttctgttgcatgcattggccagatctctcctg

SEQ ID NO: 673455 - DNA, 1068 bp, Homo sapiens
ggtttgaatacgcgtcgtggggttatggaggaccgtgaccaacagtcgtatgagttgtggctgcgggtgagagaacagtttgtcaggggcccggccaagaaggaggccgtctgttacgatggtgtccatgagtttcaagcggaaccgcagtgaccggttcgtacagcacccggtgctgcggcgtggttgcagtgtccagaaccgggacgatcatcctggggaccatggtacatggatagtaaacctattgatggcaagttttgcatgacgtgtggaagtgactcatccaaactccatgccagctgtcaacattcacgtatgaagtcatcggtaattactattcttctgagagaatggctgataatgcctgatgtccgttaagccgtctcctgatccttcatgtttgattaatccaagtccaatgctaggattaaatggaagaaaattgactaattaaaagatggagtgaggcgtagatatcgaagtaaggtatcgttgtaaacggagaagtataatagggacattcgatacctacagattagacataggattgctaatataggtatcttagtcagcgtattatgaccaaagaattccagaagagaaaataatccctggacatcaaaacattacccttgcaatttacaccgcatgtacgaaacaggaatgaccccttcaggttgggccgatatggggaacgtcaccaaagctggaccatcacatgggattcagtttgggtatactaagggtaggtacttattaggcccctataagttacagttccagttattgataaaaaggagcatataattcgtaagagttatcaccgtgggtggatttaggcaggaaaacaatgtgagtaagtatagaagttagcagttgcaaagcgagagtaccggaaagaaacgtatggcacctgaggcagaaattttgacgttgctgcattacccgttgagcgttgtaggaaagaggcaactaatagctataagatgtagggtattgtagggacgagcgattattggaaaagtggggcctagagtgaaaatatggagagtagaaagagaggaa

SEQ ID NO: 673456 - DNA, 347 bp, Homo sapiens
aaatacaaacaattagccgggcgaggtggcgggtgcctgtagtcccagctactcgggatgctgaggcaggagaatggtgtgaaccccagaggcggagcttgcagtgagccgagatggtgccactgcactccggcctgggcgacacagcgagactccgtcttaaaaaaaacaacaaaaggcaatcgtctaatctttgaatcagagttggcctagggttctgcttccctaaaattcaaactccttctggataagccacccacagaagtcattttaaaacatcatctggggccgggcatggtgtctcgtgcccaccatcccaacactttgggaggctgaggtgggaggat

SEQ ID NO: 673457 - DNA, 324 bp, Homo sapiens
  misc_feature (18)..(18): n is a, c, g, or t
  misc_feature (34)..(34): n is a, c, g, or t
  misc_feature (159)..(159): n is a, c, g, or t
  misc_feature (165)..(165): n is a, c, g, or t
  misc_feature (173)..(173): n is a, c, g, or t
  misc_feature (198)..(198): n is a, c, g, or t
  misc_feature (221)..(221): n is a, c, g, or t
  misc_feature (233)..(233): n is a, c, g, or t
ggactggggggacttggnggtagggggacacacncggaaaagggtttgaatgctctggcaatggcgaaaaaaaacggccgccccactgtcccctttgctgcccagcccccaggatttttgcctggagccctttgccctgtccctgctgcctgaggtggngtaaancaaagganaaaaatttgctccaggccaggagcncaaatcgttgttcaatgaatttntctccaactcgnccttggtaaacggaaatgttgggggtgaaaaaaaacaatccctattttttttttttttatttggtaaataattaaaaaaaaaaccggccca

SEQ ID NO: 673458 - DNA, 598 bp, Homo sapiens
  misc_feature (53)..(53): n is a, c, g, or t
  misc_feature (394)..(394): n is a, c, g, or t
ttttcacaaggtgggcaggcttttcacgcatttttgcgggtgagggccccgangacttccccggtgtgtgtgttggggaccaggcagtttttggagtcccagcgccaggtcccccgatcaaaagcttttgcttttggggcctccccccacgtggcctaatttgaggctttggccaaaatgggtttcaaagtggacaaggctttttaacagttggtgggggctgtccggaaaaaccaggaacaagagttccccccgagccctcccagtgcccccaggaaaaagggggggggttgcccctgggtcttcttttagcccaggcaaaaaagaagcaacccccccaagcttttgggaatagtggcctttgcacctttttggttggccctgggcccccccntgagccccaatttctttttttgggtttcccaggacacatcaaaaacccccccttattttttggccttttttggggtattgcccttgtgggccttttgccaacccctcctttccccccctaagcctggtgggggtgggggggtccgggtcttttttgtatataactcccctcccccaaaaaaataaatgttcttgcccacgtcca

SEQ ID NO: 673459 - DNA, 1170 bp, Homo sapiens
  misc_feature (976)..(976): n is a, c, g, or t
gcttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgacccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaactcaatgtgacgggctattaccgggtgaactacgacgagagaactggaggaagattcagactcaggtgctctgtcctctngaaaaaaaaaacaaaaacaaaagaaaaaaatcagaaaaaacaaaaacaaaaaaagggggggggggataattaggggggaggaaagccttttaaaagggccaaaggggtataaaaggggggggaaagaggggggaacggttttgggactttggggaagggcaaagaagggaaatgtgtggcgcttggtgctgaaa

SEQ ID NO: 673460 - DNA, 210 bp, Homo sapiens
ctcggtcccgcgtcgtctgagtctgaggaattctgaagttgcggtcccgtcttcgtgcccttatcctctgtcacgctgaggcctgagctgcctctctgcttctcagcagagcggcggcgctgtgaccactgctctcaggagagtgggggatgagaggccatgaggtgatgcaggctcagaccccggcttcaggagctcggggtggggtcg

SEQ ID NO: 673461 - DNA, 418 bp, Homo sapiens
  misc_feature (42)..(42): n is a, c, g, or t
  misc_feature (328)..(328): n is a, c, g, or t
  misc_feature (335)..(335): n is a, c, g, or t
  misc_feature (376)..(376): n is a, c, g, or t
  misc_feature (405)..(405): n is a, c, g, or t
  misc_feature (415)..(415): n is a, c, g, or t
cactcgggaaccctgaagttgcccaaatgttagactatcggnttgacagtgatggcaacacactcaccattagcaatgttagaaattttgattggcaagataaaacccattttcagccgcgctgggaaactaggcaatacgacttggcaaaactgcaaacggttgattttattgcctcttattggatgggcgatgccattgcccatacgctagtgagttttgggtttagtgatggaaagcagcttgcgttatctatcgagattcgcaaagaagtcaatgaacaatttagtacgctgggtggattttttcgcaagtttgaattggtgantatcgtnccgatgaaaaagatattatttacacccgtagtaatatccgnatgaagatgtttatattatcccatcgagngggaaggaanttg

SEQ ID NO: 673462 - DNA, 697 bp, Homo sapiens
taatattataacaacctgaaaataatggaaaagaggttttctgaatttttttttttaaataaacaccttcttaagtgcatgaaatggtttagatggtttgctgcattacaggtatttgggcaaacaataattggagggcaagtgactgcagttttgaggaatcagttttgaccttgatgattttatgtgtttccactgtggcaaaataaactgtttgtacaataagtgtaataaaaatccctttgcattctttctggaccttaaatggtagcaggaacaaggctcgtgaggccatttgtactcttttgctggttcatacgttgctaacttcctacaagctgcttcaagactgcttcatgaggaggtataatctaacaatttaaacaagtaattctcctcttggcaccgtccacttattctcatgaagcagatggttcatcatttccctggcgctgttaaaacaaaagcgaggtctaacggttagcacctcttggggacactcagcctaggttttccaactctctattagggcttgtcacgacatgggaaaacctacttaaagaaaacactccctaattatcattttcgaggcactggtccacacattattttattcagcaaacccattgcatccccagaagggccaacttgttcgcatcagctatgacttgcgaaaagaccagcgctatcgagtata

SEQ ID NO: 673463 - DNA, 935 bp, Homo sapiens
tgggttttgtctcccccccccggccatgttggttgccacagcccctcgttccggcaaacaattgttgagagtcccctctccttctggttgttgtattcaacctcttggtgggccgtcgatttgattttgatcagaggagcccgtcgtgtttcggtggtgtcgacatccaagcagctggctagtattgtgctcgcgcttgttggatataagtgtcgtcattgaacagccccgaccacaagaagcccctcggttgttgttggacacgacacgcacttttgtggatctcatcaccacaccccctggaaggtttttactcccgcgcgggccgcacgatatctgtgtctataatgattgtgcgccccgcgggaggggtgtattatttcgccgccctttctattgttattgttggccggtgccgtagagcgacaatcctattcaatctttctatcgatcgccgctcctctcacccgtctgcgtcctaacaataatactctcttctttctataagagggggatatgtccgaacgtcttgttcgctctccccccctatagaaggcatctttgtggtggacgattttttccacgctctcgtgtagtagttcgtcgcttttgtccgcccccccccgtggtacactcatctgtggggcgactatcttcttggttgatggcagccaccgctgtgttttttgtttgcgaataatcactcttgctctctttctcgggacgtctcacaattaatgtgtttccacgccccttaattgtctcctttcattaagttcttcccgccccaccacaccgggggtgtcctcctccccccccccttcacaaaattaccccttttttccccgggaccaaccccctttttttacacacccctttccccctttttttctttttccccccccccccacatatttcccgggttttttttttta

SEQ ID NO: 673464 - DNA, 427 bp, Homo sapiens
gtcaataagagagggtgcaggcgtggaggcacatgcctgtaatctcagcgtttggggaggccggctggtgcctgggaggtcaaaggtacagtgagctgtgttggtgctgctgcactccagcctgggtgatggtgagaccccgtctcaaaaaacaaaataaaataaaatatgaacctaatggaaatgggagaatggaaaactacaatatctgggctgggcgtggtagctcacgcctgtaatctcagcacttttggaggccgaggcgggcagatcacgaggtcaggagatcgagaccatcctggccaacacggtgaaaccccgtttctactaaaaacacaaaaacttagccgggtgtggtggcaggcactggtggtcccagtactcgggaggctgaggcagaagaatggccagtacaacctgccggtgg

SEQ ID NO: 673465 - DNA, 191 bp, Homo sapiens
  misc_feature (135)..(135): n is a, c, g, or t
  misc_feature (180)..(180): n is a, c, g, or t
  misc_feature (189)..(189): n is a, c, g, or t
ggcatggtggctgaagcctcgtgatcccagcatgttgggaggccgagtgggaggattgcctgagcctaggagtttaaaccagcctgggcaccatggtgagaccccatctctattatttaaaatgtttcttaaatncaaaaaacacaaacattagcaactagttggctagccataattccnccccctggntt

SEQ ID NO: 673466 - DNA, 157 bp, Homo sapiens
gacaatgtctattaactaagacgtacggtgccactatgcctcaaaagttactatggtgcttaagcatgtcttgatcttgacatatatcacctatctggtgttatttactccattgtgcccaggacctgtgcaatattcatgatgcctattgaccaag

SEQ ID NO: 673467 - DNA, 732 bp, Homo sapiens
  misc_feature (1)..(1): n is a, c, g, or t
  misc_feature (182)..(182): n is a, c, g, or t
  misc_feature (192)..(192): n is a, c, g, or t
  misc_feature (201)..(201): n is a, c, g, or t
  misc_feature (209)..(209): n is a, c, g, or t
  misc_feature (218)..(218): n is a, c, g, or t
  misc_feature (226)..(226): n is a, c, g, or t
  misc_feature (240)..(240): n is a, c, g, or t
  misc_feature (272)..(274): n is a, c, g, or t
  misc_feature (276)..(276): n is a, c, g, or t
  misc_feature (278)..(278): n is a, c, g, or t
  misc_feature (284)..(285): n is a, c, g, or t
  misc_feature (290)..(290): n is a, c, g, or t
  misc_feature (300)..(300): n is a, c, g, or t
  misc_feature (304)..(304): n is a, c, g, or t
  misc_feature (348)..(348): n is a, c, g, or t
  misc_feature (351)..(351): n is a, c, g, or t
  misc_feature (357)..(357): n is a, c, g, or t
  misc_feature (360)..(360): n is a, c, g, or t
  misc_feature (375)..(375): n is a, c, g, or t
  misc_feature (386)..(388): n is a, c, g, or t
  misc_feature (394)..(394): n is a, c, g, or t
  misc_feature (396)..(396): n is a, c, g, or t
  misc_feature (537)..(537): n is a, c, g, or t
  misc_feature (546)..(546): n is a, c, g, or t
  misc_feature (549)..(549): n is a, c, g, or t
  misc_feature (556)..(556): n is a, c, g, or t
  misc_feature (597)..(597): n is a, c, g, or t
  misc_feature (600)..(600): n is a, c, g, or t
  misc_feature (611)..(611): n is a, c, g, or t
  misc_feature (632)..(632): n is a, c, g, or t
  misc_feature (636)..(636): n is a, c, g, or t
  misc_feature (731)..(731): n is a, c, g, or t
nataaaatagatgagcgttagtttagataatcaagaggtgacagcttcaggtatcatcttcaccaagaataaatttgtagtgtttcatattcatttaaaggaatcaggaagaaaaattcatttaatttctgctgcctgcccagtcacttcaaaaattcttaagggaagctaaaataaaaatncctatagagnttatggttnctttattncagatcccnattatccngctgcctcaaaagnagtaagttcaatttggtgtcttgtgttctggnnnanancagttnngtttncagcactgcnagtnacagattttcaaatgactgtgaccaaattaatttagaagagttntantctgcnggntccattttcaaaatntgttgagctcnnnctgtananttcgtatattgccaatgagacctttgaaaaacaattcttcagtgatggtagcattcatcagtcttaaagctggcaatctgagtagtagtctggataacctgtaggtgtcatctggatatgttttggttatataatcttggnattccacanaanccttttnctgaaatttctctatctagttccatgttttctaggcttggntgntctggactaangagtcatattgacttcaggtnggcntattcgtatccatcaatgcagagtttaaccatgctgttacaaaactcctgtagtttgaagatgtgctccatcaataattttcttctttctgttgnc

SEQ ID NO: 673468 - DNA, 348 bp, Homo sapiens
  misc_feature (90)..(90): n is a, c, g, or t
  misc_feature (147)..(147): n is a, c, g, or t
  misc_feature (228)..(228): n is a, c, g, or t
  misc_feature (242)..(242): n is a, c, g, or t
  misc_feature (246)..(246): n is a, c, g, or t
  misc_feature (263)..(263): n is a, c, g, or t
  misc_feature (312)..(312): n is a, c, g, or t
  misc_feature (315)..(315): n is a, c, g, or t
  misc_feature (323)..(323): n is a, c, g, or t
ggatccggttgcagtgagccgagatagtgccactgcactccagcctgagtgacagagtgagactgcatctccaaaaaaaaaaaaaacctntggacacggaggcttctatggttggaagtgctctgtgtcaacgtcaccgggaacatnagcgctgtcttaaactccacagggaggtgacaaaggaaagccctgtgtctggaaccgtccagatcacctaaagtgatccgnccaccttggccccnaagnggccccatacatctttngcctttggttgattttaatctgtagccttgcactgtaattaaatcatanctnaaagcgtnacaaccgctagggctcttcgggggt

SEQ ID NO: 673469 - DNA, 275 bp, Homo sapiens
agcttcagtgttggaggaggggcctggtgggaggtgactggatcatgggggtgaatttcccccttgttgttctcgtgatagtgagttctcatgagatctggttgtttaaaagtgtggggccctgccccttccctttatttttttcctgcccccatgtgaaaatggacttgcttcccctttgccttcccccatgattgtaagtttcctgaggcctccccacccatgcctcctgtatagcctgcaaaattgagtcaattaaaccttgtttttttata

SEQ ID NO: 673470 - DNA, 114 bp, Homo sapiens
ctcctattgttatttccagggtcttggggaaagggtttactctgcaggcttccagcaaaaatttaacaacttcaacatgaccctctgcagcagctacatggagtgctgttctag

SEQ ID NO: 673471 - DNA, 1409 bp, Homo sapiens
  misc_feature (490)..(490): n is a, c, g, or t
gagagagccggagagtcatgtcttaccatccctgttctgcttactcacccactctgttcctttcctgcaccaactaagcatgtgccagccaggtcagagtcttggtgctgtctcccaggaagcagggacgactaggtgaaccagaacactctatggaacccttacactgatagggctgagaggcatgaagtccgagcaaggaggcccttgatgtgtcacccccagggaagaccgtagagggttcgcacaactcgtccagcccatccatcgtgccgtatgccacagatgttagcccgaacataggttggcaggcattgttggaagggcattgcgaccaagagcacgtactatgtcacatctactcatagttgagcgcattttctgtacctactggggcaagaagcaaggtgcattcctagtcggccattatccctacaactacatagttaagtagtgttaagtcgcggggtatcaggttgcgcaatagcanatcgtcagcactcctctcttctcccttacacatgcgcctactcgacgttataaccactcaaataccactagttacacaatggtattccgagtgctccacggagtactggcgtgtaacaacttagcactaaaacgaggcgagcgtcccttgggaggattccccctatcaaactcatagcgaagagggttccctttgttttcactagatccctcaggggaaggtgcctgtagtctcaaaaaacgcccgcgtcagtctgagaccaacgaatgagcacgcgaattcacccgtgcgcacacaacgagaccatgggcatccgtctggggctttgtggagcccctaattggggtagaactaacgacacgcagtcctcggcttgcattgagtctctacaacgcatatcgtggtgcccacggagccgccatatggctcccaccggcggcctttagcaaggccccccgacgggtctcttgccccaggacctagcggccctgggctgtcctttgggttcgggccagcatgcgtttgggacgtatatggccctcaccgtgccttggggctcgcactagggggccggcccagctcttggcccctacttggtggtgtgccttggcgtcgcccttcacgcgtccacccttggcgtccctgggccggtatttggatggccccctcgttacaccctgggtgcccccacccactatccttaggtcgcccccagcataccttggccgcgcagcagcgtgccctcggccggctcccatgccccttggctgctacttcgcattcgctcactgtggctctcggcctttaccggccttccggcggccccacttccatagctggcttacccctcttccccctgcgtgccccacaactccttcccgtttcacccaacaccttgcgtcagtcgccctccctcgat

SEQ ID NO: 673472 - DNA, 119 bp, Homo sapiens
ccgtgttacgccggccgtgcctccgtcctcctcgttcgctgtttcacgtgtacccgccggccgtgtactccgtctcctggtcttcgctgtttcccagtgtaaccgacggcccgtgctat

SEQ ID NO: 673473 - DNA, 405 bp, Homo sapiens
gtacttttgcacagtgggaggaaaggcgtatcttcctagcatacaagaataacctgtatcctaggaatctcgattcacatcagaatgccgactgatgatgtaatggatacgctcatgcctcgttttacacaattgtgctcatatctggtgaccgtagtctttagtcattacgcccagcctcctgaattgagacggacaagaataaacctgacttcccccacaaataaatctgcagacgtcacttattcattctcggatgttctattgctcacgatcttcgtcgagtggagagaagttaggctctcacgttaatccagttctaactcatgagtcaaactgagactgcaacaaaagaacgccccttttttcttttacaggattttccctttcccctgagtatacttc

SEQ ID NO: 673474 - DNA, 348 bp, Homo sapiens
cccttgaaatttaaatggccattccaagctatcaaattttacatgacccaggacatgtccctcccatggccagaaagcctaaattgggaaccagttgttagcaaaccctttcacccatttaaatgaaaacccccaagttgaaaatgcccagaatgtttttcatttgaaaatggcatggagacttttgtttctatttaatgttttcgagatatgccatgtgataagatggaaagcccataaccctgtgataagtttttaagaatatgagaatatacgtatatgaggtatttttagttcagtgatgcttttgtatttggggcgattttaataaaggatatggccttccca

SEQ ID NO: 673475 - DNA, 314 bp, Homo sapiens
gagagtctgtgcctgcagggtcccctcgtcaccccagaaatgccctcccccactgaaatcctctcctcctgcctcactatgcccaagctcagagtccttgagctgcaggggctggggtgggagggtcaggaggcggataagatcctgtgttaggggctgtctcactgcatgggcatctttgtggctgtgcccatatgacttttggacatggtggatgtaactacttctcctgccattgcgaccagtcctgctttttcattataggatcctcatacctctatggaccagtactattgaacagggctgtatttatt

SEQ ID NO: 673476 - DNA, 225 bp, Homo sapiens
  misc_feature (27)..(27): n is a, c, g, or t
  misc_feature (60)..(60): n is a, c, g, or t
  misc_feature (86)..(86): n is a, c, g, or t
  misc_feature (97)..(97): n is a, c, g, or t
  misc_feature (162)..(162): n is a, c, g, or t
  misc_feature (207)..(207): n is a, c, g, or t
ctgacgctggcggtggcgcggtttgtntgggcttggtgagggcggggaggcctggctgtntggatgtctgacaggtgaggcggggnacgcagaagtncagccgccctctcccacagcggagtccaaaacaggcctaccagtcagttcttatttctattgggngtttccatgctccaccatgttaagagctaagaatcagcttttttnactttcacctcattacct

SEQ ID NO: 673477 - DNA, 231 bp, Homo sapiens
cacagtgagatttgggtctgtgagtaagcagacaatctaccaagtggtctggagacatccgtgtcgttacaatggagcactctctaagttcaacgctggtggattaggagccccagttcaccaagaggacccacaacgtgtgagccctctacctgggttcgggtcaggagctccatcttgggaactaacagctgctagttcccatgattgatgctcctgagcccgaaggtg

SEQ ID NO: 673478 - DNA, 338 bp, Homo sapiens
aagggggatttgccttaaaggttccctttaatgaaggggaaacatgagaatgagttgggggggaaatttttttttgatatcccgggggtagtttgccaacctaaacttttgattgtttttgatttcaaagagggccggggggtaaaaaacatggccacaggaaagtttaaggggtatgggtttgtttcctttttccccaaatggggggggtcagtgggaaggggatgggtaatgctttaagggtaaagaatgggaaccccccgttttaattactaattttttttttgggtggggtttttttttttgatggtttaaataaacccccccttgagggttta

SEQ ID NO: 673479 - DNA, 989 bp, Homo sapiens
  misc_feature (114)..(114): n is a, c, g, or t
gggtcgccagaacacaggtgtgcgttgaagaactacccctaagaatgccaaaatgggaaaggaaaatgactgcatattgaacatatgtcggtcattggtacacgtatggattcngggtcatacatccaccattactgggccatctgagtctataaatgcggtgtgcatcgattgaaataagccattcatggcaacaaactttgaggaaggcaggactgctgccggaatgggcaatacgggctccttccaagtatggcctggggtctccggatcacagatcttgcaacatgcgtgagctgtggaacagtcggtatccacacaatctgatatcctctcctatggttgggaaatactctatgtagcaccaacgtcgggacgtaacctattgtttgacttatcccatatggaattgctcgcccagcgaataaccagcaggactattatcgaaaacagacattgcatctacgatgggtggacaatcttctaggtccttgtacatgatgcgtaggctccctagatttgtttagcctgcgtgggcgcgttaggcctgcacactcttcgcatgcttcgtctgatctccccaaaagtgaaatgggcgcgagaccccggaggagcactgcccccctctcttgggccttaccagcacctgggcgttagttgcacataccaactaaaacttcgtccggtctgtctatcgaacttacgtgggtcttgccactggaagacccaacccactaaccaggtccagccaagggagaactcactgacgcgcaaaacctctgcttaaaagcggcacgcctacaagccactgtgatcattatacacgcaacaacatttggggtaacaaagcccgttaccacccgattaggccacatagtgtcggaccaaattttacttgggatctgggcaaagtgggtcgaacaactcattgtccatgggaagtcgcctaggttgtgtgacacattgcctttggtgtccaaggggaacta

SEQ ID NO: 673480 - DNA, 240 bp, Homo sapiens
cacttcgagattcacatcgagatgcgaagccgcgaacgcggcctgcttgctgccctcgcggcgctgcgcctcgacgccgtcgaggtactcctgcgtcacgtcgccggtgacgtaattgccgctgaagcacgaatcctcgaaatgcgtcaccttcggattgaccgagcgcacgtcgtcgatcagcgcggtgaggtcctggtagatcaactggtcggcgccgatttcgcgcgcgatttcctc

SEQ ID NO: 673481 - DNA, 211 bp, Homo sapiens
atcgcaccactgtactccagcctggatgacagaatgagactctgtctcaaaaaaaaacaaaaacaaacaaacaaaaaaacagatatttctcacagttctggagactggaagtgcaagatcaaagtgttggcaaattgtgtttcttaaagagggcctgcttcctagattggaaatggccatcttctctcggtatcctcacgacaactcagct

SEQ ID NO: 673482 - DNA, 1056 bp, Homo sapiens
  misc_feature (447)..(447): n is a, c, g, or t
  misc_feature (476)..(476): n is a, c, g, or t
gaggtcactgatagcatctgcctagtagtcaaagctccgtgcttcgtcatgacagtggccttatcaccgcgagtgacgttgggtgcccactttccgaaggaaacatacttatgtgatatatctcgttatagacaaactcccgcggtaagcaaggcacgtcgagagcaatgcatcacatagtcacataggcgtggtggtgaatagacgggcagcaagtaggtggtgctcatctcttgcggaacctacactgctgttgtcgggacaaagagttttgtgaagtagctacatatgaactcgcaagatggtggaaggcagaacaggaaataggaatggatggatgaagcatcttgttgagtcatacacatcatctaagctttatgaacgtctgtgcttataaagcgaacatgccgtcatggaggatggtgcgtgcattgtctgtgtcgtagnacaatcttttctagcaagtggcactttgntccagaggatgacagaggccaacgagtgcttaagagctggttccctcggagatagcgcccgaagcctgtcgagtgtgagtccctgaagacatctggcttggactagcgaaacaagtcttatgtcacagtctccgtggtgaagaacagcagtggacgagggcgcttatggagaacctttcaaaatggacctttcgagaaaggaggttaccttttgttcttcctagggcaagtcaagggacgttttcgcccaaggacgtgtggcgggcaaaatttcggcgaatccttaactttatggacacacatcggagagaatcaagggctggtttccattcgaggaacaaccattggaggaaggtttccccctctagtaaggcagtaccggagcgattttattcggtggaataaatccttttccactacggggaggacatgatagagattgacaatctggggtactgttaaaattcctttgaaggcaaggcactaaagactgccgtgcctcggggacttcgatggggaagcgccatggggctcgtggcaagggaagcttcaaggcgtcatagatggcccatgggagctg

SEQ ID NO: 673483 - DNA, 857 bp, Homo sapiens
  misc_feature (1)..(1): n is a, c, g, or t
  misc_feature (303)..(304): n is a, c, g, or t
  misc_feature (306)..(306): n is a, c, g, or t
  misc_feature (326)..(327): n is a, c, g, or t
  misc_feature (330)..(330): n is a, c, g, or t
  misc_feature (333)..(334): n is a, c, g, or t
  misc_feature (362)..(362): n is a, c, g, or t
  misc_feature (365)..(365): n is a, c, g, or t
  misc_feature (369)..(369): n is a, c, g, or t
  misc_feature (402)..(403): n is a, c, g, or t
  misc_feature (411)..(411): n is a, c, g, or t
  misc_feature (521)..(522): n is a, c, g, or t
  misc_feature (530)..(532): n is a, c, g, or t
  misc_feature (563)..(563): n is a, c, g, or t
  misc_feature (571)..(571): n is a, c, g, or t
  misc_feature (586)..(586): n is a, c, g, or t
  misc_feature (591)..(591): n is a, c, g, or t
  misc_feature (619)..(620): n is a, c, g, or t
  misc_feature (631)..(631): n is a, c, g, or t
  misc_feature (655)..(655): n is a, c, g, or t
  misc_feature (702)..(702): n is a, c, g, or t
  misc_feature (707)..(707): n is a, c, g, or t
  misc_feature (761)..(762): n is a, c, g, or t
  misc_feature (846)..(846): n is a, c, g, or t
nacatgctaccaagaaggttctgtctttaattttttaacagaatatacagagccacacaatacgatttcaatttcaaattatgggagatcatattcaaatatgcttaggtttgacaagttgctgttacaatactgagaactttcatgaaaacggtatttaacaatttttaagataatcaaatatctttttgctacgtgggccaacgcattaatactaacttgtttaaaaatgcagtcttttagacttcaaattattataaaacaatatcaagatcatatagatatacttcctgattactcaanncncgttccattctgatggaggnnggnggnnaatgttattctcccttcgcccatttccngcnaccncttctcctttgcacttacctgtaaaagtcaaannttaaaccncaatttcctaagacataactatttctagaatacattggtgtaatcataaaagactacaagttaattatcatttttatactaacactttttaccacaacacatctttcctnnaacgcccnnncccccttgggaatttggatttcccttaacgntaacaggntctcatactttctgnttttnataaatttccactctttttccagttggnnctatcttcacngcacagtgctacatataattatancagtgagatgtacgttcagattcaccatataaccaacacagtggtancatanaaagtttttctgcaggtaaaaatgctaagaaaggccacagtggacagtgcccgnnaatgaatacagtaaattccaggtgccaccgagcttcagagaccacaaagtttcaaatatttttcagcaacggaaagaaaaaaanatgtagagaaa

SEQ ID NO: 673484 - DNA, 1119 bp, Homo sapiens
aacgaatgctgacagagcctgaacgctttctgataactcctgcctgggacaggggactaaacggaaacactaaaggtgacaagcacgatgacctccagcgggcgcgtttcatctgccccgcttgctgggcctggagactgaacggccgaccacaggctctctgccttcccttcggctgcctgcggcctgctgctgcttctctctgagccgagcctttgcaaagcagactaacaagcggcaagctcttgccaccacgctgctgcgggcctgccctctcccaggcagcgactgactgtcactctgtgcctccacactgcgccaacccaacggccacggcactgtgagaccgctgccctgcaacgcacaccgcgcactggcacggcacgcagcacacgcgcctgcacgcacgccgcacagccctgcgcaacaagcaaaacaccacaaacgcacaacccgcaaacggccacgccacgcaagctcctggccttccccacacacaccccagccaactgcgctccagcctgaaacacggaacaagcccccccccagcgggccccccaattcaaaccaagagcctctcacacgccacccacgcgcccaaaggccccctgcaagcagcacaatggccccaaagcccccctttggccaacctctcccataacgcaaccgcagggccacccgcaacaaccactatcccctacatcccctcctggacgccacttcccccccaacgactcaaacggccacccacggtccaaaaatttggaacacttgcgaccgaatgccacgttcctttcaccgttgcgcgcaacagcccaaggcgctcatggcgccgaaaacggcccccattccccggcactggcatggggcaaagacccccaaaccactacacggcaacgagggttccaccaatattccgggaccattgggcaacctcaaggcttggcaacacgcgaaacaactttccggcgcacaccacggcccccccttaacccacaaagcttttcccacacatttaccttgctactaaacagcgagctcttttacgaaccagaggccccctatcccccgtaccccctaataggcgctggcgcgtcttccccaaacagtggcccacgg

SEQ ID NO: 673485 - DNA, 438 bp, Homo sapiens
  misc_feature (7)..(7): n is a, c, g, or t
  misc_feature (168)..(168): n is a, c, g, or t
gtctgcncgtcaataatcccagctactcgggaggctgagacgggagaatcgcttgaatcccgggaggtggaggtttcagcgagctgagatcacgccattgcagtccaacctgagcgtccgagcgagactatctcagaaagtaaagacagaattaaagtgcccagcgcnaagtgtcacgcctgtaatcccagcgctttgggaggccgaggcgggcagatcacctgaagtcaggagttcgagaccagcctggccaacttggcgagacctccttaaaaatacaaaaattggctgggcgtggtggcagacacctgtaatcccagctacccaaggaggctgaggcgggagaatcgctggaacccgggaggcagaggctgcagtgagccgagatcgcgccactgcactccagcctgggtgacagagcacggaaaatgtctctga

SEQ ID NO: 673486 - DNA, 396 bp, Homo sapiens
agagcaactgacaactggccctagtgcttgtctagatattgttgcagtatctggcagagagactgatgatgatgacaggatggacattcccttggaccttgttttatgcgctggctcaggcaagagaaggagaaggggcaacctacccaaagaggctgtgccgattcttcgagattggctgaatgagcaccgatacaatgcctatccttcaaagcatgagccttgctgtgccatcagacacacctgtataagctacaggtctgtaactggttcataaacgcccgtcgcaggctcctccctgacatcctgagaaaggatggcaaagatcctcagttaacaatttcccgccgtggggccaagatatctgccgagctctgtagagtacgtgatgggctc

SEQ ID NO: 673487 - DNA, 795 bp, Homo sapiens
  misc_feature (148)..(148): n is a, c, g, or t
  misc_feature (665)..(665): n is a, c, g, or t
agcgggcgctgcctgcctctgactggtcggaagcggcacttactacgtggcggatgctgacgtgtgcaagaggactgtcccacagtgaagagtgggaggcaagtgcctgctgaccgggaggaggtcgaccttacaggagctgggtatngtagctcattctaatagccctagtctacttaggaaggcaaaagggaagcagcaagaagtggccatcagaaggcatgtggtcccgtagaacggtagaacgggtgaggaggatgcaggagatggtcctactgtgtggacgcatcggggctcagaagtccgcttgttagagatggcagtgacctgtgacaactccagtcgtggccgagaaagccttccggagtccttaggaagcgggaaggaggccccggaccaagtgcagatgaacgtacgttagccgtaagtatcacggtagctgggcttggtcgacagaagtccatggactttacattccatgtcgtatcgtgacttcctgacgctgggcaccgcgcctaggtacgctcaggcgaatagacgagtgagtgaatagttgcgtgccaagggggcagagttggcagaaggactgggcaatggtccaagccgaaccggggatttcgaagccttttgcaatgtgcctggcaaggtcgacagaacgttcctgnaacgaattgtggcgaagccacgaatgagttggaacgtgactccagacaaagtgggcatctgtcagccagaatgagcaggcatcagacggagtgaggaaggacctgggcgcggcagggctattttacctcg

SEQ ID NO: 673488 - DNA, 1537 bp, Homo sapiens
cacaggtgtcgtgaaaactacccctaatagccaaaatgggaaaggaaacgactcatatcaagcattgtcagttcattgtgacatcgtatgattctggtgcaatgtccacacactactggtcctatctggatctatgagaatgccgagtggacatcaacagaaaagtagacctattgcaaacatagttttgacgtacatggcatggcttgcatgagatgtggcaaatgggctccgttcaagttatgccttgggtcattggatacaactcgaaacgctgagacgtgaatcgatggataatctaccgaatatgactatcatccattgatggaaactttgacgagccagctaatgatacgtagtgtgagcttatttcattgagtgccccgaggacatcagatgacgttaattcactacataccactgagttacacgggaccatcttcacgggacatgacttgatgcttcgtccagtgagtatgtatagatagcgttgagtagtaatagagtggagattatagacacgctaggatatcgtcgctaatgaattggagcgagacgccagaggaagccattagcccatatcttgagtcatttactacaagcatgagggattggtgaataacaatacgtacaatatatgggtcagggcattcgctatgatgcaaaaaggctggtgactattcctacattggaagcgctatgccccgataacaagtacgagaaaatagaacgacgtactgacagggaaaacgatatgtagcaacggaaagttcacggcaacagtgtgaacacttttaacgaagaacaagtggaggctaacaacagcacccggcaacacaagatagacaaattaagaagagcacacaaataagaacaagtgatacgagaacatgcgaggaaacaaaacaaatgtacaatgagaaaagcccaaagactagcatacacaaatatgccatctgaggagacacaagagagaaacagaagaacaagagatacaccacggaagagcgacactaggaaatacgcaccaagagaaaaaccaacacagacaaagatagaaaaggcacatggaacaagaggcaatcacgaggacacacacaaacaaccagaccacagggaaacgagagccacaggaaggacactagctactccacaggaaaggcgtcattagcaaaacaagggagaggcagactgagacacaagaacaagaagaggaacgaggcatgaggaacagtgaggatgaaccaaacagcagggaagggagtgaaacaaaagagaggacaggcacagagaggaacagaacgagcaaagcacaaaagagaaagagacacaggaagcacaagcgaaacgcggacacacaggaaaaaggcagacacagaaacacgaaataaagaaggcaccaatggacacatcgtagacgaaaaaacaaagagaggaggaaaacagagaagagaaaagcagcagagaacagcaacaacgagcgaagcaaaaaacaaacaaacgagaatggacgcaagtcccgacaaagagaaacgag

SEQ ID NO: 673489 - DNA, 753 bp, Homo sapiens
aattcggcaccaaggggcacttcgattacacctgcgaaggtgctaccttgtcttcgctggacgttactgcggagccttagctagcatcgtgacaacattcattatcgcacctaagcttgaccctacacgtcatcctatcttggcatggaattgaccgctaccctagatgcgcgactgctgcctgtggccataggaagaatccccaagccatcaacgataaaatcctgtgctaaattctcttactactatcacctcttgcgccaccggtactacgtgaattttccctccgacaacctgacgtatataacgatgctcttacagatcctgctcttagacgcaaaggcccactgcagtccaaagctaagtttgaccagagtgtcaagacacgcaagatcatgtcggctcttacagaaactgcagatttacacgcttggatatcatcatcacgcgtttgtgcacaccctttatcccaacaaataccctaagaactcgatgacctggtctcctcgtgcccattacgaagcgatatttgttatggccctgcctgcaactggggaactgtcccaccatgcgcagacaagtgccctattaacccctggactgcagccccgggtctgcttgtatccccccgtaggcgcccctacggacccaaatttccccgacttgtaagtgggaaccccggatcccacccccaggagactgatgacctttaaagttttgtcccctttgagcctaatgggtgtggtttagtac

SEQ ID NO: 673490 - DNA, 381 bp, Homo sapiens
  misc_feature (273)..(274): n is a, c, g, or t
  misc_feature (277)..(277): n is a, c, g, or t
  misc_feature (292)..(292): n is a, c, g, or t
  misc_feature (295)..(295): n is a, c, g, or t
  misc_feature (301)..(301): n is a, c, g, or t
  misc_feature (307)..(307): n is a, c, g, or t
  misc_feature (313)..(313): n is a, c, g, or t
aaacaggcaccgcctgacgtcgaggtgttggtgggctcgtcaagaacaagtaagtcgtggtctccgagcatgattgaaaccagtgcagcccgccgtcgttccccacctacaggagcgcggcgtggcaatgctcgtcgtctcacacgaccgttggtttcttgacgagatctgcactgacatctgggaggtccacaacgccaccgtcgaggcttatcagggcggatactcggcctacaccttagcccgggtagaacgagcccgcgtcgccgccannaangaggccaagcgtcanaanctggcncgtaangaattngcgtggttgcgacggggagccctgcccgtagctccaaaccgcgtaccgagtcgagccaaatgttggtt

SEQ ID NO: 673491 - DNA, 612 bp, Homo sapiens
atgtcaagttatgatgattaagaattattgagttaatgcacagcagtaatcacttggcagagggaaagctaaggaaataaattattacttttctgaagaaatttgtggccatagattggggagcatatgactatatgtaatatgcattacagtttaatacactatgtttaatgcagatagattcttagtgaagcattttgtgtagatagtattcttgatacctggtttcttaaagttacgtaacgtggtatatagctaatatattgttagtgtcttttgtatgaagatatgatagaaccagtaactatcggagtagcgagcttttctataagcgtatttaagagttcatttatggtcattcgagtaagagtattgtgagtgccttgcgtgtactaggcattgttctaagtgctggaaataaagagcattgaaagagatagcatggtgtttatgagtagtagccagatatgggggtgctcagcagagagaagtaagatgatcaataaactagcagaatagtaagtgctttcctgagaggagattcaacagttgcacaggtgagtatattggtagagaatccatctgtggtaatggtggctcgaggaaggtgtg

SEQ ID NO: 673492 - DNA, 314 bp, Homo sapiens
tgacatatgcaaggcaaggcagaagattgcttgagtgcaggagttagatgactagccgtgggcaacatagtgagacccatctctaccaaagaaataaaaaaattaactgggacacggtggcacactactctcgagctatatcaaggaggttgaaacatgaaggactccttgtaagccagagaattcataggactacagtaagacatatgcattgtgcctgttgcacccaacgtcacagccatggagtgacagcagcgagacacatgtctctaaaaaaaagaaaacaaagctctagactgggccaagatgtggta

SEQ ID NO: 673493 - DNA, 793 bp, Homo sapiens
  misc_feature (685)..(686): n is a, c, g, or t
  misc_feature (689)..(689): n is a, c, g, or t
  misc_feature (704)..(704): n is a, c, g, or t
  misc_feature (707)..(707): n is a, c, g, or t
  misc_feature (713)..(713): n is a, c, g, or t
  misc_feature (719)..(719): n is a, c, g, or t
  misc_feature (725)..(725): n is a, c, g, or t
atgagcaatgattaaccgaattccgagctccggtacccccaacattggcctcgacgggtccgaagcccatgccgccgtgctcctctggcacggccaggcccatgagacccagctcagccatctcgccccaggcctccttggagtagccaccttccttgacgatgccgcgccggcgctcgaagccataggccttgtcgacccacttgcgcaccgcgtcgcgcagctgttcctgttcgtcggtgaagtcgaagtccatctcacacccccagggtcatctgagcgacgatgttgcgttgcacttcgttgctgccgccgtagatcgtcgtcttgcgcatgttgaagtaggtcgaggccaatgttggttcgaccgcgctatggccgatctttccggtggggaacgacggcgggctgcactggtttcaatcatgctcggagaccacgacttacttgttcttgacgagcccaccaaccacctcgacgtcgaggcggtggcctggttggccggccatctgcgccacctacaggagcgcggcgtggcaatgctcgtcgtctcacacgaccgttggtttcttgacgagatctgcactgacatctgggaggtccacaacgccaccgtcgaggcttatcagggcggatactcggcctacaccttagcccgggtagaacgagcccgcgtcgccgccannaangaggccaagcgtcanaanctggcncgtaangaattngcgtggttgcgacggggagccctgcccgtagctccaaaccgcgtaccgagtcgagccaaatgttggtt

SEQ ID NO: 673494 - DNA, 344 bp, Homo sapiens
  misc_feature (176)..(178): n is a, c, g, or t
cggtgtgtagcccctgttctgccggggcgggtaaggtaggcatgcgctcgttcctgatgactctgttaaggagtcccagtacagcgaaggggccagccgccaagggcggtagatagctacagccgatgttttgcgggaacttggctatcctcatccatgggtttgatcccaaccgnnnagcctttatggacgattccaacaacaagccgccgactttctggcagatgcttcacagcgtgatggcagccgccttcggggtgcagagcgggaggaatcgcgcccgcgactttacccatggcaagcccagccactttgtcatcctggtcgacgcggccgcgaattta

SEQ ID NO: 673495 - DNA, 360 bp, Homo sapiens
catcccggctaatatttgtatagaagtagagacaggtttttgccacgttggacagtctggtctcaagctcctgagctcaagtgatccacatagccttggttgaccaaatggctgggattacaggcatgagccaatatgatcagctcaaacatcttctttttaaagtgtccaggaagcatgtatagtgattatttcttatattatcccccttgatccatctcaccagatatatgttgattttataagaattttcaaactaccagcttctggctttgttgaacttggatttctgtttcactaattttctttctcctgtctttgtacttactttgttggtctttttctaagttttaaagattg

SEQ ID NO: 673496 - DNA, 794 bp, Homo sapiens
  misc_feature (686)..(687): n is a, c, g, or t
  misc_feature (690)..(690): n is a, c, g, or t
  misc_feature (705)..(705): n is a, c, g, or t
  misc_feature (708)..(708): n is a, c, g, or t
  misc_feature (714)..(714): n is a, c, g, or t
  misc_feature (720)..(720): n is a, c, g, or t
  misc_feature (726)..(726): n is a, c, g, or t
ccccacccaaacagttgggcccttccgaccgggttcccggaaaggcccaatgccccccgtgcctccctcttggcaccagggccaagggccccaatgagaacccaagctcagcccaatcctcgcccccagggcactcccttggagtagccaccttccttgacgatgccgcgccggcgctcgaagccataggccttgtcgacccacttgcgcaccgcgtcgcgcagctgttcctgttcgtcggtgaagtcgaagtccatctcacacccccagggtcatctgagcgacgatgttgcgttgcacttcgttgctgccgccgtagatcgtcgtcttgcgcatgttgaagtaggtcgaggccaatgttggttcgaccgcgctatggccgatctttccggtggggaacgacggcgggctgcactggtttcaatcatgctcggagaccacgacttacttgttcttgacgagcccaccaaccacctcgacgtcgaggcggtggcctggttggccggccatctgcgccacctacaggagcgcggcgtggcaatgctcgtcgtctcacacgaccgttggtttcttgacgagatctgcactgacatctgggaggtccacaacgccaccgtcgaggcttatcagggcggatactcggcctacaccttagcccgggtagaacgagcccgcgtcgccgccannaangaggccaagcgtcanaanctggcncgtaangaattngcgtggttgcgacggggagccctgcccgtagctccaaaccgcgtaccgagtcgagccaaatgttggtt

SEQ ID NO: 673497 - DNA, 723 bp, Homo sapiens
  misc_feature (615)..(616): n is a, c, g, or t
  misc_feature (619)..(619): n is a, c, g, or t
  misc_feature (634)..(634): n is a, c, g, or t
  misc_feature (637)..(637): n is a, c, g, or t
  misc_feature (643)..(643): n is a, c, g, or t
  misc_feature (649)..(649): n is a, c, g, or t
  misc_feature (655)..(655): n is a, c, g, or t
atgagcaatgattaaccgaattccgagctccggtacccccaacattggcctcgacgggtccgaagcccatgccgccgtgctcctctggcacggccaggcccatgagacccagctcagccatctcgccccaggcctccttggagtagccaccttccttgacgatgccgcgccggcgctcgaagccataggccttgtcgacccacttgcgcaccgcgtcgcgcagctgttcttcgttgctgccgccgtagatcgtcgtcttgcgcatgttgaagtaggtcgaggccaatgttggttcgaccgcgctatggccgatctttccggtggggaacgacggcgggctgcactggtttcaatcatgctcggagaccacgacttacttgttcttgacgagcccaccaaccacctcgacgtcgaggcggtggcctggttggccggccatctgcgccacctacaggagcgcggcgtggcaatgctcgtcgtctcacacgaccgttggtttcttgacgagatctgcactgacatctgggaggtccacaacgccaccgtcgaggcttatcagggcggatactcggcctacaccttagcccgggtagaacgagcccgcgtcgccgccannaangaggccaagcgtcanaanctggcncgtaangaattngcgtggttgcgacggggagccctgcccgtagctccaaaccgcgtaccgagtcgagccaaatgttggtt

SEQ ID NO: 673498 - DNA, 690 bp, Homo sapiens
aggttgctttgagccgagatcacttcacagcactccagcctgggaaatagagtgaaactccatctctctctctctctccctctctcacacacacacacacacacacacacacacacacacacacacacacacacaagaaaacatgtatagcctggtgcccttggctggggtcaaatagttctatatacctcaatagtctaggagaacttcattgatatccaacaggacaagtgttaaatttggttcaggacactttgttttctctttattaggttttgagatggagatttgctcttgttgcccaggctggagtgcaatggcaccatctcagctcactgcaacctccgcctcctgggttcaagtgattctcctgccttagcctcctgagtagctgggattacaggcttgtgccactcatgcccagctaattctgcatctccagtacagatggagtgtctccatgtatgacaggttggtctcgaactcctgccctcaggtgatccgcccaccttggcttcccaaagtgctgggattacaggcgcgaaccactgcacctggccctcaggataagttaattagaccaaaggaaagaggtcactttcctatggggggtcctgtggttgagaggccccaacttgcccaggatgtctaacactcgggaaggagaaccactggtctggacttcattct

SEQ ID NO: 673499 - DNA, 105 bp, Homo sapiens
gtgctgatcggtacctcaatggtgacgtggtcgcgctggactcccagcaccgtgtgaacgacgaaatggcgcgctcgcgtacgtgagtgtccgacgggacaacgg

SEQ ID NO: 673500 - DNA, 261 bp, Homo sapiens
ctgcgccaccgcatgtttcctccgtgcgacgctcatgtaggcactgaagacctcccggtgcatgcatcacacggcatagctcgcttgccccttattctcagtaccaatacgaccgtgaaagcggcggcctcccgatccttcctgaccattcttgggcttttatgcccagtagggtgtcagcaacaatgctttccactagggttaacctggccctgttggccgagccacagctgcttcatccgcggactctccgcttcctct

SEQ ID NO: 673501 - DNA, 101 bp, Homo sapiens
cctcggtacctgtatgcatgtggaaattggaagagcaaggaacacgttctgccttagtatcctgtatccagagagcacaaagataccttgcatttcagcct

SEQ ID NO: 673502 - DNA, 869 bp, Homo sapiens
  misc_feature (211)..(211): n is a, c, g, or t
ccaagaatcatctgaagcgaggtggcaggtcctaacacagttgtggatgctggataaattgaccggtgtgtgatgctccgtcgtccatccaccggttccccactaagattgatagagtgtctccccctcatcattttcctgaggaacatacttaagtatgccctgacaggagatagaactgaaagaagatttcgaattgcaagcgagttcnagttaccacctcgcgataggccaagggtccggaattggactataaccttacccgtgctgtgattccagtcggatgtcatcaatccagtttgacggagaccgggtgacgatgaatcttccgtcctggatctatagacgaccctaggtggtcccattttgcttgtactatcgtattacaccttggcatggaagagccaaagtcctacgttgtgcaacgtgtgaaaagatctttgtgggtcacccagaggaatccctcatctggtgagctcatgatgcccggcatccatccgttaccccgatccgcctctatcaaggtgaatgataccattcagattgttttcgagactggccagattactgatttcatcaagtgcgagactggttaactgtgtatggtgactgaaggtgctagacctatgaacgaatcgagtgttatcaccaacagagagaggcctgcctggatcttaatgacgtggctcacgtggatgatgcctgtggcaacagatttggctactccgactttccaaccattttgttattggaagggccaaaaaacattggattctcttcccgagaaatggtgttccggctcaccattgtgaagatagagaccatgactgggggcaccgcagccaggtgaatgggtcctcggtgagacg

SEQ ID NO: 673503 - DNA, 153 bp, Homo sapiens
ctgggcgtgatgatgtgcgcctgtagtcctgtctactagggagtctcgctcttgtcacccagactgtagtgcagtggcacgatctgggctcgatgcaacctctgcctcccaggttcaagcaattttcctgcctcggcagagacggggtttcac

SEQ ID NO: 673504 - DNA, 445 bp, Homo sapiens
tgccaatgagcaagaggatgggagaagtcaaagaagggggcgcagctcagggtctgggcaaggagatgagcaagtagggctggggtgtaagatcatgccaattgctgacattttgattccatcttctgccttctccatgtcagcttgtccttggcacaggcaggaccaagtgagatgctctgctctggtcgatgcttctggtccggtgtttcctcctcacccccgtaccctcaggttctcctccgtcagcctactgaagttgccaccattaaggatcctgtcttgcacctttaatgaccttgagctaggtgtggtggcaggctcccagctctttgggaggctgaggtgggaaaatcacttgagcccaggaattcaaggctgcagaaagctgtgatcatgccactgcactccagccttggtagcggctcaagacccccatcactta

SEQ ID NO: 673505 - DNA, 743 bp, Homo sapiens
  misc_feature (33)..(33): n is a, c, g, or t
  misc_feature (114)..(114): n is a, c, g, or t
  misc_feature (128)..(129): n is a, c, g, or t
  misc_feature (138)..(138): n is a, c, g, or t
  misc_feature (165)..(165): n is a, c, g, or t
  misc_feature (176)..(176): n is a, c, g, or t
  misc_feature (178)..(179): n is a, c, g, or t
  misc_feature (182)..(182): n is a, c, g, or t
  misc_feature (198)..(198): n is a, c, g, or t
  misc_feature (257)..(257): n is a, c, g, or t
  misc_feature (288)..(288): n is a, c, g, or t
  misc_feature (291)..(292): n is a, c, g, or t
  misc_feature (341)..(341): n is a, c, g, or t
  misc_feature (363)..(363): n is a, c, g, or t
  misc_feature (376)..(376): n is a, c, g, or t
  misc_feature (378)..(378): n is a, c, g, or t
  misc_feature (460)..(460): n is a, c, g, or t
  misc_feature (486)..(486): n is a, c, g, or t
  misc_feature (496)..(497): n is a, c, g, or t
  misc_feature (510)..(510): n is a, c, g, or t
  misc_feature (513)..(513): n is a, c, g, or t
  misc_feature (520)..(520): n is a, c, g, or t
  misc_feature (602)..(602): n is a, c, g, or t
  misc_feature (618)..(618): n is a, c, g, or t
  misc_feature (635)..(635): n is a, c, g, or t
  misc_feature (642)..(642): n is a, c, g, or t
  misc_feature (660)..(660): n is a, c, g, or t
  misc_feature (666)..(666): n is a, c, g, or t
  misc_feature (674)..(674): n is a, c, g, or t
  misc_feature (679)..(679): n is a, c, g, or t
  misc_feature (711)..(711): n is a, c, g, or t
atctgagtgacaagtacatacaaacgcattacngcgagagagacttagatggagataaaagaccacattgcaatagagggatcacacagaccagtgggatggttcttcggaganaacccactttatgnnggaaacagngtggactctggggacggcctctgcgcnggctgaggatngnnggnccagagcggtacaggnatcggcgtagtgttttagtttggagaaaacaggaagttacactcatcacatcttttgcncagatgatagaattcgaaatccccccggggntgnncatggaatgagccgctctgttatggggtgagccgtgggattaatcagcnacccctcactaggtgttggggntccaccacgcttncnccaccccccgtcatccacagcagcgggtagtatttaggttgaatattccaaatagtcaattatgacagtgaatttcaaaggngaggacttcgggtacacgtgggaacnagacgagggnngatcacgacgcangcnatccgtntgtgtaatcaaagccttctaagtcttgatatgtccttacaaagacgaaggatagagtgaatgtcaaaatttgccaaacaggngttactgaaagtctgnaggggaaagcctagttnggttttntcttagaagtgatttttnaaacgnaacacgcngatangctcgagctttctggagccgattcctaaggcnttgcaggtggtaagggggtcgagagttggctg

SEQ ID NO: 673506 - DNA, 343 bp, Homo sapiens
tgctggcaggatatagccaggagtcgagaccagcccgtgcacacagtgagacctgtctgtacaaaaacacaaaaaatcagtcggatgtggtggtgcatgcccgcagtcccagctactcaggaggctgacgtgggaggatcgcttgagctcaggagatggaggttacagtgagctgagattgtgccactgtactccaagctgggtgacagagcgagaacctgttctccaaaaagataaaaaaaatgccaaccgattattaagaggaatgccctgtgcgcatcttacccctggtcacactgaagagctactccctgtctgtgactctgatttagcctttgcacag

SEQ ID NO: 673507 - DNA, 382 bp, Homo sapiens
tggccgggcgcgatgattcatgcctgttatcccagcactttgggaggccgaggcaggcggatcacaaggtcaggagtttgagaccagcctggccaatatggtgaaaccctgtctctactaaaaatacaaaaattagcctggtgtggtgccggccacctgtagtcccagctactcaggaggctgaggcaggagaactgcttgaacccaggaggcgaagtttgcagtgagccgatatcacgccactgcactccagctgagtgacagagcaagactccgtctcataacacagtacctccttcaactcaaattgcttccccaacaacattgccaggatgttaaataaaacaatgtttggcacagtgcttcatgcgtaggactgctt

SEQ ID NO: 673508 - DNA, 714 bp, Homo sapiens
catgtccctatacttcgtgtgcttttcctttttttttttggagacggaggctcactccgtcacctaggctagagtacaggggcacgatcttggctcgctgcaacctctgcctccctgattcaagtgattctcgtgcttcagcctcccatgtagctgatattacaggcacttgccaccatacccggctaattttggtatttttagtagagatggggtttcaccatgttgcccaggctggtcttgaactcctaacctcaggtgatccgcccgcctctgccttccaaaggtgctgggacttacaggcgtgaagccactcgtgcccggctatatctttccttatacgtgttttggcttcgtaagaggttctgttgagcagtgattggcaactctggctgacgttgctggggaagctttacaaacaaaaaaggatgccccaccggagatccggattccaatggcccggattcaatgggcttggattagaattcaggcttggctatcttcaaaaacttccccagtgttgagacccccttctcgagcatttgacaagtaggtatatcaccttccggaatctcacggagatctgggccgaacctggctcttcccgttgggcttagcctccctaaccttcgccatggcacatcggcatctgcagccatactgggcccctggtacctgttgccactgtcttctcacagttcgacccttggccag

SEQ ID NO: 673509 - DNA, 126 bp, Homo sapiens
  misc_feature (9)..(9): n is a, c, g, or t
ccgatcctnttgctgttactaaatggctgtcacctaaattgctgtcgcatttagatacagccattaagtcacagccatttaggtcacagccttttaggtaacagccatttatggtaacagccattt

SEQ ID NO: 673510 - DNA, 432 bp, Homo sapiens
tgttgatagctgactctagaggatacactctcgctactgtatcctacctacgtgtttctgccaaattaaagaaaaaaaatgcaggccgagcacagtggctcacgcctgtaatcccaacacttggggaggccgaggtgggcagatcaccagaggtcaggagttcgagaccagcctggccaatatggggaaaccccgtgtctactaaaaatgcaaaaagtagccgggcgtggtgataggcacctgtaatcccagctactcgggaggctgaggctgaggaatcacttgaactcaagaggcagaggttgcagtgagccaagatcacaccactgcactccagcctgggcgacagagcaagacaccttctcaaacaaacaaacaaacaaacaaaaaaggattccttaatcatggtaaagccatggtagagtatttgat

SEQ ID NO: 673511 - DNA, 126 bp, Homo sapiens
tggtgagggtgcagagaagagtgatatgccactgaagtccagccataggtgacagagtgagagcggtgtctcaaaaagaaaaagattccttgttgcctctctttgtgctttgcttttatttttttt

SEQ ID NO: 673512 - DNA, 137 bp, Homo sapiens
caggatagacatctagaggatcccagcaccgtcctgagaatcgggggtatgctgtacgaattcataagaacagggaggttagaagtagggtctatggagacacaatatgttgtagtagagtatcaggggacgagtgc

SEQ ID NO: 673513 - DNA, 785 bp, Homo sapiens
catctgtgccgcacccgcacattttaccacctggcggcccccaacagtcacctgtcagagcactccaccctactatgaggcccatcagaagcaagacaccgaggttctcttctgctttgacacttgatgagctcaccctgctgcaccttcgtgagtttgcaccagaagaagctgatctctgtggagacggacatagtcgtggatccactaccaggaggagaacatttgaggaccggtcccccgaccgccgagggcctatcagagaaggaagacggaggagcctcatggcctcggatgagaaatgtagctcggggtcgcgctgtcacccaacgtgaaggtgaccctccgactggacagcccaaccctgccaatggtcacccgctgcctggagatgggggactgccccccaccttacctgcgcacagcaacacgctggcccagagaccccggaggagcgcgcacagctcctgcagcccacgctggagatcaacccccgggcacgcgctcatccagaagctgaatcagctgcgcgcacacacgaaacctcggcctcggctcagctagctggtggagtcagatatacgagcacgaccctgattgctgctggacttgttgacgaccctagggccctggtgggccgcttgaatgactgctttcaaggccctggagcgcacactgacagccaagggggccagaaggactgacaccccagatgacagccccccctccttgagctttatttaccttaatttaaggtatttcttaacccgaaacaaaacaaaaaa

SEQ ID NO: 673514 - DNA, 872 bp, Homo sapiens
  misc_feature (1)..(1): n is a, c, g, or t
  misc_feature (65)..(65): n is a, c, g, or t
  misc_feature (75)..(75): n is a, c, g, or t
  misc_feature (108)..(108): n is a, c, g, or t
  misc_feature (114)..(114): n is a, c, g, or t
  misc_feature (122)..(122): n is a, c, g, or t
  misc_feature (135)..(135): n is a, c, g, or t
  misc_feature (139)..(140): n is a, c, g, or t
  misc_feature (205)..(205): n is a, c, g, or t
  misc_feature (290)..(290): n is a, c, g, or t
  misc_feature (329)..(329): n is a, c, g, or t
  misc_feature (380)..(380): n is a, c, g, or t
  misc_feature (407)..(407): n is a, c, g, or t
  misc_feature (411)..(411): n is a, c, g, or t
  misc_feature (421)..(422): n is a, c, g, or t
  misc_feature (424)..(424): n is a, c, g, or t
  misc_feature (452)..(452): n is a, c, g, or t
  misc_feature (454)..(454): n is a, c, g, or t
  misc_feature (456)..(456): n is a, c, g, or t
  misc_feature (460)..(460): n is a, c, g, or t
  misc_feature (469)..(469): n is a, c, g, or t
  misc_feature (471)..(471): n is a, c, g, or t
  misc_feature (476)..(478): n is a, c, g, or t
  misc_feature (483)..(484): n is a, c, g, or t
  misc_feature (487)..(488): n is a, c, g, or t
  misc_feature (496)..(496): n is a, c, g, or t
  misc_feature (510)..(510): n is a, c, g, or t
  misc_feature (512)..(512): n is a, c, g, or t
  misc_feature (527)..(527): n is a, c, g, or t
  misc_feature (529)..(529): n is a, c, g, or t
  misc_feature (538)..(538): n is a, c, g, or t
  misc_feature (558)..(558): n is a, c, g, or t
  misc_feature (581)..(581): n is a, c, g, or t
  misc_feature (591)..(592): n is a, c, g, or t
  misc_feature (596)..(597): n is a, c, g, or t
  misc_feature (601)..(601): n is a, c, g, or t
  misc_feature (607)..(607): n is a, c, g, or t
  misc_feature (619)..(619): n is a, c, g, or t
  misc_feature (658)..(658): n is a, c, g, or t
  misc_feature (671)..(671): n is a, c, g, or t
  misc_feature (680)..(680): n is a, c, g, or t
  misc_feature (690)..(690): n is a, c, g, or t
  misc_feature (704)..(706): n is a, c, g, or t
  misc_feature (721)..(721): n is a, c, g, or t
  misc_feature (735)..(736): n is a, c, g, or t
  misc_feature (782)..(782): n is a, c, g, or t
  misc_feature (786)..(786): n is a, c, g, or t
  misc_feature (790)..(790): n is a, c, g, or t
  misc_feature (795)..(795): n is a, c, g, or t
  misc_feature (799)..(800): n is a, c, g, or t
  misc_feature (806)..(806): n is a, c, g, or t
  misc_feature (812)..(812): n is a, c, g, or t
  misc_feature (828)..(828): n is a, c, g, or t
  misc_feature (850)..(850): n is a, c, g, or t
ntcttcacatcatggtgtttgtttgtatgattaataagaagcagctttttcttgttatgcttggnggtgaacgtnttcttagcctgtgagatccgaccatcccattanctttgntgtttctnttgattaatagangagnnggggggggggtgaagaaaaggaggaacatgctaaaaaccttatgacaatcatccaaatgtgaggnaagaacaaccgattcaccaactccactttttctattttacaactttctacatctcactcttgattttggccttcctggctgaaanagcctaatgtgaaaagaaactgcactgaaaggtaaaggnggaaatggtgatgaactgggcttatgtgagaatgtctatattttcataagncagccccagaatctttctctcagttanagcntcaggcaaannangttctggttggtgggttctgcgggggtntntnccancactgggcntntagtnnnaaaannatnnttgacaanatcgtgtgtgtgtnanttccctttgcccacntncagggcacntggggaagcccacaggaggnaaagaaaatgaaatgaaatgaanaaaaagtatnnatanntaantattantttaaaaagcanaataaagagaaaagttgaagctgcaatgtgtgtttaagncagagcaaagcanatagctctnaaaaaatctnaaaataagcaaatnnncaaagatataaatgncaagagcaaaatgnncatattaatgcgcgctgcaaaggcattaatagcttagcttaaagcntagnatgntatgntatnngctagnattttnatttttagcaaagctnatgctattaattaaatatatgntagcaaattgctataaggcagc

SEQ ID NO: 673515 - DNA, 447 bp, Homo sapiens
ggcccccagtctgcccgggccggtcatgcccgtccggaacgctataaaaaaggaaaaagcccgagtcctcccttaggaaaaaaaaaatttcaaagccttcgctagtttccgtatggcccgggcccacgcccggctttttggcatacgggcaaaaaaaacccaggaagcccccgaaccggatgtttaaaaaaaaaaataaagcccccctgggggcttggaatccgtcggccgtccttctgggtccccccctggtgtgttttgtgggaaccactgggcctgggaaggggcttcccccctgtgacttccccccgcccggggatttggggctttctttaaaaaccgtcccagccctggataaagcttttccttttgtgtttaaaccccgttggttgtttgggtagtgacttatgtaaaacggtttttttgtgggggggtttccaaggctga

SEQ ID NO: 673516 - DNA, 532 bp, Homo sapiens
cggggtggctcatgtctgtaattctagcatttgggaagtcgagacgggtggatcacctgaggtcaggagttcaaaaccagcctggccaatgtggtgaaaccccatccctactaaaaatacaaaagttagctgggcttggtgatgggtgcctgtaattccagctacttggaaggatgaggcaggagaagtttatgctgcttagaagagaaggcctaagaaggatagagctcacagttgtaaaatctacagggttcatatccttgtatgatttacatttgtatcatttcccccacacacctgcgttacctcctggattctctatttcgtacagccttaacaagatctacctgtggcccaagccaaaaccctagatgatacctcttctctacccatcctctaaatacagacactaaacccaattgatattagctcttaaagacgccctgatctatttccttctttccatatgacatcattttcctcttaactgctcctttctcttgctcctctccccctctccccaggcattatt

SEQ ID NO: 673517 - DNA, 257 bp, Homo sapiens
tagtcactcagtctacatcatcatctttcaatctgcaccatcctcactcagtctacacaatcatcactcagtctatgcactgcatcactcagtctacacaatcttcactcagtctatacaccatcatcactcagtctgtatcatcgtcaactcagtctatgcaatcatcactcagtctacacaatcatcactcagtctatgcactcatcactcagtctacacaatcttcactcagtctgcatcatcatcactcagtc

SEQ ID NO: 673518 - DNA, 542 bp, Homo sapiens
ggcgctccgctccgcatccagctcggtatcatgtcccgccaggcgaaggatgacttcctgcggcactacacagatgtcggaccccaggactcaccccaatggtgctacacctgagtacaaagtaaccgcgcacgttcatctcaaagaatggacccagaggactgtcacaatgaagtgtggctgagtcatgagaacgcgagtacaagcgacattccgcaacgctgcaatggaagaccatggacctacacccaccgcaacctcttccgccgtcctcgagagagttccccggctttcctcccggggcccaggtgtttggccgcgtttgaaggccgtcagtgagtcgaggagcggcgaaagggggcagaggacctgcttcgcgttcactgtgcacatacctgcgctcaactaacagcccccagctacaacggagttcttccggggtggggaggtgacccgacccttgcgaggtgtccagggtacctacacatcctgccaccaagcatagagctacaaagaaaacgacaagataaagaaagagtaca

SEQ ID NO: 673519 - DNA, 134 bp, Homo sapiens
gaatcgagctcggtaccgacagcatcctaaccagataatctggcactgccattgggttgaagaacattgtggacagaacaaagaaggtgacggacagaaaacacaagtgctttacaaacaggcatccgtaaatg

SEQ ID NO: 673520 - DNA, 155 bp, Homo sapiens
gactagaggaccctcttgctgggacttattgcctgtcagtactgtgggtgatatttgcctttagtgcactcttctcctatcgaataaagtggttggcggtggttatcatgggtgtaggtgctacaaggtgccaacctgtatggttacatcacggt

SEQ ID NO: 673521 - DNA, 239 bp, Homo sapiens
ttcagaggatcccggagctatcggttcattgtatgtgctactttgtacagtccatactgtctggatactgtagccttatagtataatttgaagtcaggtagtgtgatgcttccagatttgttcttttggttaggattgctttggtatgcaggctcctttttggttccatatgaattttgggattgttttttctaatttctgtgaaaatctgacatttggtatttttattaggtattgca

SEQ ID NO: 673522 - DNA, 367 bp, Homo sapiens
tattagacgacccttttttttggtacactggagctgtctgtgcggcgtacttggagctgtctgtgcacactggagccatcggctgcgtcactggagctgtctgtcctgcatcacctggagcccgtccctgtgccacaccctggagcccactcctgtgccggcgacacctggagcccgtcctgtgccggcgacacctggagccgtcctgtgcacacctggagcccgtcctgtggcggcgtcacctggagcccgtcctgtgccacacctggagcccatcctccgccagcgtcacctggagcccgtcctgtgccatacctggagcccgtcctgggccttccttcacgtgtgacaagtctcgcggttaaaa

SEQ ID NO: 673523 - DNA, 223 bp, Homo sapiens
  misc_feature (22)..(22): n is a, c, g, or t
gtagtggtgtaaaaagacgggngatggtgtgggagtgggggggttgtggacacgcatgcgaactgctccggggggacgctgtgtgcattattgtactggcatgtgggtgtaccctttcctggacacattggccaggagccagaatcatcttctttgagtctaccaccatcttaatgaacttcctgtacctgctgggagaagttctgaacaactatctctggga

SEQ ID NO: 673524 - DNA, 335 bp, Homo sapiens
agtagcaccctttcgtggcggcgggcataccgagcaagaaggtaagtttctaggatctgcagcagttatccgattttgttcatcaagtaggactggatatacctgtatacgtcattcagcaacttttgccgcgactgcaaaaagcgtctattatcgaatgggatagttcacagcgcgcattcaagtgtctaggccggcagcaggtcaacgaaataatcgcgccatttataagcgaagatcttggcgatatttcggagactatcgaatctcgactgtctcaattcgcgctacgccacagcgttaacaaggtcccagcatcggactcttggggcgac

SEQ ID NO: 673525 - DNA, 407 bp, Homo sapiens
  misc_feature (9)..(9): n is a, c, g, or t
ccagacgantctctacttgaagagcttctctggctatccaaatcctgatactcctgatactattatttttttatttccatgagatgctcagtcgctcaggctgtgggtgcagtgccgcaatctcggttcagggcaacctctgcctctcgggtacaagtgattctcaggcctcaggcacccgataagctagaagtacaggtgtgcgccaccaagcccgactaatttcggtattttcagtagagacagggtttcaccatgttggccaggctggtctcaaacttctggtctcatgtgatctgcctgccttggcctcccgaagtgctgggattacaggcgtgagcaattgtacccagcctaaatcctgattcttaaagtcaccttctcctttaaaccttttttttacccag

SEQ ID NO: 673526 - DNA, 874 bp, Homo sapiens
  misc_feature (1)..(1): n is a, c, g, or t
  misc_feature (112)..(112): n is a, c, g, or t
  misc_feature (289)..(289): n is a, c, g, or t
ngtgtagagaactgctctttggcgctgtacagtggggtcctcttttatccgcccccatttgtcaaatccgcgcccggttctttttggcgcgccacacggccgtgttaaatcnggaaagatttctgcttgcaccccagtgagggatctttgttcctctgtaagcgaggccgcaccacccctctggggagtgtctttgaagcccccttgtgtccttcctcaaagggtctctcccaggggcccccacttggggtccccccacggcggtattcacgcggggccgacgacccantgggctcatcttcgtggccagcccaattctgtggccccgaggcgtgaaaaccagcgaagggcgccgtcttgtctgcgtccaaacaacccccgcgcggagacttctacaactaactgtgaggccctttgaggcccccctatgtggagttagccccattctcctggaacgatggttgtttgccacccgaagatttccggcacgcccgaggaatccccgtgcattctatggggcgccggatttaattacatcccgggaccctctgcggcgggttttctcttataacccagagtgtccaccccccgattctcatgagatcatctcccggtgaaacataacatgatcaaaccttcccctcctgtaccattatcaattgggaaacatttgtccttttccggcgccaccccccgcattttaccatctgaatctctaaaacaacaaatgaatatactcccccttgctaaaactacaatttgtcccccccaccatgtaagacacctctgttcacccctcgttcaaacacactggttttttaataaggttttgataagccgcccccaaaatctgtagttaacggcccacatacaa

SEQ ID NO: 673527 - DNA, 691 bp, Homo sapiens
aagagtggtatcaacgcagagggcccattacggcgggggctgtagtggcttcgtcttctgttcctcttccttcgctaacgcctcccggtctctcgtcagcctcccgccggtcgtctccgtttaacaccgaacaccatgccttcaattaagttgcagagttctgatggagagataacttggaagttgatgtggaaagtggccaaacaatctgtgactattaagaccatgttggaacgatcgggaatggactgatgaaggagatgatgacccagttcctctaccattaatgtgacagtgcagcatattgattagcaacgaaggtcagttcacgtggtgcacccaccagagggatgagcctcctcctcctgaagatgattgacggaacatagaagcaagcgatcagatgatatccctgtttgggaccaagaattcctgaaagttgaccaaggaacactttttgaactcattctgggtgcaaactacttagacactcacaaggtttgctgatgttagcatgcaacgactgttgccaatatgatcaagtgggaagactcctgaggagattcgcaagaccttcaatatcgaaagatgactttccctcttgtgtgtaagcaatgtctggctagtttatggccagttaactttagtgagcttttaaaatgtgggcttgtacttaaacacactttgccaa

SEQ ID NO: 673528 - DNA, 300 bp, Homo sapiens
ggtgaagcggcggtgcacgctgattcgtgatgtcgttctagagttcccctgtggcagcgtgacgccgtacagtgcttagctgcctgcgcgccaccggtcaggccggccagcagctgcgagtgaaggcaaggtgctggttttcatgactgtgtctcctgtggggcccggctaccgggttgccttcgccgcggtctctggcgtcgcgtgtcgggggcatgcgtctatctcacacctttcccgacccgggcacaacggcccatagggatgaatgggtaacaggttgcaggggatagccgcaga

SEQ ID NO: 673529 - DNA, 207 bp, Homo sapiens
gaaccgatggaaaggatgagagaaacgatgagggaaatttcggaaaagggaggagtttgggagtggggagggatggcccagcctgtaaaatactgtaaatgggctgctgtaaaaaccggaatgaattttttggacatgtttggttaattttttttggacaagatttttgtatgtttccttttcaataaaatcagattgggacagtga

SEQ ID NO: 673530 - DNA, 269 bp, Homo sapiens
tttttttttttattcatcaaatatgtttctcttttttaggccgagagcagatgtgaatagcaacacactgctggccatattctctctctgtctgtctgtctgtctgtctgtctgtctgtctgtctgtctgtctgtctgtctgtctgtctgtctgtctgtctgtctgtctgtctgtctgtctgtctgtctgtctgtctgtctgtctctctttctgtctgtctctctttctgtctgtctctctttctgtctgtctctctttctggtcgacg

SEQ ID NO: 673531 - DNA, 642 bp, Homo sapiens
  misc_feature (177)..(177): n is a, c, g, or t
gcctacgacgaacagacctaaaatcgctcatagcgtactcttcaatcaggccacatagccctcgtagtaacagccattctcatccaaaccccctgaagcttcaccggcgcagtcattctcataatcgcccacggacttacagtcctcattagctgattctgcctagcaaactcaggngctacggaacgcactgcacaggtcgcgatcatagatcctcgtctcaagggcttcaagactctactcccgacataatagctgttttgatgacttctagcaagcctcgcgtaacctcgccttaccccccactattaacctactgggagaacgtctctgtgctaggtaaccacgttgctccgtgatcaaagtatcactcgtccgtacttacaggactcgaacgatactgagtcacagcccgtatactccctctacatatttaccacaacgacagatggggctcactcacgccaccgagcattaagcaacagtaaaagccgtcgattcacacgatgaaaacaccctcatgttcagtacacctatcccccattctcctcctatccctcaagcccgacgatcgattgaccgggtttgtcctcgttaaaagaaaggatagaagaaaggaagaaaaaaaggggggggagtgaa

SEQ ID NO: 673532 - DNA, 1035 bp, Homo sapiens
tcaggcaccttctcaggtacttctactcccgaacggattgacatcacgcctgtcagtcagtcgagtgcttcctacaagctggcctctgcctatggggccaggcagctgcagggcttacttgctgcacgcctctttgccatcctcctccccgcaggaccccgtcgttccatgatgcccctggacctgtatgcctatgcacgtggccacatggggacgccctgctggaggagagcgtcgtgcctacaggttcctggcctgtgaacttacgatggcgcttgagcgcagggcgatggcctggtgccagtgtccccacagatgctgctccatctgctgctgcccgaggagcgatctgggtggtgtcgccagctgtatgctggccctactgtaaggccgtgtgacacctggagctggggtggagcgtgcctctccatgaggaggtggagggctgggtggagacagatccggttcccaatgatgctccgctgaggaggtctttgagctgcagattcgaactgtgccatgtacttggagccaagaggaccgtgtaccagaaagaagactctgtaggcctcgtgtgcaattccacaattgtgcccttccaagttgtctggccggtaacaaaggcttgaactcaacgaggataactaaagccccgggatttacacatcgaccactgaaatgcatagtaaaagacagttactggagtgcacggaaagtaaagaaacggtactatcacgatcagaaggaggggccttagggacacaaaattcatgtggattaaatgcaaagagaccatttgtgataaggaatactaaccttagcagtgctataaagaatcacaaaaacaccaaaataactatcaagaaacaaaggatcagtgaccgtggtttaaaatcccacaaataaaaagtgtggaaagaaataacgagtcaagtagaagacacatagcaattggacacacagaatggggagtaataaaaagaacagaaaaaaaatgaatagttaagacaaagagagaaaacaacaaagagaaag

SEQ ID NO: 673533 - DNA, 145 bp, Homo sapiens
  misc_feature (130)..(130): n is a, c, g, or t
tagttagagatcgtccctggtatcccacccaaggagcaacccgaatggaccctactacccgctacaggcttttctagcccagaaggtggctacccaggctactgctaaggactcgtacttcccagttagnctgtgggcagctttc

SEQ ID NO: 673534 - DNA, 348 bp, Homo sapiens
catgttctctgcgtcgatggaaatagtctatcaccgtattcattcacttgagcatgattctgcgaccacaggtctgtctgtcaggacagtgtattctcacagggaaacgatcacctttagcgtcttgagtctgaaatacacaatccagcttgtctggcaccatgaagtttcagcacgtgctcttaacggtcagtgatgtataatccctgcccaacgagctgctggatcatcccttcgcatagactgcggtgtgcatcttcatacttaacaatctcatagtgttgtgagcaaagtaagatgcacatgttgtgtgtcagatggtagctcactattgttacaccattacac

SEQ ID NO: 673535 - DNA, 364 bp, Homo sapiens
  misc_feature (62)..(62): n is a, c, g, or t
  misc_feature (92)..(92): n is a, c, g, or t
  misc_feature (173)..(173): n is a, c, g, or t
  misc_feature (300)..(300): n is a, c, g, or t
  misc_feature (316)..(316): n is a, c, g, or t
  misc_feature (325)..(325): n is a, c, g, or t
  misc_feature (343)..(343): n is a, c, g, or t
  misc_feature (345)..(345): n is a, c, g, or t
cccaaaaggcttcctttacccaagtgggtggttgaataaatcttctcagttccctggctccnaaggcccatgaagaagatgtacaaggcgtncctcaagtaccccgagtggaaacagaagcacctgcctcacttcaagccgtggctgcacccggagcagagcccgttgccgancctggcgctgtcggagctgtcggtgcagcatgcggactcactggagaacatcgacgagagcgcggtggccgagagcagagaggagcggatgggcggcgcgggcggcgagggcagcgacgacgacacnctgctcacctgagcgncgcaccgcnaaagggacggagacaggnangcggcgagccctggggcgg

SEQ ID NO: 673536 - DNA, 156 bp, Homo sapiens
gcaattcactgccaatgctctcgctttggccatggagcgggatggctcagtggggagtcatcgacctggcagccattgcagagtcaggggtagagcgacaagtacttttggagaccagtacccaattacgcgtgcacttaccacccgctgatactg

SEQ ID NO: 673537 - DNA, 340 bp, Homo sapiens
  misc_feature (52)..(52): n is a, c, g, or t
  misc_feature (212)..(212): n is a, c, g, or t
  misc_feature (296)..(296): n is a, c, g, or t
  misc_feature (311)..(311): n is a, c, g, or t
tgttggtcattagaggatcccgcacgaggggtgtccaggctggaggccccanggctctgcgctctccctgcatggtgggcctggagagagcaccagcaccacctcccactttcactggggtatgcttgcccctgtgcctcccaccccaagaagctacaaagagacaggctgtccgtgtccccaacactcctccctggtgtcctgcggactcncctgttctgagtgggctaagtgttgcctgtgggcccagagggccctctcccagtggacaacccatctctctcctctgtgtcccncttgccccccacacntgagggaatgtcttgtgtctcttgttcct

SEQ ID NO: 673538 - DNA, 238 bp, Homo sapiens
ccactctcagcctgggcataagagctactccagcctgtgcataagagctactccagcctgggcaataagagctagactctgtctcataaaaaataaaattttggcagggatcttaaaaattctggattgtgtgtggttaaggaccaaattggacttgtgctgacttttcttaaatagccctttttttgaaattccttgttcatgggttgcgggaagaagggaggtgctcatggtggag

SEQ ID NO: 673539 - DNA, 175 bp, Homo sapiens
cgtgtcctactagcttgcccggatcagcctgccatgcactgaatgtacggccagccctctagggctgtgcttgtgtctgtgggttccaagtcagtattcactgaacttaaggtaccatttatgctctccctgtttgactctcttctagtttctaacactggtgttcaatcaacat

SEQ ID NO: 673540 - DNA, 348 bp, Homo sapiens
gggggggggggaaaaagggggggggtgtgtccccccaagtgtccctcagtatcagggcccgccttagtttggaaaatttcctttctggttttgtttttgggggaaggggggttaaaacccccttacaccttagccccccctttttttttaaagcaaatgtttattgtttttaaaacggggttttttttccctaaagccatttttttttttttggtttaaagaaggtttgctagctgaagcccgttttccataaaaagatgtccgattttttttaaaggggggccgcctttttttaaacccaacccttgaccctttttaaaaaccattaaacctttttttcccccccca

SEQ ID NO: 673541 - DNA, 632 bp, Homo sapiens
aggagagagagagagagagagagagagagagagagagagagagagagagagagagagagagagagagagagtgagagagctcgttagagccacattccctgttcttcccttacgccttcatttccccctgtgcgtcttccacctctctgtgcgctctttcacgacccttactatatttgccgccgaccccattgttcctcttcatgccataagtgagtcctgctccggagacattctctacttggtctttaaccgcctgtgtgtctttcatccacattgctctttgctgtacagctctttccctatcttcccaaattttctttgctctcaggctactcgtcatatcgagcttcctagcgtcatgactacctatccttcatagcccacatttttgctctacttttacctctacttgccatatctgcactctctattttgtgctgcacattccttggcgcacttcgcgtgtctatctagtctctcggcaccttcaagcctccgcttatccattctaatgagagcgagccttctttgcttcttttttcaaccactttttctcggcttccccttcttcattcttctttttccgcgtgtgccttgatccctttggcctcctttgtcgtttcccttcg

SEQ ID NO: 673542 - DNA, 132 bp, Homo sapiens
gctgtcagatatcagagaaccatacaaacggccttctagagacgccagacgctaatctgactctaggccactgcttgccaactcttacccactgtagccaaggtcctttaacctgggttctctgcatcctct

SEQ ID NO: 673543 - DNA, 234 bp, Homo sapiens
tgatgtccagtttaaggcatgcagctgtagaccgggggggagccagtgttccagtttgagggctgtgcattctggagacccggtggagatctgatgttgcatggttgagggccgtgtgagctgtagacctgggcagggagctgatgttccagtttgagggcgatgccgctggatacctggctgggagctgatgttgcagttggagggcgctttgtaggatgagagctgcttctc

SEQ ID NO: 673544 - DNA, 123 bp, Homo sapiens
tatacttacccagtgtgcaacggaaatattgagatggctaacctccagtcttctgatccattgatttgcataagtggtgatgtacaccaaatacacaaaagctggagtataaatatttatttt

SEQ ID NO: 673545 - DNA, 203 bp, Homo sapiens
  misc_feature (77)..(77): n is a, c, g, or t
tacaaataataaaaaagccaggcatggtggtgtgcacctgtagtcccagctacttgggaggctgaggcaggagaatngctggagcccaggaagttgaggctgcattgagcacagcacttggcttgagtaacagagaccctgtcttaacaaacagaaagaaagaaataatatgcacttatttaaacgagtttgaaaaccctctc

SEQ ID NO: 673546 - DNA, 560 bp, Homo sapiens
ttcggccattatgtgtcgggcatggtggctcatacctgtaatcccagcactctgtgaggccgaggcgggaggatcacgaggtcaggagatcaagaccatcctggccaacacggtgaaaccccatctctactaaaaatataaaaattagctggccgtggtggcgcacgcctgtggtcccagctacacgggaggctgaggcacgagaatcgcttgaacccaggaggcgcagtcttcagtgagccaaggttgtgccactgcactccagcctggcgacagagtgagactctgtctcaaaaagaaaagaaaagaatgaactacttaggactaaacttaatcatggatgacatggacttggactctgctgactatattctttcagctgtgacataggccccataaattagtcgaacaacagagcacattcctccaaggactaacgactgaaagctatagctttgaagaaaccgcctgatacggcatggagtccacacgcctagcagctgctgtcctcctaacagcgccgaacggatcggctttcccagtgctccctccagtggcgg

SEQ ID NO: 673547 - DNA, 128 bp, Homo sapiens
tgtgagaaggctacgatttaaagatgtcatttcgtgtaagggcgcagactgctgcgaacagactggtgataacgcctacgcatagtgttagagtttggattagtgggctatttcccgctaagggacat

SEQ ID NO: 673548 - DNA, 103 bp, Homo sapiens
ttttggtttcggttgttcatctattaactatggctgagctcaggtgattgatactcctggagtgcgagataatacgtgcatgtgttctaggatctgggacttc

SEQ ID NO: 673549 - DNA, 179 bp, Homo sapiens
tacttttgcccccccccctaatttttaattgggttttttggaaaaacagttttggcccatgttatctttgtgggaggaaggaggccggctttggtggggctgggtaggggataggatccctcctgggttcccctgctttagaatttaacccgaaataaaaacctagttttttaggggga

SEQ ID NO: 673550 - DNA, 238 bp, Homo sapiens
  misc_feature (39)..(39): n is a, c, g, or t
gctcgacggacttttaatacagcatgaagaggcattatntctataggcgagcgtattaagaatcttcaggaaatagggacacaacggaatggcatcccaagggctggacttcggagacgtcggagccttctccacggaccttccgagctgggcccacgggttctgttttgtctttttagctggactcacacgtatggacagacacagacacggacggggtcaccgcatgggggcggag

SEQ ID NO: 673551 - DNA, 407 bp, Homo sapiens
cttggcctccactggaatacctttaaatacttttcacacctatgtggtgctcctgaaactgagtggttccccctgtgatagggcacggggtagggcacccttccaactcctccctggtgtcactctctcccttatcacctttagtttcttttctacctgtgccttaggtgtcccagtcccctatcttcggtgaatccaaaaatccatatccttttttttgccttgtattctgttttttgattttgtaagtaatacatattctttggaaaaattagaaaatagaaatagggctgggtgtggtgctcatgccataatcccagcactttgggaggccaaagtgggaggatcacttgaggtcaggagtttgagatacagcctaggcaacatagcgagaccctcatctctac

SEQ ID NO: 673552 - DNA, 871 bp, Homo sapiens
  misc_feature (87)..(87): n is a, c, g, or t
  misc_feature (101)..(101): n is a, c, g, or t
  misc_feature (121)..(121): n is a, c, g, or t
tttttttctcatttaactttttaaaggggtctcaaaattcgtggtgacaaattttgtgggctcaagttgtgttctccatttaaaaanttacgtgattttanaaaacataattaacttaaancgtgccacagccaaaaaagaaaaccaaaggtggctccacaaacacatttctcctttcctttcgtgaagggttttcacggatgcgctattggttctatctatttacacccagcctttctactaactaaaatcttaatttgggccaattggacacacaacaccatgttctggaagaccggttccttccaccactggatataacaatgtggggtgtgtggccgggttattcagcgggataaattattacatcttaacgcctttctggacgccttttcctcgggcgcaaagacttgggtgagaaccttggcccagttccccaagcacgccctttcttggtcccacctggtttatgagatgagaccaccccacacgcgagacacgtgcgtcgtgctcctcacataattcaccggacactagacacaaagcgggaccacacaggggtgagctctaacgtcgggcaagagaggctcctcaaaaaaacaccatgtggggccgtgggccaggggacaccactatctgaaccaagggggcacgccaactcgaccacagagagctctccaacgacaccagttgcgacgggggcccatgtgtgtccacgagatttatttataaccccaagaaaggggggagactccaaattctttttacccattcaaagactcaagcgcaacaactttggccctttgcacatgtgttgaagccgtgtgttggcaaaatcacaatcaccgggggggacattagccgggacccc

SEQ ID NO: 673553 - DNA, 513 bp, Homo sapiens
  misc_feature (24)..(24): n is a, c, g, or t
  misc_feature (162)..(162): n is a, c, g, or t
  misc_feature (197)..(197): n is a, c, g, or t
ggtggggggggttgttgtgggggnaataacccgccccctcccccccccccccctccgggggggggcgcgggggtttatgtgggggggggttttgttttttttccccccccagagggaggggggtggccccttccaccccccccccccttttttttttggggncccccaagggccccccccgggggggggtttttttnaccccccccccgccccccccccgggggggggggggggggtgggggggccccccttttccccccgggggggggggccttgggggttttggggggttcccccccccgttttggggccccccggggccccggggttttccccttgggggggtttttttgggggggcccccctttttttccggggggggggggttggggcccctttttttttttttgggggggggcccccccccccccccccttttgggtgtttttcccccccggggggccccccccccctttttttttttttttttcccccccggggggggggggggga

SEQ ID NO: 673554 - DNA, 179 bp, Homo sapiens
ttaacatctttcattactacaatataatatgaaaacttcatatccttggcctggcgtggtagctcatgcctgtaatcccagcacttcgggaagctgaggtgggcaggtcacttgaggtcagaaattcaagaccagcctggccaacatggtgaaatcccgtttccacaaaaaatacaaaa

SEQ ID NO: 673555 - DNA, 195 bp, Homo sapiens
gagattcggtatactcagtgaggatgggggccagtttgttgtcctgtgcatcaagataccatgccggtatttcatagctgtgccttgtgtaacatctgggactcagaagcgaaagggggctattcctagttttattgctatagccattatgattattaatgatgagtattgattggtagtattggttatggttca

SEQ ID NO: 673556 - DNA, 798 bp, Homo sapiens
gttgcttgtccggggggtttttgtgcccttacctgctggtggacccgcaatgcgccctgattcttcgcgccgggggttatccgacctgcctcgaaggtctccctccccgccggtgagcggatcccccgtccgttagcgtacaactctgtttgcgcatggagccgggcgctctctcggccagacgctgtatcttccgctccaggcggcgctctttcgcagtctgaattggacgccgcgcgctttgtccgccacgagggtctttcccctacgcactccctgcgcgcgcccccctttgcccaagccacttctttggcggccagctgttcctgaattgagacccattggcctgactagcgtgggttcctttcgaagcctcctccgcccttgtttacgacgacgttgctctgggggtcgggcgttccctcgtgtggtcgtgcgtcctccccgcccttcttctcggcgcacgctatattttctgcccgctcctccgctccgactcacgcgggcgggtctctctccccaacactaacaggggtgctcgccgccggctctgtttgtctcgcgccctgtgctcaagatgctcgcctcccgtacgacgctcgaggggggcactatcagcgccccgcccccgttgtgcaacccaatgagggccgcctgggctgtctggccccaggggaagcccccctccatttgttgagcagtcacgtatctcaccgccccatttccgcctgccagtgctcgctctcctcgccctcgcggcagctcttatacccggtggtttccctgcccaacaataac

SEQ ID NO: 673557 - DNA, 672 bp, Homo sapiens
ggcttcctctcgagaaggcgccgcgcgggctgtccggcccgcgaggcgtgcgagctcgtgcgcgccatggctcacagtaggttcccgcaagcgctcgcaggaatcgctagccggtcccgggccatggtggggtctgtagacgagaaagaatcaagatggtaggaaacgacacttcgaggtgacctgttcgggctccacgatcaccatatgtcgcggagggctcggcactggcccgtggtggcaggaggcatagaaagcaagcatgaacgtgcccggaaggagagcatgatccagctccatccgtcctcgttctcccaagtgactacctaggcttctcatctatctttccatccttgcgatgctcttctcttccatcctttgcttcacaagtgataggcctggtaatcgaagcgggtggagaccggtacagacggagcaaaagacattatggaaggaccgacagagaagccacgtagcggatcgccagtgcgtgtgccggaagggcagcgacggccagcggggggaatgcagcgttgccgacaccagtgggagggacgggggggacctggacagtccgtgaccgcagggtcgtagagacatttaagacgcctgattgccattacgagtgagggagcgtccagagatgctttgacgaaacgaagacggcgcgaa

SEQ ID NO: 673558 - DNA, 2785 bp, Homo sapiens
  misc_feature (196)..(196): n is a, c, g, or t
  misc_feature (1821)..(1821): n is a, c, g, or t
  misc_feature (2207)..(2207): n is a, c, g, or t
  misc_feature (2229)..(2229): n is a, c, g, or t
  misc_feature (2238)..(2238): n is a, c, g, or t
  misc_feature (2271)..(2271): n is a, c, g, or t
  misc_feature (2299)..(2299): n is a, c, g, or t
  misc_feature (2364)..(2364): n is a, c, g, or t
  misc_feature (2437)..(2437): n is a, c, g, or t
  misc_feature (2495)..(2495): n is a, c, g, or t
  misc_feature (2529)..(2529): n is a, c, g, or t
  misc_feature (2549)..(2549): n is a, c, g, or t
  misc_feature (2561)..(2561): n is a, c, g, or t
  misc_feature (2695)..(2695): n is a, c, g, or t
  misc_feature (2725)..(2725): n is a, c, g, or t
agagaagcatgtgactactcatatgtatctaactttcgaatatagcactattaaatgtagagatctcagtgccctaatgcactgagttatcaaatgatggtgctcgtagacaatctagaatttatatctggaagaaatgatcctccctctcatggatcagctcagtgcccagagtagcggcaaccgggcaatgtcnatcatagctggtgctctcacagcatgcatgcatgtggtaagattggggatgcaagaatatcccaccaccagcatgggcagcaagcaatcattctaccaaattcatattcataagcaacaaaacattcatatcagcacttgcccacagtcatatcgcacaaaaccagcagcatagtagggccccaaggtctcaggacatcccgcaaagagcagcaggagggatcgtatcacaggcacagcattacacgaattaggcgcaaaatcaagcacagggcttaaatacccccaacccgtccaccacaaaggcacagacacacgctcacacagcacacaccagggccctggcgaaggagcccggccacccaagaagaagctggaactcctaacaacaccgtactgtacgcaaacaagaaccccactcttacatcacggcaaactgagacaccacgcgagagacacacgagaacagcacagggcacacacgaagactacgagccaattgatcacgaaacgatcacacagcaagacggggtaaaacagcagacacaaactcctaaataacaccagacgacatggccgaggcaagaccccgaagcaagaaacaaatcccacacaagggcacccagcaggggcgaggatcacatgcatgtccacaaacatcccacacaaaactgcgacatcgaagccggggcaaaatcacgcacccatacactacgaaccgccaccaatcaggggcaaccacacggacccatggaaagcagggaaggcaaccggacaacccaccgacgaggagacgggacgtaagcaagcaaagtgaaaaacgaaaaggaaaagagaaactgctacaaagaggcacgcaggaaacagactcacaactacacactagtacgaaacaacacacacaatggcaaataacaaccacggagtccggacgactcgataagctagaagaaccaagcacaaacaccacagacgacacaacaatgagaaactagaaaacgaacaccagcaacaacacaacagacaactacaaacaaacagaagaaaaacgaacaaacgacgaaccctcgaacaacacaaaactagaagagcaacaagagaccaatcaaatgaaagaagaaaaagagacacaacagacaagaggcaacaaaagagcgcacgacacagacgaaacacacacacaagcaaagaatcacagcacaccacagacatcaacgcacaagacagagcgaacgaacggaagaacaatcagacagcagaaagaagcaacgcaaaacgacgacgcgacgacgcaaccacagacacacgacaccacacagtgactcgcgccacggcacgcacacggcgaaacactgacagacagacagcagcgagacagcagacagtacacagcagcaacgaccgaggagcataagagagagcacgagagaagacgagcacagcacgggagcgacacgaaacacgaagacggacgaccgacagcacgagcacacgagaagacgaaggacacacgcacgacaaaccgagacgaagcacgcacagcgagagcagagagacaaagacgagacgggagaacgacacgacacgaacggcacaggagagcgacgaagaaaacagccacagacnagcacaagggacgagccgagtagacagcgcaggacaccgcaagaggactacaccgaacagcacacaacgacaaagacgcgacgaagactgcagaaggagagcgagacgagaagacaatgtagcacagataactcgagagtgacgcacagacgcgatgtagaagcgacgcagcgacaagacgacagacagaacacgcgaagacgagaagcagccggacgagagcaacagctaagcacagtgcactgcgacagagatcagcagcacagaagcacgtacagcacgagaggacaggctcagcagagagaccgacgcggtacgacaacgagcagcaagacacacgcgagacgagcacagcagacacgtagactgacgcatcaagagcagangacacggaagccgacacgcagnacgcagctnagccgagcgccagcagtctaaacggacagatgngacgacagagacacgatcatgaacgagnacgtaggcgaagcacggacgaacagcagacagctgaatcacgacagacgaagacgacacagcacnaccgagacagcagacgacagcgacgcaagagccagcctgccaagaacgagcgagctctgaggactacgcagcngacgagaagccacagacagagagcagtcgacatgagatgtgaacgacagcaagcaacngcgcgtcgcacaagtaccaccagagagccgacancgcaagacgagcacacgcangacagcaagcgngccggacgagcgaacgagagcacgcacaggaacgacagcgaagagacgaataggagcggtcagacgagacgacagcacagcggaggtagcaacgagagagcacagatagcagcaagcacgagagcagcacgagnggagcagcacgaccgaagacgcagaacagnagcacatgcgctagagacgacgacacgcacgcgaacggagccagagagcagcgagaccga

SEQ ID NO: 673559 - DNA, 1068 bp, Homo sapiens
agcgggtctctgccgaccggtgcagggagggctgccttattccttgcagtacgccttgaaggcttccgggccgttgaagtttacgatcgagggcagtgctgttactcagtgtgtgccggcgctcggacggcacggtgagatagagattcgagaagacagaggctggctcccgggaggtcacgtcctcgcagaggcctttcctcctctctccactaatttgtgttctacttggttccgtcgtagacccacgacggtttccagaccgccttctatccttagatccattagaatgttggttggcttctttgtcagatgaccgggcagctcccagatgctgtccgtggaagctgcgaatcgacggatgccagggaggacctgtgctctggagttgggcagccaggatgagtctggcgagccttgcgaggtagcaagacgatggcgttgcggacaggcgtgcagtggggcttggcttcccgggtaccttgcggggggctgtgttcgtggacgccggtgcagctctggctgtgcgtgggcctgggattgggctactgtgctgagtgccacgggcagagtccgggccgcattgcgctcagcttgcacacatagctgaagcattgagtctggtgccaccaatcttatactactttatttcgtgcctgggcagcaccctggaacgctgtggcttgcgtgtgcgcttcgtgcgctccttgcgtctgaacatgaggctgtagacgttgggcttcattgctattccgtgccccctgttgggccccaaagtctcccggcgatctggactcacgaggttcatcggccccgcgggacagccaggaccttccgtggcgttgggaaaattttccttaccattgctggcaagaggttgcgcggatttggagtatccgttggctgaagaacagacttggcgcgtgttctggacattttcggcccgggccggtaggcagaactaatttttgaagccatgggtgggttggggccccttgtggtggaacacgggaaggtgttggcgggccgtggaacaccagtggggactttggagagtgggaagggagg

SEQ ID NO: 673560 - DNA, 368 bp, Homo sapiens
ctccatctcaaaaaaaaaattagctggacgtggtggcacgtgcctgtaatcctagctactcaggctgaggtgggaagatcactgaagcccaggaggttgaggctgcagtgagttcaagcgattctcctgcctcatcctcctgagtaattgggattacatgcgcctgccactgcgcccagctaattttttcgtatttttagtagagacggggtttcaccatcctggccaggctggtcttgaactcctgaccttgtgatccacccacctcagcctcccaaagtgtgaagtgacagccttgtgtgtgatctttctgccctccccaagtttgcattttccacattaaattttactttttcattaaaaaaaaa

SEQ ID NO: 673561 - DNA, 191 bp, Homo sapiens
tgactcactataggcttcagccactttcccaacaaacagcaaatctccgtcgagttgaactcgtgactgaggcaatgggggcatcccaggcaacacaggtgaaggtttgctaccgtggcagcagggcgagcgtggcaaaagcacgctctgggtgttgaagaggaggcttcacccttaaatccacaccaaca

SEQ ID NO: 673562 - DNA, 810 bp, Homo sapiens
tgtgggccgggtctgaggccttggtttctcttatacttttccactctaggccacgatgccgcagtaccagacctggaggagttcagccgtgctgccgagaaagtttacctcgctgaccctatgaaggcacgtgtggtctcaaatataggcattctgatgggaacttgttgtgttaactgtaacagatgatttagtacgacagtgtcttgctctatggctccaggctgccgttgctgtggattgatcatggctcactgcatcctcgactcctgggctcaggcggccctcttgcttcagcctcctgaaatagcagagactgcaggtgttggtgtatacaaaccagacccaagctcaagatgtaaagaagattggagaaaattccacagtcaaataatggcggattatgggtagccaaggaagcccgaagtgttacctgtggaaaatgagtgaatggtttgaaatgaagactttgtcggtgtacttagaaaagtaaatatctttggagatagagaaagtgttgggaccagaacagtactttatgtaactaagttgggctttgttaggaaagctttagaaggtcatttttttgtattattcttttttaattactttagacgtgctagggattgaaaatgtttcagttaagaaatgccttttattttacttttggaaatgggacacgaaatggaatcttgtctaagaaaatggagatataagatgttggtaacaccattaattggccctgaaaatttgttcgcattgaactgcagtatttggaagcactttttaattagtacttcttaaggaatt

SEQ ID NO: 673563 - DNA, 1230 bp, Homo sapiens
ggagatctgcgcaggggttcccttggccgatctctctcacctcatcttgcaaacctaaactcgagcctggctgttcaccggcactagcatgctctcgccatggtctcagcgatgctgacgtgcaaaagcagataaagcatatgagtggctttcattgaacaaggaagccaagtgagaaagcgaagaagaaatagatgcaaaggcagaagaagagttcaacatagagaaaggtcggctgtgtgcaaggcccaaagacgtacagattatggacatattatgagaagaaagagaaacagatggagcagcagaagaaagaggcagagttgtaccaagttggatgaatcaaggcgagactcaaagtcctcagagcaaagagatgacctgtatgacagacctagctaagatgaagcaaaacagagactcagggaaggtggtaacaagatagcaaccagggaccaagggctgcgggatggactggttctccagggtgggtaccagtagctggagccccgagtgatggtcggaggcaggaaacaagatttccctctggtagaggctgcagtgcagaaggcacattcctatgtacgaaaattgcgcacaaaaaacggatgtagatgttccacagtgacccaggagtcctcactgcctgaaagacatagctggtggagttggagactctataatggagatcggaaaaattaaagggttgccaaaaccgggaaaagccgggagcgaacacatacgcccaagacagagtgaagccggaacgtccggcgagcagtgggaggtgcaaatgagcaaccatggacgtagagagggaactaaaagccatccaggagagcggcaggacggtcgccaggccccccaggccgtgatggcgcgaagcgactggacaggtgggaacacgaaaagcgaggaaacctggtcatgcgggagagcctacccctcatacaacaggccacgccaaagagatatggctgcggacaaagtagaacaccagacgaaaaggccacgacaagggagcacatccaggacgatcggccctaagatggtgacaacacagacgggagacaaggaacacaggacgagctaataacacggagaaccaaaccacaagataataccgaaagagggcaccaggtacacgcgggacacagagaacacacagggaaggaggaacaaatgaggagcaaggggaatgcgaggaaacgacagaatcacgtaggaaaa

SEQ ID NO: 673564 - DNA, 321 bp, Homo sapiens
tccccctccctaacgtcgatcacaggcgcagcagcacggagagagggagcccactgaaaggaagcgttgaataagtaccatacagaagaactgacatctttgggttcttaacaacaaaaactcacattgaggaagcgagaaaatgaaaaagggaaagaatttaatctgaatcattggacagaaatatgtggattactaacccacccccataatgcatacaatttcatactacaatggaacaataaacaccacaaatcattgcaatgcattccaaatattagcaaccaaagatatatgaacatataacaattgaaactgctt

SEQ ID NO: 673565 - DNA, 640 bp, Homo sapiens
agcgggtttacaccgatcagtactaatccggaccgaaccgatccggattaaggggccggaggcgggtcctgggcaccagcggttcctgacccaccccggccctccgctgccgcacccgagtggcccccagccgagcgggcccccacctcctggcccggcctgggcccttctgcgcctcccttggcctttgtccagcgccaggaggccggtcccgcgcccgcgtcagggcgcctggctctagtactgctgatgcccggggatctagcggccttcgttgccccccctccacctcagtccgacctttgcgtggagcccggcgcacggctggctgctgcccgggcggggaggttgcggctgctcaggtgaggacccccggactccgtccccgggacctgtcccaggggcgcagagtcggcagccggtccagcagacgaggctcgtggctcggggcccccttcccgggagtgtagcgctggagacgagcggctggcggcaggcccgaccctaagtggaatgaacttgctataacgcgtggatcccatctgacagagctaggacattccttagacggccaaggctttactggagtcaggtgtacacgtaagtgagttcacatctgtaatcccagtctcccaaacag

SEQ ID NO: 673566 - DNA, 558 bp, Homo sapiens
  misc_feature (1)..(1): n is a, c, g, or t
  misc_feature (384)..(384): n is a, c, g, or t
  misc_feature (538)..(538): n is a, c, g, or t
ntatgttctcaatctatactaaagctggcgggtgtcatatactgacgatctctcaagtgtgtttgttctgtagcagctatgttcacagttcgtgcgtatcacgaattcgtagtacaggaaactggcatgtcagccgctataggcgggccagactctcattagctggagtctgtctcgctgttcaccgctctgtactgttctccagaagtttaatgacctcacggcagctgttgccttattgagtgtttaagtttttgcagtagtgttgttttggcagtaccgctgtccaagtaagtgtttcaaagtagcagtcacttcgtaagaattggtaatgccacttctttaacccagaagggattcgatagtttgttggtgatgccttanaggtagcaagttgcaaggcgaaagtgttcaagctttttgggtaaagtgtagtagcattctggcagtatttaaggttggttcatgatagtggtctcagttggctttccgcatatctttgcttgtgtcgctcgtgctcctgttgtaacaggtaaantatcacttggttcattctgt

SEQ ID NO: 673567 - DNA, 625 bp, Homo sapiens
  misc_feature (17)..(17): n is a, c, g, or t
  misc_feature (101)..(102): n is a, c, g, or t
  misc_feature (104)..(105): n is a, c, g, or t
  misc_feature (118)..(119): n is a, c, g, or t
  misc_feature (123)..(123): n is a, c, g, or t
  misc_feature (158)..(158): n is a, c, g, or t
  misc_feature (165)..(165): n is a, c, g, or t
  misc_feature (179)..(179): n is a, c, g, or t
  misc_feature (239)..(239): n is a, c, g, or t
  misc_feature (421)..(422): n is a, c, g, or t
  misc_feature (425)..(427): n is a, c, g, or t
  misc_feature (431)..(431): n is a, c, g, or t
  misc_feature (433)..(433): n is a, c, g, or t
  misc_feature (436)..(437): n is a, c, g, or t
  misc_feature (450)..(451): n is a, c, g, or t
  misc_feature (455)..(455): n is a, c, g, or t
  misc_feature (464)..(464): n is a, c, g, or t
  misc_feature (474)..(474): n is a, c, g, or t
  misc_feature (476)..(476): n is a, c, g, or t
  misc_feature (482)..(482): n is a, c, g, or t
  misc_feature (516)..(516): n is a, c, g, or t
  misc_feature (522)..(522): n is a, c, g, or t
  misc_feature (527)..(527): n is a, c, g, or t
  misc_feature (531)..(531): n is a, c, g, or t
  misc_feature (533)..(534): n is a, c, g, or t
  misc_feature (552)..(552): n is a, c, g, or t
  misc_feature (562)..(563): n is a, c, g, or t
  misc_feature (588)..(588): n is a, c, g, or t
cccagggcgaagctganagctgggcagagctccagggaggcggccacacgggaggctggagctcttgccctgggaggcaggctggttccctctctcacccnnannccactggacccannactnaggctgaggccatgagtaatggatggaaccatccncccaccnctcccccacaacancccctccaccaccctccccaccactccctccaactttctcttcattttcccatccacaancacaaaaaaacaaaaacccactcacacccacccacacacaaccaacccacacctccccaccacacacacacacaccatctctatccccaaccaacacccacccacactatctctcaccctcacaactccacacacaaaaccccacccaccaaccacaccaatcacactcacacatcccacgnncannnccangncannaaacccacccccnnacanaggagcgtntcacagatananacaaanattcctggagagagacacacacaccgactcaggnggaaangaggngagngnnagggtgccccgggggagngggggggggnncaaggacagggaggaggcctggggnccctgggctgctgccgcccgcctggaccccgtgggct

SEQ ID NO: 673568 - DNA, 504 bp, Homo sapiens
  misc_feature (399)..(399): n is a, c, g, or t
ggtcaggtgagcgggcgcgtcccgcgacggcgctgacttcccgaggcggttcacgtaaagacagcgagatcctgagggccagcctgggacaggaggctgtggatatggcagctggctgtctgccaaggtcctggggccacgctgcacgcttgccctagctgctgtccttgggggactactgtgtggtgactgcgcccctgctgcctgcggctccggggacgccgtagagccgcggcgctgcgcgcattggcccatggctctcgctgcccctgcgcttcacgcctacctggctcgctccgtcagtgggccgggctgatttgttccaggtgttggcccaaggggaggcccatggggcccccaatcggaaccaccaccgcgggaacccttggggacaggacnggcgccgagccacgttgaacacaggaagcgcaagttgcacccggtgcaacaaccccgggaggcatggattccagttacaggactacgaccacagtaccgtgaacg

SEQ ID NO: 673569 - DNA, 137 bp, Homo sapiens
ctgaatctaggtatgcactggttattgtacacagtgccaccgccctttacagaacatactactctggtccaggggagctttcaaccaggcaaatgcacttggccaggtttctgcggatgctttttggactcgctgtg

SEQ ID NO: 673570 - DNA, 801 bp, Homo sapiens
taaggcccatttgattttttggttttccaataagggaaatagtgggtattaggattaggattgttgtgaagtatagtccggatgctacttgtccaatgatgtgtcaaaagggtagctttactgggttgccctcccgattcaggttaaaatgaggagtgtctagcggctaggagtcaataaagtgatgggtcttagtgggcgaaattattatgctttgtgcgttttgggatattatggaggatggggatatattgctcaggatagagagatagcgatagtcaatagggcaaggaccgcctaccttatttttggttagggacggactccggacaatttttgtgtagcgcaaataggaaattatcatccgggctatgatagtagggagaaggggttgttaaacgggtgttcggctaagggtatacatctagtctgggggtcgccataggaggtctggtgagaaatagtggtatcaatgtcatctaaggacagagcattgaagagaatgtaagccgagggcgtctttgaatggtcgtacctacgggtgcggaaggtagattttaaatccgagaatgggagcgggtcgatcccctcaagggggtttgttcagacccccgtattgcgtccacaaaatacgggacgtggtggactcgcctgactaagggcttgccacaaatatggaagcgcacagatagaattgcaactggtaacaacatccgtctgaaagggtcggacctcgtccaaaggagataggccccctcaaaattcttggaccacggttgcccccctttgatgtatcgcgga

SEQ ID NO: 673571 - DNA, 819 bp, Homo sapiens
tccgaggatgtagtctagatccgaagaagctagacgatcttccttcactgataggtaaagaaagcctgcccaatttctctggttagacaaggcgtttcattgtttccgtaatcggcaagcctgtccttggttgcaataaggtaggccccgtccatggtaatacctgttggttccccccaacctgtattcagggtacaatggccgtgtgagcaattgtctagagcaagagtgtaagagtcttgtgggttggaagagttgcagaaaggagaactaagtggaatatgtgcaaggctttctaagaagaatgggaatgttgggaatataacaaccatggcttatgactaaagtaaatctaaaggagagacagtggtatagtagtaagtaaggaaggtcatacgctttggagatggagtaatgagaatcttgtagaaatatggtgcagactcccgagtgaaggatgataacagcttcctcatactacaatctccacaagaacccaagtctcttgaattggtcgagttttgtacgacaacagcctttgtctgaagaattgcactacctcagtatcagacatcccaggacgtggaactctgggagggagaagtggtcaaagagctgtctgtggaagaacagataaagagaaatcggtattatgatgaggatgaggatgaagcgtgacaatattgcaatgatgctgggccgtaaattcatgttagtgttagcgagccagctgccggtttgtcaaaatgtgactgcacctaagaatgtatcccagcacgagatgtacttacttagtaccacttgtaagatccttaaccc

SEQ ID NO: 673572 - DNA, 322 bp, Homo sapiens
ttctgcaaggacgtagaaagacacatacatctaattttaacgtctctctctctctcttttttaacataaaatactgaaattaactttatatgcaaggtgtgagaccatgattcaattctatcattttatattctcaaatcattacccagtatattaatagcataaatggcagaatccctcttgttacgtgaattaaaaacgttaccctgttactagataaaattacactcaatttctgtgcccatttcaattgaaatgggcacagaaatttcccatgtatttcccccaaagaggcacagactccctcatcatcagcatcccc

SEQ ID NO: 673573 - DNA, 115 bp, Homo sapiens
acgctgcagttatcctttgagacaccaaaaaaagttgcttccctatggttacattgttaattccataatcgcatttacaatatcattactgttgttcttctctgctggatacctt

SEQ ID NO: 673574 - DNA, 140 bp, Homo sapiens
ttcgattggcgggcaacttatttgggaaggttaaatgagtccatatttatacagtacctaggaggttatgtcctgcagagattgacgtgggtcgtcgaggtgcagcaccctgttgctttctatcacagatggggatagca

SEQ ID NO: 673575 - DNA, 538 bp, Homo sapiens
ttatgctaaggtagacgatatgtctggtcggaatagtagtataaagatcacactcgtacatgagtcctcaccaagcagtgccataggaagagtggtacgtaggtaatcagtaagggcatcatgcctaaacacatagaggatgccagaagcaaactccctcgagactacaatctagtgccgtagttgccatgggtacctcgtttgcacggcgtgcgaattcagaagatggggctagaacgtacgatgttctccattgctgcccattgcaggtgatggctcgagcactacagtttacaatctcgcttataacactaacttctactagttccactgctcaatacggatcctaatagatcaatgatataagtctgcgaatgtacccgtgtgctgttcctagagagacatgctggttagcattggaagtcaaactagcaaagtctatcgctaaaggacttgactacaattcgtcaatcggtggcactcctatcaattttctataagctcagatattcacacataaacgaccgtatcctagcct

SEQ ID NO: 673576 - DNA, 667 bp, Homo sapiens
gcccacctccacctcccaaagtagtgggatgataggcgtttccttctctttcctcctttctttacttttctttttctttttctcctatctcttcttctccttcttccctcctcttgtcttccttctttcctctcttctccttttctctctcctcttctcttctttctttcacttctcttcttccttctcccctcttttttctcttcttcctcttctatctctctctcttatttctctctctatcttcttctttctttttctatcctctctcttcttctctcttcctctttccttcttcttttttctttctttcccttttcttttctcttatctcttctcctctttctctttttccttttttttatccttcttccccctttttctcccttttcccccctctttttccctctctttttctcttctcttcccttcttttcttctcccctcattcctgcctccttctcacttcccccttcctcctctctttcctctctcttcctctcttctcttccccttctcctccctctcttccttttctctcttctctttctctcttttcttttcttctctctttttcctctctttttctcttcctttcaccttctttccttctttcttctttctttttccatctcttctcctctttcctcttctcttccttttaccg

SEQ ID NO: 673577 - DNA, 141 bp, Homo sapiens
ggatcacttaggggtttcctggtttggtggatattataaattatgctgccataaatgttcttgtgcatgtcatttagtatgcatgggcatacatttctaatgggtatataaatagaaatggaatggctgctgtacagatca

SEQ ID NO: 673578 - DNA, 502 bp, Homo sapiens
cacgagggggctctcctcggtgaatcgacgatcagcgtcacgacacttggcgcgccattcattcgcggcctatctggacagtttgcgattggccagttcggcgggcgcaatgtcgttcttgagtggcaggaggcacagcagaacttcgtccttcgtggagccaccccagccgctactccaacgccacgcgcaaccacgacgccgactgctaggccaacctcgacgcggacgccgaggcctgcaccgactcctcgtccctgttgccgtgtgtgcaccaccggaaaggcgtgcggcaactcctgcatctcgcgaagcgacacatgccgcgtaggccccggatgcgcgtgcaacgggtcgacgtttgcggaggcctttccagcgcagggcggcccgctggccgaccttgcgccaagaacgcagcctccctgggagtaaagggagtgtcgctaatttttccttaccacggcctgcgctcagcgagaccacgacccgaggaacgagc

SEQ ID NO: 673579 - DNA, 146 bp, Homo sapiens
ggggggggggggtttttccttttttttgtgggggggaaaaagccctttttttgtttgggttttaaggataaaaagggcccccaccgggttgttattattccgggattttgttttttttatttttaattggttaattttggccctta

SEQ ID NO: 673580 - DNA, 955 bp, Homo sapiens
ggggatgtagtgtttctgttcaccttcgtttactatgcctgtgtcttcgttccaccacgctggggtcgtgtggatgcgaatggatcacgtagcacgaggatgacgtcgtctacccagtggcctgcaggacgctgcctagatagtcccagtcatgctcgtcttatgcacttaccactcctgccaatgtaggtgactgtccatcttcgtgccagagtcttctctccagggtgtcccgaggcgtattaccgtgtgtcctcggctttgtctcagtcatggagtgagtggtcttacagcactctttgtctgtgccctttcctgattcacctcacagcatctagtctattccagtggtaagcgctaggtccagcttcacgcgtcgcggattgacaacgttagtcgagaagcacgatgtcgcggattttcatcgcgttgatgcagttgagcgcttctggataaaccgcgtgggaacccaagggtggggttcctttgccatcaaattgggtttggctttaccctgccccattggcccattttggttaagacaatcggaaccttgccacctttgccctacaacaatttgccctttgtggcaccgttgcttccaggggcgttaaaaggaagccaaagcgtgctccctttgtggcaaaatcacctgtctgtgtggcacttttggtgccacccggcatagaaaaaaagaaccctttggacccctttggcctagaatatcgtggccttgtggcccctttgacgccgcgaatcccatctcaagggggttttacccacctgggtttagtaaacggaacgttccagaacatggggaccccaactgtggcccctttgacaaaagtgtagaatggaccccctatttaaagtgcctttgttggccttccagggtgaaccttcccatacgaaaaggcccttacctttggcggttccaaggtgggtgtcgccaagg

SEQ ID NO: 673581 - DNA, 143 bp, Homo sapiens
tcgactctacacggatccccccctcgaaacccagtactgactttgtgcaacctagcggcctggctccactgatccccactcatcgccctccgcgtcgtgtccaactctgttatcggtaagccaccgggtagcccgtactgccc

SEQ ID NO: 673582 - DNA, 154 bp, Homo sapiens
tggtagactcccacctaggccagctccccatttccaaacaggagctagcctagggtgccaggagagcccgagaactgggggagtagcaggccgaaggagaatacgagcgaggaagcagatcataggagaaggaggccaggctaagccggaatac

SEQ ID NO: 673583 - DNA, 544 bp, Homo sapiens
  misc_feature (3)..(3): n is a, c, g, or t
  misc_feature (6)..(6): n is a, c, g, or t
  misc_feature (9)..(9): n is a, c, g, or t
  misc_feature (13)..(13): n is a, c, g, or t
  misc_feature (35)..(35): n is a, c, g, or t
  misc_feature (47)..(47): n is a, c, g, or t
  misc_feature (91)..(91): n is a, c, g, or t
  misc_feature (117)..(118): n is a, c, g, or t
  misc_feature (120)..(120): n is a, c, g, or t
  misc_feature (131)..(131): n is a, c, g, or t
  misc_feature (134)..(134): n is a, c, g, or t
  misc_feature (145)..(145): n is a, c, g, or t
  misc_feature (157)..(157): n is a, c, g, or t
  misc_feature (191)..(191): n is a, c, g, or t
  misc_feature (231)..(231): n is a, c, g, or t
  misc_feature (250)..(250): n is a, c, g, or t
  misc_feature (261)..(261): n is a, c, g, or t
  misc_feature (282)..(282): n is a, c, g, or t
  misc_feature (318)..(319): n is a, c, g, or t
  misc_feature (328)..(328): n is a, c, g, or t
  misc_feature (330)..(331): n is a, c, g, or t
  misc_feature (335)..(335): n is a, c, g, or t
  misc_feature (349)..(349): n is a, c, g, or t
  misc_feature (355)..(355): n is a, c, g, or t
  misc_feature (362)..(362): n is a, c, g, or t
  misc_feature (368)..(368): n is a, c, g, or t
  misc_feature (422)..(422): n is a, c, g, or t
  misc_feature (462)..(462): n is a, c, g, or t
  misc_feature (476)..(477): n is a, c, g, or t
  misc_feature (479)..(479): n is a, c, g, or t
  misc_feature (515)..(515): n is a, c, g, or t
cancancantcanagcgctcggcgttcaggaaaangagcagcagcgnaggcggctgcttcagcggcgggcgggcgccaaaaaagccccgancgaaaaacctgggaaggccgccgaannanccccggagganganccaatccgaanccaaagcgccancgccgcaaaaacggaaaaagagcaacaatcgccnccaaggcccaatcgccggtggctgtccaaatgcctgggangcaaaaaaaaaaaactganccaaaaaaaangttcaaaaaaaaaaaacgcantgggaaaagctcatttggggaaattttcaaaaaaannaaaaaacgnanncaanaaatcgttgctaanaaaaanaaaaaanttgaanaaaccgaaaaaaaaaaaaaaaaaaatcaacaaaaaaaaaatgtcttaaatcaangtgaaaactcaaatgtaaaaaaaaaaaatgggtcaaaatnaaaagggtctaaannanggaaaaaaaagaaaaacctgggcggtggttcaacantggatcttcttcgagctggtccaattgat

SEQ ID NO: 673584 - DNA, 502 bp, Homo sapiens
gctgcgccgcacggtgtccctccgccgtcgaggcgcggcttcttttcgtatccttccaccgtgcccgggcggggtccaggcggctcaccgggggcggcgacgcggcggcggtgcgggcggcagggcagcggggcgatgaggtgaggacgcccgggaaccggaggcggcaccgcgcggcgcacggacctgggacgcggagtcctgaagccggcggacggttttcgtacgggcggccgtgcgcgaggcgaggagagaacattgaaagtattctctaagctatttgaagagcagtgcactaaatgcgacctgggggtccaaggctgggtcctagttagcgcgttcattgcacacggtgggggcataggcgcgccaagcaaaattccccacacgaacacgaattggggttggggttggcaccctttggcggcccagggacgcaccaatgcgtaagcgcccacagcttcgttcctcacttgcaccatccagccagagatccacgccg

SEQ ID NO: 673585 - DNA, 142 bp, Homo sapiens
cagttgtcacgtggccgttgtcagtgtacattagtgcgatgagtaggggaagggcgcctactagggtgtagaataggaagtatgtgcctgcgtacaggcgtactgggctggttgcctcactcgggtgatgatagccaaggtg

SEQ ID NO: 673586 - DNA, 132 bp, Homo sapiens
gtaaaacgggaacagaaccactcgacctaggtcccccatctgtttgtaaaccttcctgaagggacagggaacctcccaggcagttaaatataattctctatatttctagtaaagttttcgatatgtttctga

SEQ ID NO: 673587 - DNA, 123 bp, Homo sapiens
cgccttgtccctgagacactctttccagcccttccttcattggtttaggattctgctcgcatccatgagacagctcacatagcatcatgaagtgtgacattgatatccgcaagacctcgtatg

SEQ ID NO: 673588 - DNA, 118 bp, Homo sapiens
cagcagcagcaacagcagcagcagcattccctactgtctgcaccaggccctgcccaggccgtgtctttctcaggcgggctcccttcccgagagcccactgcaggtataatcctgttcc

SEQ ID NO: 673589 - DNA, 190 bp, Homo sapiens
gtcgttagcacctgacaagagcaacgttttccctggaatcacaaatggccaacaatgaatgaacagctctctgactgctccttctgctccagattaactatccagaagactagctgtcagaagcaccgcaaggaaccgccaccattactgacaccagcgttggttccgtctgctgcagttcctgccgcaa

SEQ ID NO: 673590 - DNA, 814 bp, Homo sapiens
caaaatggcgtcagttgtaccagtgacaggacaagaaacttctggaggtcaaactggggatagctgccaagctgggatcttgatgcgggacttcaggtcctaagtggcatttcacggagcgtttcacaaagaggtcactaccgggtactacaacaatgtacattcaatggtgcacgcaaggggagcatctcagggaattaccatgggtgcttgggcattgctaccgatggccctttaagcataactccttatacccatacagagcattctacaatgccacggagccgggattccagacaatatttacccagtttggaacgcagtgaccacaacttcttgcaagctctccttcaaatcctcacagtgaaccctattgggccctgaatggcccaattccgcgtagaagtgagaaccatctaatttcgttcaaaattccggtatacgcctcggaggctctcccatgttccacataaattcccgtaacgctaacgggccccatctcacacccatatcccaaaagatttacacgcacctctctttgcacccttggagtaacccgtgtttgacatatcacagacacatcctcatcgtagacagaacaaacaatcaccaccactttacttcatatcatagctctacactcggtgctcgcccctgaggcggaagtaggttgtgtgagcggggtgcccactgacaagaagaagaaaggaaggagcgccttatagtgtcagaagaaagagacagccacactatctgcaggtgcgatgtgagcggagctgctagcgtgtgagggtctcaccccaaagcattaggt

SEQ ID NO: 673591 - DNA, 333 bp, Homo sapiens
ttttttttttttaaaaaccgccaaaaacaaaaaggctatcccgccttttgtccggccgccgcccataaaactgaaaatcgccgggggcccccccctttttaccgggactgagggataatccccaatttaattgttttttttttggccaaactaagcttttcccccccccccggggcgggaaaactttggttttatttttttttttcccccccccttcccttcgggtggggccccccccaggccccccccctttaagggttcccccccgggggccaaccaaaaattttgggggcttggaaaaaaaaaaaaaaaaaaagttttttttttggccca

SEQ ID NO: 673592 - DNA, 501 bp, Homo sapiens
ggatccttacactgggtcgagttcgaacctggcaggtgactgtcaacaactcctccttttctcggagactgaggggaatccctgcttcttggacatctagtagggaataacctgcttgtagggacagactatggttcgctttaaaagctttgatctttcccgcacgagagagcccagcacactgtagctgcaggagcctggtggagctggtccctgtggtgtggggcatcgcttctctgcgggtgcaacagcagggggagcaccatcagcatcctccccagcaaggtttacaaacagccctgattccaaaatctgcttctacgacgttgaaacatgggcacaggtgaccgtctattgacttcaagacctgggacacaattgatcgggagagaagacgctttcctttaatgagccagagactaataaagagccccctctttgtgggatgagggactgaacaaattatgttcccgtgaaccacttctgggcccgagcgagccc

SEQ ID NO: 673593 - DNA, 456 bp, Homo sapiens
  misc_feature (101)..(101): n is a, c, g, or t
  misc_feature (118)..(119): n is a, c, g, or t
  misc_feature (139)..(139): n is a, c, g, or t
  misc_feature (144)..(144): n is a, c, g, or t
  misc_feature (250)..(250): n is a, c, g, or t
  misc_feature (270)..(270): n is a, c, g, or t
  misc_feature (280)..(280): n is a, c, g, or t
  misc_feature (429)..(429): n is a, c, g, or t
  misc_feature (442)..(442): n is a, c, g, or t
ttccctttgccgatttctctcacctcacctttcaaacctaaactcgagcccactgcccaccggcctagcattgctctcgccaatggctcctcagcgatgcngaccgtgcaaaagcagnnaaagccatatgatcggcttncattnaacaagaagccaatgagaaagcagaagaaatagatgccaaggcagaagaagagttcaacatagagaaaggtcggcttgtgcccacccaaaagcctaaacgattatnccaatattatgagaagaaangacgaaacangattgagcagcagaagaaaattcagatgtccaatttgatgaatcaagcgagactcaaagtcctcagagcaagagattgacctttatcacagaccttacttaaattgaaggcaaaacagagacttcagcaagggtggttaaaagattacnaccagggttaccnagttgctggttggt

SEQ ID NO: 673594 - DNA, 649 bp, Homo sapiens
ggcacactatctctactatcactgttgataaaatagcccacagagaacaagtacaggtcaaagtagactttgtgaaaaatgtattgaattgaactgattggaattcagccggcagtgggtggctcaaggggaggctggagaagaagccaaatgggaagaaggggaggtcacattgctgctggagagtggatcacttggcagtgagggaacagacagtcaaaatataagaaataggaacagctcaggagagcattcagcttccatgtggtgaaggaacaaatcatccttacatatcttagcagcttggaggctgttttacagtagagcatgatagctaatgtttaaattatgctcagtctactgtgaattattaagggaactctaaattatgctcaaggtatggtgttagaagagaaggaaaatttacaatatggcttagaaaactttccattagaaggagtaaggtaacaaatctatactgtatttatttaagccttaattatctagattaccactactaaaaaaacttccctaaaaattcctttgcaaaagtgccagatgacttcacgtacacctttagcttcctgacatgcactggaacagcaagttcctcatctttcagtggcaccgaccaagacgactcacctat

SEQ ID NO: 673595 - DNA, 324 bp, Homo sapiens
  misc_feature (34)..(34): n is a, c, g, or t
  misc_feature (124)..(124): n is a, c, g, or t
  misc_feature (181)..(181): n is a, c, g, or t
  misc_feature (208)..(208): n is a, c, g, or t
  misc_feature (223)..(223): n is a, c, g, or t
  misc_feature (228)..(228): n is a, c, g, or t
  misc_feature (261)..(261): n is a, c, g, or t
cctgtggaaagtttcactgtgtcgcccaggctgncgttcagtggtgcaatctcagctcactgcaaactctgtctcctgggctcaagtgattctcgtgcctcagcctcccgaatagctggaattncgggcatgcaccaccacacctggctaatttttgtatttttaatagagatggggttcnccatattggccaggctgatctctaacncctggcctcaagtgntctanctgcctccctcagcctcccaaagtctgggattncagacaagtcatcgtacccggccttcttttttgccctttaaagtaagggatgtgggtttgtac

SEQ ID NO: 673596 - DNA, 1748 bp, Homo sapiens
ggtacacgtcggttgcctaacaaccggccagcggactcctttggctcatggcctccaactttcaagaaggcacacaccatggccatcaagttctcagcgacaaaagacatgagccctaagcctgcagcttcactgaagcagccaccaagcaggagcatccgggcacagctttgtgatctttttcgcattgcggatgggcacactggcacccatcagcatggttcacaagaacactgcacagggtggccacatgcaggcgcccttggcgctcttgcaacccctaagcacacgcacagcacacatgtcagagcaacctatattggccatccaacggtggcaaacatctggccatcacaggccaagcgcgcacccggtgcacactcacattggcaacagcattcggtggcaccttctgcatcaaagctgggtggcattgcacccgccatgcccacacatgcgtcatcggcaggcacccggcatccacttcaccagagcgcacgctcacaacattctccgtggccacaacagacgtcgcttctctcagcaccagggtcgttccccttctctcggcacacgtggccactgcgaccttgccacaccacccgtggggcgcgtcacacggccacttcttcccagcgtgtccaccacaccacacttcactttggtcaacccaccggaacggattgggcccccacaagtgccaggctctagtcccgagctggacagtgacaccctcgttggccacctggggcaactggcacgcggccacggtcttcgtgccacatgcggcaaacacattcgcacatgcggcacactcggcacacagccgtcggccaattaccggcactcacatctgcgcgctagcactcggcgccaccaacggtgcgtccaagggtcgcaacgaccacacacgacagcgtgtacgctgttggccggtacacttgcgcacttcggcccacacaaacacggaactcctcacgcgccctttcgcacatgttacaagcgtcaattaccacgcactggtatcctcgtcgctcatgtctgaaacgctcaccgctggtgcctactggacaacgacaacttgggctatacaccggtacagcaacatctctgaagcgctcggcccgctggcccccagtgtgggctcagtcgatgcaaacaacagtctccgttgtggcgtccctctgtgtcggtaactgacacatgcatagcgacaacgccagctatgtgctacacccacaccaatcgggatcacgactatgccagctagttatgaattctcaacgatcttaccaagctacgtcctgtaaccctctgggcatggaccctatcagttacttacggcacgcgactactggggacacacgacggcaccaatttctgagcctacagttgcacgcgtgctagcgacttggtgtgacacaactgtgtactcttggcgacactctaccaccctgaaattacttcggaaacaggcggaaacactcatcgtagcgatcaaccttacacagcgacatcaacaaaccatggcgtcggatacagcgctatgtgaagcgccccgtggaacagtcagtgcgcatgaacactcattccaaccgtacgacgcagattacacacaatatacccacgcccagtgtcagggctgcgaatccagagcatgtaagcgcagtcggtcgcacagacgagaatacatacggggcagcgattgatagctagaagcactagattctaattcgcacggcaagccg

SEQ ID NO: 673597 - DNA, 156 bp, Homo sapiens
gcttgatcgaatcgagctctgtaccagtagcctgtgaaagcagccaggagcagtgctatacccttgcaagccacatggagttgatgctgccaaatgaccatgagaacccacctcttgcatcagtgtgacctggatgtgagactgtggattcaaatg

SEQ ID NO: 673598 - DNA, 275 bp, Homo sapiens
aaaaattttttccttttttaaaaaagggcccaaattgtttatattggagtttggacccccccaagtaatatttgaaatgggatttttattccgggatcggggtcgttatgtattggggaaaacccaggtttgaaggctttttgaattttgataaatgttcagctgaggccccccggggaatttttcttgccaacggcctaagaggcccccccagaatgagttatgcccttgggggtccgccgggccccgaggttcaaaggtttttctttccccaa

SEQ ID NO: 673599 - DNA, 183 bp, Homo sapiens
tcttgtttcctgcacttcctcctcctgttcatcatccctttcttcagataatgagttacagggataaacaataacctttcagatattatataaaacaaaaaagttcttactttattttcttttagaaatatgatagttctactgttattttttgtttcttatggtcctcttcttcctcttgtc

SEQ ID NO: 673600 - DNA, 109 bp, Homo sapiens
gtgtagacatcaaggagagatgtgcgcgttgtcttgcgccttcggtgtactggcatcctgatgattggtgcttcttgggcgtgtttgcttgcaagcattttcttgattg

SEQ ID NO: 673601 - DNA, 706 bp, Homo sapiens
gagtcgagatcgcgacactgcactccagcctaggggacagaacaagactccgtctcaaaaaaaaaaaaaaatctctgtggccccagttttctaccagtctcactttagtttctgaatatgcagcccccgtggtgtcttagtggactttaagggttcttatccaggccaattttggcttcccagaggatattgggtgatatctgggaagatctgggagatattttttcatgggacatcctagggggatagtaagggcattcagcaggtagaggccaagggtgctactaaatgtcctacaatgtacagggcagcctcccacaacaaatctagctaaatgtcggtagtactggaggttggagaaaccctgtgctctagctgggaagcctgggttgtcctgggctgggttttaccctgaaggagtcccagtggtgatgactggctggggagtgggacttgggtgacaggtggtgagagatacttgagcatgggagtggcagcagcacggttgggagggcaaacctccagggattccatgatccttgacgggacaaatattatcccaagttagtccaagggaagatcacacagagctcctggttaatagcaggggtgagctctgaaggccacccttttcctcgaccaggaagctcctagggtaatgtaggggccaggcattcctacctcctccaatccctgtaaccgtgtc

SEQ ID NO: 673602 - DNA, 332 bp, Homo sapiens
tgtttgcttcgagtcgctctcagatccccagcatctaacgtaacacatgtactgtagtttcattagggatttcatttggttatctttcttattactgatctactctatcttgagttaccctaaatagtccctcgtaccctcctcagatctcatactgaaccacccgctctggtttctctggagggatcaccgtctcgttcctctgtacctattattgtacggattacttgctttggtcccacaggctggtatacttgggtactacgttccccacccagctacataatatcatgaatgccaggaaaccgaatagctgctatctcataatatgc

SEQ ID NO: 673603 - DNA, 364 bp, Homo sapiens
  misc_feature (4)..(4): n is a, c, g, or t
  misc_feature (164)..(164): n is a, c, g, or t
  misc_feature (306)..(306): n is a, c, g, or t
cttnccactcgatgatgcttctataattttgccctttaacagaaactttcaaaagggaagagtttttgtgaatgggggagagggtgaaggaggtcaggccccactccttcctgcattgtttacagtcattgggaataaggcatggctcaaatcggccacagggncggtgaccttgtgccccagggttttgcccccaagtgcctccatttaaaagcattaaggccggtacggcatcttcaaaacagagggctggcattcgaggaaacccttgctgctttagtcccgatagggtatttgaaccccgcntatattttaaggcattttaaattctcttccccccattttattgactttgaacaattaa

SEQ ID NO: 673604 - DNA, 516 bp, Homo sapiens
  misc_feature (494)..(494): n is a, c, g, or t
  misc_feature (503)..(503): n is a, c, g, or t
caagaatcccaatttaactcatgttatcatcattagtgatctgtgttgtagaacatgagggtgtaagccttcagcctggcaagttgcatgtagaaagcccacacttgtgaaggttttgttttacaaatcacttgatttaacacactcaggtagaatatttttatttttactgttttatacccagaagttatttctacatgttctacagcaagaatattcataaaagtatcccttcaaatgccttgagaagatagaagaaaaaaagtttgtatatatttaaaaaatgttttaaaagtcatttgcaacagtcgtaccaagaggtacttgcctaaccgtttatagcacttcaggagactgcaatacgttgctagagcacttcttatcctggagtttaatccttgctcactttctacgtagacataatgattgctaggtgtaaaacttgtaaaaaaaggcggcgccgaatgtcgacgcgcgggtcgtaccagctacgnacgtcgacncgaggggggccgt

SEQ ID NO: 673605 - DNA, 1107 bp, Homo sapiens
  misc_feature (804)..(804): n is a, c, g, or t
gcttactgtactgagagccctcgctacatggtgagcgcctgtgatggtacctttgggatagcggcggtctctgcgtagattcgcgtgtttataccttcttcctgactcgaagccgagtccgggtgtgatcaaccggactagaaaggaccaaactgagcacatgagagagctgtgagagcatgccggtggcccagctgatgccctagagcctgagtgacgccgagagctggaggcaggcctcgtggccaggaagggacctgtgactagtcgtctatcaggacccatgggatataagccacattgtgagatgagtctgggcaccgaactcatgatgagaacgagcgagaaagagcttgacatcctagcccaatggggaggcagggtgtcgagaaatccaatgcgataaaactcaaactctgtcgcgttgaaagtttgggagctaagaaactgcggaagctggaggagaaaaccaagcgcgaaaggcccagcgtgaggcagaggaaggctgaacgtgaggagcggaaaccgaactcgagtcccagcgcgaagctgaggtggaaagaacggaggacggagcggcattcgacctggaagtaggacgcagaacaggaggaggaggagaggaatagacccggaaggaacaggcccatggggataatgaagaaagtacccagaaatgaaagggaggactatgtggtgagaggacggaacgcgtaggaaaaaccataactgcaggaaccagaccccagaagctatccagagcaagaggacaatcaataacatacaagcaggcaaggatggtgncattggagaaccaggataccctggttgaactaagctcagagacgccgtaattgatcaagaccctggtgtgtttgggctatacagttgtatagagacggggagttattaataccacaaagaaaggtgcggtgaaattaaccacacgatcgtattcattaggttacaatgcaaagtcatataagtgaccgacctacaaccatagccacaacataaagatggtacgtcagtaaccccctgagaggggacatagcgtgtgaaacaatttgagatgaatgatagctataaatataaaagagaagatat

SEQ ID NO: 673606 - DNA, 215 bp, Homo sapiens
agcggggccgacgcccgagactgccaatgtggacctgattcccgagattcctcatggctaacgagcacctggtgaaagatgctactgtatacacgaggtgcacctcgcataactgcgtacttctagacgcgtggtggcagggcagcttttagtctacgaaggcggggcgaagatctcacgaaagatgctcgatccaactgaagcacggaggcctt

SEQ ID NO: 673607 - DNA, 553 bp, Homo sapiens
  misc_feature (26)..(26): n is a, c, g, or t
  misc_feature (110)..(110): n is a, c, g, or t
  misc_feature (122)..(122): n is a, c, g, or t
  misc_feature (141)..(141): n is a, c, g, or t
  misc_feature (181)..(181): n is a, c, g, or t
  misc_feature (194)..(194): n is a, c, g, or t
  misc_feature (196)..(196): n is a, c, g, or t
  misc_feature (198)..(198): n is a, c, g, or t
  misc_feature (203)..(203): n is a, c, g, or t
  misc_feature (206)..(206): n is a, c, g, or t
  misc_feature (226)..(226): n is a, c, g, or t
  misc_feature (233)..(233): n is a, c, g, or t
  misc_feature (238)..(238): n is a, c, g, or t
  misc_feature (250)..(250): n is a, c, g, or t
  misc_feature (270)..(270): n is a, c, g, or t
  misc_feature (297)..(297): n is a, c, g, or t
  misc_feature (312)..(312): n is a, c, g, or t
  misc_feature (314)..(314): n is a, c, g, or t
  misc_feature (331)..(331): n is a, c, g, or t
  misc_feature (338)..(338): n is a, c, g, or t
  misc_feature (402)..(402): n is a, c, g, or t
  misc_feature (411)..(411): n is a, c, g, or t
  misc_feature (423)..(423): n is a, c, g, or t
  misc_feature (444)..(444): n is a, c, g, or t
  misc_feature (456)..(456): n is a, c, g, or t
  misc_feature (466)..(466): n is a, c, g, or t
  misc_feature (533)..(533): n is a, c, g, or t
ggagggagggagaggccctggccggngcccacccacccacagggcagacattccacttgcacagaggggagggggtggcccagccccctctcggcttacccctctccccntccccctgcggnatgttcacgggtggggganaattgaggagctcggagaggtaggaaggcgaacaccaacncaaaatcgcggcnancngagcntgnctaggtgatggtgaagtaancagaagnctttnccttcatgtgcnggagatatacgttacagcgncagctcccttccgggggctccgccatngggggactcaatcantncatgtggtaaccccgancgcagtnatcacaaaacatgcagctggtcgtcgttctcggaggttccgcacaggctgcaggatttgcactngatgcactnccagcggtaagnccgcacggcttccgttatgtncaccgttaattntaaatacgangcggtgtcctcatcgcccaagttccgcacaggagatgaggtcctcgggacaacccgtcttcttgganccccccaggtagaagtcaca

SEQ ID NO: 673608 - DNA, 901 bp, Homo sapiens
gggtgactgcgtgcatgcatgcctccggggtaggatggcataccgccaacagggtcactaccgatagcgcccgtgcagcccaagcacccttacctacccttcctgcctccctgaagtccagcattaatacccctcacccgtgctgacaccctggcagccccttacacccctgtgtacctcgcaggatgcagagatttgtgctggacccgggatccctgaaaaactcgcttcctgtgacatcgtggtggactgtggtggggctgatgtacgaccctcggagacacacctgatatgaccatacaccatgaggtctttcacagagaccatgatgctaccctgtacccctgggaatgcctgtggcagaccaagctgagcagttgctgggactcatctatctgcacttacgggcacaagcttgctggcccagtatgcttgggcactagtgaagaggaccagcatggttgggcaccctactatgcacacagctgtatagacaactattgtggaggaggtggcatgcttgtggaccaatgggatctcccagtgtgccagacgggggagcctcgcaaatgcaccatgaccccactaaccctgacgtgcacgcagtctgctacgaagtatagttcctacccgtgggacccacacccaggagcaagaacaccttgagggcagtgatacaactagcgtgaactgggatactggagaccaccaggagtatcttgcatagcaccttacgcattatctaccaaatctcagcctggagataccaaccccgcgccatgtctgtcaacactggaccttgacccaacgacactccagagtgaccccaagtggctccatttcgctacagtgggccagtcactcgtactgtagtagcccttaaccccttgactctggtttc

SEQ ID NO: 673609 - DNA, 568 bp, Homo sapiens
  misc_feature (185)..(185): n is a, c, g, or t
  misc_feature (566)..(566): n is a, c, g, or t
ttgggctcctttctcccacattttattcttatttaggcccggagaagaggaaaaccggggaatagcccccctcggggcagtcctgggtccttaaatatttcctaaaaaggaccaagagaaaaggggccggggggccaccccccccccctctttggaaaaaaaattttccagtaaattcccttatnttacggctgtggtggggactgggggttcggggacaaacccccttccttccccccccccctggtggtttttttcgcaccccccaaggaaaaaaaactattttttacttgagggttctccccttgccccggtgttatttgggttttcccctataaccaccaccccttactggggggggcccggatcacatttccaaaatccttttggggtccctctttccaagggggggtaaagaaaaaacacacagttgtcttttcccaggggtgttaaattttccccccccttctttcgggggggatgggagggggctcgggggtcatatgagaacacccccttggatgatttgcggttgcttagaataaaacttgctcctcgcaaagggnag

SEQ ID NO: 673610 - DNA, 191 bp, Homo sapiens
  misc_feature (40)..(40): n is a, c, g, or t
tttacttttagttcacattttttaatgtttaaaaactatnttaatcagagcagttatagaacagaacttcttatatatctttatttacaccaccctgaaaaaaaaaacccagttctattgattaacgtataatagcaagtttgtgacttgacgtcacttaatcaccactgaatcgattacaggtttacata

SEQ ID NO: 673611 - DNA, 218 bp, Homo sapiens
tccagacgagttgtccgagttacctccttttagaaaataatgctgtgtggttgtgatgtgtatgtgtttttctattttagggtggggtgttcccaaagggatgggttactttttctctaataaataatcctgacccacgttgttctcatcccaatttatattaggccctaacatgtaatgatattaatttccaatccatgcatactctatacccccta

SEQ ID NO: 673612 - DNA, 4496 bp, Homo sapiens
ggagagaaaggtcgctgagtcccacagagacacagttaccggttacgggatgagatccagggccagatggacgtgtccccgtgtagcctgacccaggacaccggacaccccagccccagccctgctggggtgagctaagcggggagtggcagcggcacccccaaaggcatggccaggagagacgggcgtgtagcctggggcgggctggcagcagcccggggcagggggtccctcctgtgaccggaagcatcagcccctcagagggttggagtcatcagggggttcaggctgcaagagaaacatggagacgggcttatctcgtcctcaccgggcccagccccctggccgggtgtcaccgtgaaacctccctcaagctcatcaaatgtgcaggcagcgttttcctatcaggaccttccttccttggggtgagaatgaggtcttggactccgaaaacggggtccatctgtccctgaccctttgtgttcaaaatctggcaacgcttgctgaaggaagctcagccttttcttttttaaaaaaatattttttaggccaggtgccgtggctcacgcctgtaatcccagcactttgggaggctaaggcaggtggatcacttgaagttaggagtttgagaccagcctggccaacatgctgaaacccgtctctgctaaaaatacaaggattagctgggcgtggtggcaggcacctgtagtcccagctactcagggggctgaggcaggagaattgcttgagcccggggagcaagagattgcagtgatcacaccactgcatttttctttttttaattttgggaaaagacacacataaatttatttatttgtttatttatcttaattgagacagggtcttgctccatcccccaggctggagtgcaatggtgtaatcttgactcactgcagccttaacctcctaggctcaagcaatcctccagcctcggccccccagttagctgggactacagatgcccacatcactatgcctggctcatttttgtattttttgtggagatagggcctcactgtgttgcctaggctggtctcgaactcctgggctcaggtgatcctcccgcctccgcctcccaaagtgctgggattacaggcatgagccaccgcgcccagtggtgttttaagcatgaggcatccgcgtggctgggagaggctttgaccatccttggctcttccaggttgtcctaccctctggcatccaccatagacgtttttcaaacagaaaatgcaggctggggagccgcggcagggcgggtggggctaccctgtgctgctgtgtgtacaaaattgttccatgatcttggagtgactctgaaggactctgggaggtgagacgttgtcccggagatcaaaacgtccgctcaaaacgttaccctgtcgctcgaacccgatctttttgcttttccacccccgtgcaacccaggacggctgtctgaggccgggagatgccttagacgcaggatgggccactcctcccagcggcaagtggaaatcgaagatgtcatggggtcggggggaggcttctgaaagatgactgcgtcctcctctgcggcacggacgggagcaggtgcagccacatcttccagggcctgccggcatcacctgcggccacacctgagatggaccccacgcagccctgatcgcaggaggcctggccgccccgaccccctccacggggctggcctagaagcaagtagtagaataaaactagcctagtcctgtccctccggccccagtggagacaggcgtctaagaacccgtgccgagagggttcctggacggccgcccaggtcctccgtgcaggcccgtgaggcggggatccctgcttggctcacttcctgagctggtgactgccagggttcccacctcgccaaggctagagggctccgggtgtgtgtgcaggtgtcgggggagtgacctccactcctcaacctcgggcagctcccacaggccacagccgggctccccacccccggcacccagctctctacggcaggtccgggagggctggggcttcggggagccctacccgccaaacctgctgttggcccgggagagccccagaggctcccggagactgcagcctcctgtggttgggctgggagccggcagggtttggggtgtgggcgtccccaccacgcatagcaggaatggcaggaagggacaaaagcctgttccagagaccctgggaggaccccaggcagggagagcccgcctgcctccaccctttccaacgagccatcttggtaactgggaacaaacacaccccaccccgtttttccttaaaagaggccttaatccccgagcccccgctgccagggcagagggaggagggggcacagctgtgccaagcccggccccactggtgtgtcctcacaatgtgaccccagaaatgccagcagggaacggaggctgctgcagagatgcagccccaggcagccggggctcctaggctggtgcagatggtggggttaaacgggctgagcgttccaggtaaactgaggctcggggaggggaaggacaggctggcctctccttcactgtccacagggccttgggttccctgagctgtccagaccccaccatctcccggaccccagggaggtggccattgccagaagcctgtgggtttctttctagcttgggggattaaaaaaaaaaattctccacttttttttttcttgagtagacttcagtgaccacactgtggaaaatacctttgcagacgtggcacccgagtgcacacaccgaccgccacatgtgcttttctgccgggaatccctggggtgaacgcatgttttatgggcgtttccaggagcgcgcgtgcacctccagacggggagctggcgggcgggggtggcagcagcagctctagccttggggggacaagcctctctcagctacgccaggggaaaagagagttaaggacactcacccccacccacgcacacacacaaggcagcgtcgggtgggagagagaaggccgtttctccttctgtagcctgggtctcccacgggccttccccgctgctgagcgagacaccagtagccaggtgaagggccacagcgggccaggccccgaccctgttgtgacccacctgggcaccttcccggaccagctccgcctcccctgccctcctctctccaggaaggagccagaaccctcacccctctcccaccctccccaggggtaaccccaggccaagcacagatagctcagctgcgacctctggcctctggggacataaacggggcggctgggccagggcggaaggtgctcctgtttccctccttctgcgtggtccctttgacgggccggccaccgtgtccgaggcgcaacgctaggcctccaggccacgcatccatctccaagttaacagcccgtcctgcccaagttctggggcaggtaggagagggccgtcacacacctgtccgcccgtgagtgacccgggggggcttccgggtggaggtggagccaccacgcccttcctcaaggggtcacttattaaaaagtccacggcctgaggccaggccctctgcacagaagccatatgcctgtccgcccgtgagtgacccgggggggcttccgggtggaggtggagccaccacgcccttcctcaaggggtcacttattaaaaagtccacggcctgaggccaggccctctgcacagaagccatatgccggccagccgcgcctcctcctctgtccacggaaccgctgcccatctaaccttcgtaaagacctgtctcctgtttccagccgccgcctgtggttctagcaggttctatgccatctgcattgggatgtctggttgtttttatttctgacttttttaaaattccaggtgtgccgcacccactttctcgcagtgttttaatattgtgtggagttgtcgataccacgtgaattcatacacaataaaaagcctcactctcccttttctcctggctctgggctgttccttctctctctggcccgggccttgctggggagggagctcctagcatgcaagcagatgccccaggcttggctccaggcatggggacccgcggccccacaccatcccgtccaccctcccttcaccggcccagggaagaggtaacaggaggggacccctggaggcagcaccacaaaccagggacgttcaggcccagtgggctttcggatttgtacttagaacatctaggaggggccgggcgcggtggctcaggcctggaatcccagcactttggaagcccgaggcgggcgggtcacctgaggtcaggagttcgagaccagcctggtcaacacggtgaaaccacgtctctgctaaaactataaaaattagctggccgtgatggcaagtgattataatcccagctcctcaagaggatgaggcaggagaattgcttgaacccaagaggcaaaggctgcagtgaaccaagatcacgccactgcactccagcctgggcaacagatcaagactccatctc

SEQ ID NO: 673613 - DNA, 657 bp, Homo sapiens
cataatagacaaggtagagttatcattttagtcctgaaaagaattagtaagtacatgtcctctgctgaagtctcctatatgtctttttattattggtttcttcctctagcagaaacaaaataattactagcaatgagaggtaatgtgctgttatttatattttagccatttccctttgtatgtgtgtgtgtgcatatatgtgcatacctacacatacatagtttcttttccttttggtgaaattgtagatttgctaaagaagtaaagtatctggatgaaggaaaattacacatagaaaaaaataagcaatttactggtgtacagttgccattgcatacagttaaactaaggaatctaaaaaaagtaagattttagaatgaaccgaagcctttctcttgaagataatttaaaaaaaaaacacatagttcagttgtgatttttttcaaataagaaaagcaacgatgcttattatggaacatttagaaaatttagcatgtttaacataacaaaggtaaaatcatattaccacaatgtcaagataaccctcatttgggtctatttattctcagtcttatttttttccttacacattttccccataattgaaaactggtaaagacaacttggtgcttttaaaattatcgttgtagtttaagc

SEQ ID NO: 673614 - DNA, 395 bp, Homo sapiens
tccccgggtttcctggacttctgaacagctgggcttccggcaccgccaccacgcctgggtactttctgtctttcatgtggagactcggattttgccctgttgccccggctggtctccaccttctggactcagagcactctgaccaccttgggctcccaaagtgctgcgattagtcttactacgatttaaaataatattaatatatacttgatcacacagattacgtgtgatccccgtcgatcttctatgaagacactggacacactgatcctcacactatacctggacatgccaaggaatcagaataactaaaataactttccaaaagaagaacaaaaatccagggtggctccttaatgaacgatgaaagaagagaaaaaaactcaagaaataag

SEQ ID NO: 673615 - DNA, 271 bp, Homo sapiens
caattgtgctccaaaacctcactaaaaaggaaacaaaaggtaaacaaaatatatttataaccagaaatgaggtctcactatgtagcccaggctagtctcaacctcctgagctcaagttatcctccctccttggcctcccacaatgctaggattacaggcgtgagtcactatgcccagcctggaattttttccttacacaggaatacaccacatggacaaaaagaaacgtagagagatgagaaactaccagccccctcttgctacacactgg

SEQ ID NO: 673616 - DNA, 186 bp, Homo sapiens
  misc_feature (73)..(73): n is a, c, g, or t
ttggtcaatgccaggtgggttattgtcaccatccatgcattttccaatttcagtgcatcatccttgtctcaanttatgttattttccagcagtcacctcatcattggcaataccaatcaacaacatcattccaacacatctttctatcaacaaacacacaacacacacaacacaacacaacacaca

SEQ ID NO: 673617 - DNA, 917 bp, Homo sapiens
ggtactagaaaagatctgattgctggctcctcctccgtatgcggtaggcaagctctgctgcgatgcctcggcctcatctcacactgcgtcgaacccaaaggagcgtgccgtcactgacccagccccccaggaaacagtgagacaagaatcaagtatctgagactgtggagtaatagccacaaaacagagggcgccgactggcacatgctagtatccaggcatgccacaggtggggacgaggctgagagagtcagtaggcagagccagatgccatgctgggcagcagcagtaggactataaaccaacaggtgtctcgcctcgaggatcccactcctttcctgtctgtgtggtgtaagttaacacactggagatgtgctccagattgagcagggtagcccagatgcaaggttcagatccagtgtagctaaggtattatccggcttccagatctatgtcaccagtaccaatcagtcagggtcatcaacatttcaggccccaagaaatctctgtgcaagagcatcaagaaagacctgcttcccagcccccaggatgtccagtgctctccaggcttcctctctttgtgattgtgctgtccagagtgtgcagctggtgctttctttctcttcagtcctctggagtacatctggtggtgtgcattagatgtgaggggttatgtctgatgatgcgcatcactccaaatgagctgatctgctaagaatgatgacggcatccttctggcgttctaggtactggctgggtgaccggaccaggacctgtgacattaatcagtgccgaggaactgggaaggggggcgcgcaatctcctttgaaaatatacggccttctgttgaatcggttaggcagtccgggaacccccaaaggctttttaccccctgggatccaggccaaaccaggggc

SEQ ID NO: 673618 - DNA, 142 bp, Homo sapiens
ctcccttatgcggtgccttcccgatcatcttcatcatatccatctcagacacaggtcctgacagctccttgtatgtggcatcgtctttcagcatcttcacggctacggtgacaggcttggtggccctggtccttgtcaaatg

SEQ ID NO: 673619 - DNA, 265 bp, Homo sapiens
ttttttttttttaaaaacccccccggggggaaagggggggggggggggggggggttttttttttttcccttttgggggggggggtggcccccccccctcccccggagagccctttccctttccccgggggtttttggggggggggggggcgcccccccccccccgggttttttttggggcccgggggggttggggggggccccctttttttttttttccggggcccccccgggggtttttggcccccccccccccccggggggga

SEQ ID NO: 673620 - DNA, 274 bp, Homo sapiens
  misc_feature (102)..(102): n is a, c, g, or t
  misc_feature (110)..(110): n is a, c, g, or t
  misc_feature (118)..(118): n is a, c, g, or t
  misc_feature (153)..(153): n is a, c, g, or t
acaaaatcaatgtacacaaatcagtagcactgctatataccaacagtgaccaagctgagaatcaaatcaagaactcagccccttttacagtagttgcaaaantaaataantaaataantaaataaaatacttaggaatacacctaaccaaggngctgaaagacctctacaaggaaaactgcaaaacactgctgaaagaaatcacagatgtcacaaacaaatggaaatacatcccatgctcatggatgggtagaatcatattgtggaaaatgacc

SEQ ID NO: 673621 - DNA, 556 bp, Homo sapiens
  misc_feature (25)..(25): n is a, c, g, or t
  misc_feature (29)..(29): n is a, c, g, or t
  misc_feature (51)..(51): n is a, c, g, or t
  misc_feature (75)..(75): n is a, c, g, or t
  misc_feature (213)..(213): n is a, c, g, or t
gggagcgggagactgagaaccaccnggancccagaccccaccggtgatggntgcttgaacagactggcggacccntcggacagcttggcctggaggcatagtgtattctcccgcttactaggctgttagctgcccttaggtctttggagtagatgcccctttggtaggtgtcccttggaatccgtagctctggcgccacagtcacaagggagngcaatcagggacttacgagcaggaactatgtggaagggatgaaaaaccaaaccgcccttccaagtctgcagccacccacccatcaaatgagtggactcaggcacgcaaatgaaggaaagtcagcagacccggacttaaacccagaatcctcatgtctagtgcagtgcttttcccgtcctgtccacggaggagaagcctcttccacaacccatggaaccatctcaacagtttgagaaactgaggctcaatatttttcttcacccaaatagctggaccgttgattctggaaactgtgttacctgtttgtctccctgcagcataatataactgtgtgtgtacattc

SEQ ID NO: 673622 - DNA, 222 bp, Homo sapiens
  misc_feature (136)..(136): n is a, c, g, or t
ttattacaacatttatggacctagctccaccataaataaatctgtacagagttggaaagtaagaccatggcatatacagaaggaaagagcacaggtgttaaaggcctccaggaatacagtaacaagtcatacaggntcagccattctccccacttttcaagtgcactaaacaagtgctggctggggatttcccactggatgtgtcaaccagcatgtattctt

SEQ ID NO: 673623 - DNA, 302 bp, Homo sapiens
  misc_feature (10)..(10): n is a, c, g, or t
  misc_feature (44)..(44): n is a, c, g, or t
  misc_feature (75)..(75): n is a, c, g, or t
  misc_feature (89)..(89): n is a, c, g, or t
  misc_feature (110)..(110): n is a, c, g, or t
  misc_feature (144)..(144): n is a, c, g, or t
  misc_feature (202)..(202): n is a, c, g, or t
ggtatttttnggcccgccctgatagccaaacacaacggataganactttggtggtctcttgaaagtgccattgcntggttggaagcaanccaactcagatcattacagcntctcatgacagattaaccctgatcccaggaaggntaagataatacctaattttacttcctgcaacgtcctggctaaccagaggtcctgagtntttccagaggcaactgtactgctggcataaccagcattggagatagccagtacaataaacatatctacaaccaaggactcttacagagtctaacttcaat

SEQ ID NO: 673624 - DNA, 183 bp, Homo sapiens
cggggtgaggtgctcacagtctagggacaggtggaggcctccattccagctgtacgcgaagtccagctcgctgctcaccaccatgtgatcccgcgttggtgaagtcgtagttaggagcggtggtcacacgttcccacacatggccacacactggtgccttttgtagcgagggagccgagcttg

SEQ ID NO: 673625 - DNA, 1228 bp, Homo sapiens
catatcacagtttggttacctatatgagttgaaaacgtcaggaagtaaactttgttgaaacacttactctggggacttcaaacggacacaaatcttagggatgattccctgattacgcactctgacactgtttacacttagtgaacactttgtacgctataatctggaaaattaccctagactctattgtaagagtattaacatacagaagtagatttattctctcagaaatgtgacctggtcttttcataacagcacactctatagaccaggattcatctacatgccacatccagaagccacacaccaggccacaatttcaaacttgggaccaagtaaattacgtagtgccccaattgtgtaacagggcaattccgtgcaatttcattatattcttatttcaatcagcaggccataggcgtcatccacgtagtgagttggccccaggcatgggatctagacaactttgaggggctacaagcgatacctccacaaaacggctggggatatacagtcaatagaagcccaccggtggccacagcctaaattcctggactttcgtcattataccaggagtctttccactgtgcatcagcgccactcagtcgtggtacgtaaactcaagatttggaatcatctttagcacaaaggtcagacagaacattccatttcggtacaccaggaacggtcaagggaacatcacaggaattaatccccaatacatggccattagcgtggataaggaaggccagaaaatatgggatcagacttaaagtggttcaaaatccataaagtagggaacacatacagtgggtataaacctggtccactcaagcattcatcagtcaaacaatttaatacacttaagtaacttgcgcaccctacctacagccctatagctacaattaccgggccggcccgtgcacacaactacgtcggcagacaccaaccatggggcaacccggtgctaccgaccccacctggcacgccccatctaaccacacaggcgcagagacggagcaaacaaaggttatcacacaaaacccaacagagtaaggcggcaggctcacaaagacgccccccaaaggaggaagaaaaaaacgagcgacaaacagcatatacaaaacaggctcgtgatacaaacacgacatgacaacccacaccagagggagggcagaaaacaccacacgcgatcccaacaacgaccgcacaactcgaaccagatcgc

SEQ ID NO: 673626 - DNA, 181 bp, Homo sapiens
gcctgactaccataaaataatccatactggagagaaaccatataaatgtgaggaaggtggcaaagcttcaacctatacgtaaaccttactacacataaaaaaatccatatgggagagaaaccctacaaatgtgaagaaggtggaaaagcttttaaccagtcctcaactcttactacacata

SEQ ID NO: 673627 - DNA, 405 bp, Homo sapiens
gcagtggccgcatctttcgtctgatccgtcgtaatcatagcagttcctacttctcctatgtctcccagtccttgctgttgcctttgttaaaagagtagcagagcgcaaactcaagagctagcttcttggatcccgcacggcggaggatacgcagttcgtatatccaacacctatgctgatgtttcggtcaccctgaagtttagtattcgttatcctaccatggcttcggaataatctcgccttattgtaacttactagtccggatgaatataaccatttggatacataggtatggtctgagctaagatatcaagtgggtacctagggttgatcgtgtgagcacaccatatatttacagtatgaataacgtggagcacgagcatatttcacctccgctaccataat

SEQ ID NO: 673628 - DNA, 1011 bp, Homo sapiens
tgaaagcgaaatagggggggcgcacaatccaggttttggtctcctttgtatttcgctcattacttttgtctctttctcactgcgcaagagtgatggccattacccagtatctcttctcacatcgtctattcgtttccgccgctctagcggccctgatgatcagagtctagaataggtgttctgctatgctaataggtcagtacagttactggaagccattcttacacccttcatgggaattgttcccccccagtttcttcttcccccgtgatcccacatcttatcctcgttggattcattaggtggccagaccaaatgcgtttttttgtatgttgttttttttttaagcttcccttgagagaactaaatggtatatggagagaactattggtaacaaggtcctggtttctcttgcgacacagtagctaaacttgcctgctttgtatatgcatttttgtacgggatcagcttggtagcacagtatttagccggagatacaccttgatcttggtctgcaagcccttctcccatcagtcctagattaggccctgttcagccatgacaggggtgttggtttatgcgtgctgcagcagtgggcataatgaatataatttacccagtgcacaaaggtgtgtaccaagtgaattctaaataattggtgtggatttggccagtagctaagtgggcttttaaagagtattgaagattgaaagggtgtgtcctctctcttcttttctgtgaaagagtataacgaagtagtgatctgtcagataatgaaagctagggtcttgccctcttcatgtccactctccttccaaatagttatatccggaactgtctgtccctctcccctatccttgtcccccctattagaaatagatacagggattgattaatgtcccgctcctgtagtacatgtaaaatttgtacaacaatatcttctagtgacaatgactttgtaagtctgtagacttattacctgggagatgtcttacacgtagaatcccatcc

SEQ ID NO: 673629 - DNA, 1108 bp, Homo sapiens
  misc_feature (849)..(849): n is a, c, g, or t
ttgggtgtctaggctaattttacttcataaaattgttcatagttgtatttctgagttttttcaatgtttaccctttttgttcgatcttaggggtatgatgttgttttggtctttcgtgtaagtggtactaatgatgagtttgtaatatggtctgttaagtttttctccaaaggtgttgttctttctcaaagttgtttatttttgacatggtctcttcggggcggttctattgttactattgtcgccgttctttaatatttcgatattccccatgttctttgccgcttgtctggaagcagaattttctgcctcagattgccactactcctcgtgtctagttgcctatttctgccctaggtctatgggttttattcctatggataggtatcatgatgttgaccatttgtcgtgttacttctgatactttatatcacacggtggctctctacttgtcctcgactcgctctcttttacctatttagtcgcttattatgctacttattgtcgtgcttttactcttgcgtgctgagacgtatctcaggtctttgacctatggtacatacaggaagcttctgaatatccacgtcgtgtatcttgaatgttctcataggtctgaatgttgtataagcttgtattagagctgttaactaagtgatggcgtatgtatagggctatgtagctcagaatatttgcttgcttttattactcctaggctcatggaattcgttattgtttaatagatgtttaggttatatattataacacgagctactagtatttagtctagtaagtatatatattaatattatgtatgtaatactctgaatctatacctctatctataagatnacgagtgcagatataatagatatatattagtgagctctttaatagggactacaattacgtattgaataaatgaacttggactatgtggttatgcgtttagatcgcacatcttagctgtcatttgttcagctctaacaacgtgatgttcatctttctgttaatgttccctctgcctaaagactacactgacagagaatgacctatcactacttatgatttgctgaagcctaactagcaagactgatttctgagacattac

SEQ ID NO: 673630 - DNA, 144 bp, Homo sapiens
aaaaggagcatggggccaaatctcgacaggctggcaaggcccccaaggggagttggggctggaaaggttatgttgcgtcaggtcctaaaacaacccagcttttgccagtagtaaaacccagtaaaattggtatttttttggcca

SEQ ID NO: 673631 - DNA, 469 bp, Homo sapiens
  misc_feature (430)..(431): n is a, c, g, or t
ctagagaaaagcgatgccgattctggcttcctggcggtgcggcccacttcggtgttcccagcgctgaggcgtcggcggcgagcgggaagaaataagaagcggggctggcggcgccttgctcaggagccgctggggctggaggttgaccagttcctggaagacgtgcggctacaggagcgcacgagcggtggcttgttgtcagaggccccaaatgaaaaactcttcttcgtggacactggctccaagtaccaggcacctgacatcgacgtgcagctgagctcggagctgacagactcgctcaggaccctgaagcccgaggacaacatccttcgagaccggttcaagagcttgcagaggagtaatatgatcgagcctcgagagagagccaagttcaaacgcaagtacaaggtgaagctggcggagaagcggnncgtccgtgagatccagttgtagctgccatcagatgccg

SEQ ID NO: 673632 - DNA, 306 bp, Homo sapiens
  misc_feature (132)..(132): n is a, c, g, or t
  misc_feature (230)..(230): n is a, c, g, or t
agagacagggttttgctcagtggcacaatcttggcttcttgtagtcttgacctcctggctcaagtgaacactccctcctcaccctgcgcttggagctgggactaccggcatgtaccatttctttcttctaantatttttaaattttttgtcaagacaaggtctcactatgctgcctaggctggtcttgaactcctgggctcaagcaatcctcttctctttggtctcccancctgctgggattataggcatgagccactgttcctggcccctcccagattgtttcagcacaatgctgtaagtagcca

SEQ ID NO: 673633 - DNA, 451 bp, Homo sapiens
gaaaggaggggcgtacgcggacatgatggcgtcgaccagggctggtgtgggccggctagtaggaggaggcgtcgcgggttcaaaggaccggtttgaagcgcgccatagcagggcagaaagacctgggaggcgcgaatgccgtacgacatgaaacggatgcgggacgccagtagtaccaagcatctggaggcagcactagagcaatggaatcaggggcagaaggacacgcagaagggcaagtctcatcgctcgaggagcctaatgtcccgggagcatgacgcccttgacgacacaggagggtcgtcccgagcgttcgatagacctgggccacgcgaaaaaggcaggagcacacggtgataacaggccaccgcacacgtggctagagagcggtcgaagggggtcggagcgccagtcgatgcagagaggagggtgtggagcctcggcgccaaca

SEQ ID NO: 673634 - DNA, 218 bp, Homo sapiens
agtaattagaatatcatgatgcgactgccattatcatagcacataggatcatcattagatgctagaactattatgtgaaaagttttgagggatgagatagtacccttgttgccaaagcaccaatgaatggattacttcctgacataccttcataaggaagagatccagtggttatcttaactaagtgaccaaatccagcgatcatcagcagacaggtg

SEQ ID NO: 673635 - DNA, 391 bp, Homo sapiens
gctatttttaataggtatctatctttttttttgtacacgtcactgacaaagtttttgaatatatgacctctaacctaattttcctcatgggtcttacggttcataatgtgcagttttccatagcacagtggttttcaggaatgcataggtggcattatagcagaactgactgcactttgccaggtggtgaaatttagtttcccaaccagacatcgtatgcctcttgatatgttgtaatgtgaactatacagcatcacctatgaagagtgattaccaaaaatcttaacctgaatctaaccacgcctttagatgtaatcttcaaggtaaagaaaaacagtggagagagataagttagatgacaccaagaggattattagattgctgctgtatg

SEQ ID NO: 673636 - DNA, 835 bp, Homo sapiens
acccggtaggggtgtgagaggtctgctcgctctagggagatctgcaagcaatcactatgtcaacggacagaggtgtacccttccttcgtatgaggaagagtcagggattatgaactcattcgaaatgctaaagaggcgattccattcgtagccgttgggacaatagcgggttgtggagccaacttgtggtggcagtatggagtctactagtagaacgtgtacaggagcaggggaggatagctaatgagtgtccagttcatctgatccacatgcgtgtggcttggcccgagggctttgtgtaaggagcgatgacttgtgggtgtgggctattccatgtatcgggaattctgggcataacggtaagccgttagaaggaagagatgctgtctgtgggtctttgtggaggaggcggtgctttgaggttagatgtctttagttattaaagttagctatattgtggaagatagagtaattttgtctgggtttagatggtaacatggcatttgagtattggttcctttcttgcgggtgactggcttggtgaccgaattactagtgagtagtttactagactaggtcatgcatgggacgtcacggttaccttcttcacatgtcatctaaactggcctgtgatggtgttggaaatgtccacctttcttacatttttgacgatgaacttagttctagaggcgaatacgagggcgatcctggaaggtactccctggttgatgccgaagtagatattgggtgcggcgaacgaggaccatttgcgccaggtgaattgcactttgttgctggtggggcgggggtctgtaaaccggcccagcgccggcgt

SEQ ID NO: 673637 - DNA, 604 bp, Homo sapiens
  misc_feature (248)..(248): n is a, c, g, or t
agcggtacttagccttgtccctacctctttactcctctggtaggcagctaattcttttaatcttttgcttgtctttttctgtttgctttaggtggtaacagtatcggcatgagccaagacgtgatcagtgaaacctattgtggatacatgtactccgggttcctatcatctcctccatgctgcatcagcgcataagattgtccatatctagtctattcgttacacggagcctctgccagtgaaccacnggggataagtgaaggaaacgaaatgttgttcgctccttcacagtgatcaaggtgcctaggccagggcagcgtttgttccaggcgctctactgtagaacgaatagagtaactgttcaatggatggcagcaggataggaccctacatgaacgaggttctatcatgattgggtttcactggagtcctatgtgggatcgaatagccttcagccttggcgctatgcaccttctttgctgtccactccaatcaagaacgggggccctcgacaactgctctcaggtatctagaaacaaagttaacatctcgagtgacagacccgagaataacagacatacaaagaattactcacgaggggttg

SEQ ID NO: 673638 - DNA, 520 bp, Homo sapiens
  misc_feature (227)..(227): n is a, c, g, or t
cgcggtggtgtgggtagcagggcacactgacatgattggggtcattgttcacggctgctggaggacaggactgatcgagggcccattaatcacatctaacccaacaggtttagcaacaggtacattccccaagtaataaaattggaaactccttgaacaaactcattctttaagcgctgggaattccacttggaaagggacatccacaagtttagagtggtccaggnagagtccatttaccaagcagcgggcattacgccgttcggccatgatcttagagcagatctcatgcaggctggtggcgatgttcttggcaggtgcctcacagcgaaacacgtggcacttgagcatctgggtcagcttatcacgagctacgtaggcaaagtcccttccactgtcccgcccgacgccccacacgcggatgctgatgatgggttgggcgtgcagcagtgcctggctctgtggctccactagctttagtgtctcatcctccagctgcagtagcagatcctttcctacc

SEQ ID NO: 673639 - DNA, 189 bp, Homo sapiens
tacggtctgtcactatgctctcttcccttcagacagaccattctgaattctctaaagggaaagggcttttgcatcgaatcacaatagagttgaaagagaggctaggatctctctctctaggtgctgagcctcactctgtcagctgagactcaatgtacctgctctctacatgctgtgtgatatggtgac

SEQ ID NO: 673640 - DNA, 361 bp, Homo sapiens
  misc_feature (215)..(215): n is a, c, g, or t
  misc_feature (310)..(310): n is a, c, g, or t
  misc_feature (326)..(326): n is a, c, g, or t
caggcatatgctaccacgcccagctaattttgtatttttagtagagactgggtttctccatgttggtcaggctagtctcgaactcccaacgtcaggtgatccgcccacctcggccttccaaagtgatgggattacaggtgtgagccaccacgcccagtctgaatcactcttaaagctcaagcaatcctcctgcctcagcctcccaagcagttganactgcaggcacatgccaccatgcgttgcaattttttttttttttatagaaacggtctcactgtgttacccaggctggtctcgaactcctggcctngcagtcctcccacctnagcctcccgtcctgggactaccacccccctggccg

SEQ ID NO: 673641 - DNA, 252 bp, Homo sapiens
ctgcctagaggacccgtactgtggtgtaccgtgcagcaaaaacgaaatatcacagggatttcactgatctcattatgcatgcgttggacacatcataattcacaggatacatagtaacatgttcctccttatttcagtctatgtactttgttccaaatagtcaacatgaaactaaaataattctttaaaagataagtcttaaatatttcatgatcagatttgtttattaggaaaggatcaacaaaatagatt

SEQ ID NO: 673642 - DNA, 563 bp, Homo sapiens
gccactcagcaaattaaccactctaagttacttgctaaaagggggagatttcaggggacattagctggaggcgatgggcaaacaacaacttctctatatttatttttctcccacccacattccttgcattagggcaattagttaagctagatggataaactaactgggtaacccactaaatttccaagtctttcacaacctttccttacacctggcaacttgtacaccatgtcttccgcattctgtgggctgcatagacctgccctgctacattgcggaaggggtcagcactaggtttaagtagatcatgggggtggcgaggcatcatggaggctgactaccaggtatgtcgaggtggaaaccatttctgttaataccttatctgaaagagtctcagcatttgtgatggaattttggcaaatttcctgctgctatgtcaacatcgattttgtcattgcttctccttctgtggaatggagctctaggatctttacataaactgcagtgtcaagaggcagggtgttgaacttctggtttcgtatgatcagtatcgtaatgtgata

SEQ ID NO: 673643 - DNA, 955 bp, Homo sapiens
ggagagggggctcaaggcgagcgcgccgggcagttgcgggcgcgtggtgctgaggttggcggcggtgccggcgcccgagggccggtggttgcgggcctcccgctcgaccgggctggggcagccgtggcgggcgcggggaccgcaaggggcggaggaaaggagggggcggtcccggcacgcaagaggagcagccgaccatgccggagacaacatggcctcctggatccaaggatcgccgccaggctttgccttcaccttccgggcagctggggcggccgcgagcgctcccggatcgcagaagcggatctggccgcgagaggggcctgattagcacgcggggttccccgagaagaagctgagcaaaggtgaaagagcctccgtggaccccaggttccgggcagcggagggactttcgaaacatttccgcccccgggcgaaggcgcccccacacttgcacgccgggtgccgggccaacactggccggcctgttacaaccttactagggggcctttcttacggacgcggacgggcatccaagccgggggcggctgtcacttggctccagagaggcggacacgtcattcccgtggcaacgacaaccggggattggcgcgcgactgccacaggggggtggacgcgccccggtgggctcaagctggcgggaccagctagaccgcgggcggggggacacgcgcgggggactgtgccgccgagacaacagatcgagcaggcgttgacgccccggagggaaaaccggggcgccggcatagcgagatcacggggcaggaaccccgaggccggggccgtggtctcaaaccggacgggacactgggcaaaaagaccacggagggaccgcagctcaggaatcaggccccaacaaccgaaaagaggggcaacaacagggggaccgcagccagagccccgtggacaccaagtgcgccaccccaccgttggc

SEQ ID NO: 673644 - DNA, 187 bp, Homo sapiens
cagctacattgcgtttgaatcttaatttttaaatcctattatgaaagatcctcatgaattaaatatttaatgcaattattatcgtttattgatataaaaaaaaaaccaccaaaattcaggcttgtaaaaactgacttttacataacgtgggtttcgaaatctagccccagacttaatgttggagata

SEQ ID NO: 673645 - DNA, 476 bp, Homo sapiens
aagctacatatacacggggagcgggcttgtgttaaaaactactgctggaatgtctgtcttcgaacgagcccgtaaaccgttaaagccctatggcgagccgccttgcccagcctgcttagctgggtattgtcccggatccccactatgcggggtttttgacaacaacgcggctgtggctaaaggaacagactaccactggtcccaagactccatagcgggctgtcatggccggaaacctttaggtagctctactactacgttgcggaaagcgatcatggcacctccctaggaagacccttttagctcaatccaaccatcccactggaactcggccgtgatgcacaacaacccgggccggtcagtaaaatgtttcccgcagtagataggttgtcgggcacatagatgaacactatctactcagcctttggggagtgcggaaggagcctaactttccatggagcaaatgcctagtgccg

SEQ ID NO: 673646 - DNA, 870 bp, Homo sapiens
gcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcaaccccaccggacgggtggtcctggagggaggctggagcggggaggcgaggagggggctgtgagtcctcagaggccctgggcaccagatttctggcagcgtttcccagacaccgcctcgtgctaggccagtccctggatagcaagtgaattaacgttaagggcactgtgatgggaagccgttgcgccccctctttttgtaatggttgtaaatagtctggggaataaacccaagggtaaatttgggaatgattaaagggcgttcggtggaataacacagtggtcccatctacgggctgggcatcttagcaatccaggcgtcaggctctgccccttctccaggatggggtagccccgagtcgcctccccagtctgcacattccctgtggtccctgtcccatgcaggggttcccggggccccagggaggcccaagcttaagtcccagcctgactcggagagttggctaccttcaggactttgccgcaagtcagtcctgctcatggggtctaagattccccatccctcggatgggacgcaagaggtctactgagtgggcctgccttgcaggggcctggggggacccaagtgtgagtgtcatcatacaggggcctcaaagaagtggaggacggtgccaagagtagcggatggcatggtggtgcctccacccggacctggcctggggagga

SEQ ID NO: 673647 - DNA, 211 bp, Homo sapiens
gatccccttgattggcgacgagtactacctcatcctcagcaagtccactctggatgaactctgtctgccaacattcttcctgacgtggacttgcttgaggttgatgcgtagtagatcgtcgtcctcgttcgatgctctccagcgaacagcggagatgtgctcgtgaagacgactggcatgactggcagatgccgctagcctcgctgatgct

SEQ ID NO: 673648 - DNA, 521 bp, Homo sapiens
ttgtcatgtgcagcagttgcctccctccagttgtcttccccatgtcaggcaattgatagctagaggtaccttggtgatcttgtctcgtttctcgcagaaaatggtcatcctccataattggtaatggtgatatcctgaaatcaagttcacaggtgaacagatctaatgtccattttattgttcactaaagtttagggtcagttgagagtgggtgataaatatatgactcttcattcattatctctttggtatttatatttttgacttattttttcagaactccattggtccctattcaggaaatgctaaatttaaacagccccgtcctgttttgggaccagccacctagagttctcaagtgctaaaggcaacgacctccttcccatcctcactcaccagtaattccacagggccaggctcagtgagatctgtcaaggcaagaggggtgcttcagctgatcccatactatcactcaattctggttttctgactctcttatttgttttcaatccaacctctac

SEQ ID NO: 673649 - DNA, 860 bp, Homo sapiens
ggcttgtcagtcggcgccgcgtgcggtctgtggctctgtgtcagcgtcggtggaggcttccggaattatgagcggtttcagcccgagagcgcgcgggcaattctcgcttggagatacagagtggttcgctgaaggcattgcagaggggaccagtattataatctccattgcatggatatccaagtttactgcagataaggatgtgtccaccatgtaaggttgagttaccaggctggtctaattgcaaaagtggcaggattggctacaaaagggaacccttaaaaaccctttataaggcaagggattgcttggaccacactgggaaaacacttcggcataatgtggcagaattgtggtcccccggttataaaggggcatatacttctggcaccgtattggtgcccattccccatacaaaatttgggggaacgaaccctcatgtgggcgacatgttgtataacacacctattacttgcgctggtggtggggttgggcaccattgacccccattttgattggtggtcgcttcacacattgtgcacagggcaaggggttatttgtgccaacgaggcgtgaccactactttgtggggtgaaaatttaccaagggcatatggggctatgattgacggaaaggggaaaaccgggtgtggaagaggtacattgggcattaattgttggattgatcttgattgcagccaatttatttattgatatccagtggatgtaacgggttagaaacctgggtaattagagctactgtgactggttagaaggtataagggtcctggtggaaaccagaaaatggttggttaaggaaattaaatatgggttgcctgaattttaaggtatacattgaag

SEQ ID NO: 673650 - DNA, 142 bp, Homo sapiens
ttatttttttaaacttaaccaagtattcagggctattgaattttgaaataacatgaggcggtttggaaatattcacatgaatttatgatattttcagccatctatcataaataatatgagataattaaaaatgttgtttaca

SEQ ID NO: 673651 - DNA, 1172 bp, Homo sapiens
  misc_feature (612)..(612): n is a, c, g, or t
gctcaatgtgcacggtgttccatggtgtgcccagtgtggagtgactgccttccgctacatggcccaaggtgaagcacattgtgcaaatgtctgtcgtgcatggtgcttgctggagtgatgcctggaggcagtgctgaatgggggccaaacccaatgctgatgtctggccatctccaagaccttcttgccctggcccacaagatgctacatcatctgcttgtgtgtgtcttggtgtgtgcttctggcctgtgagtttggctgcagttgtgcttgatacatgctgtggtgtgtgcatgaaagctccgttgtttgacttcctcgctcctgggatcctggacatggctaccagtgcccaagcaatgtgtcctgcctgtgttgtgatgtgctgccagtggctgtacatgtgtgacagtgtgtcacaaccatgcaaaaatcatgactcaactgtggagtgtggggccctgggtgcctcaatttgcctgaaggctgtgctgcacgactatgtgtgccctgtggggctggctgtcttcaaccttggcctgtggtcttgacgagatgtgttgctggatgaaccagaaccccagagttcttccagtgactgtcatagcaagngcccaaggatacatgctgtgacacccttgaacctgtgacagggtgacccgagaggcgtgccctgaggctggactactttgtggtcttctcctctgtgagctgcgggctgtggcacttgcgggacagagcaactacggctttgccaaattcctgcatggagcgttatctggtgagaaaccgacggtcacagaaagggcttccagggcctgggcttgccagtgggggcgcccatcggcgaacgtgtgacatatgtgttgacaccgatgagcaccaaggacacggaacgacaagagggaacacgttggccaaggcgcatgtggtacattggcttggacgtgtgcgggaaccactttccagtagaaccacgcccacacgtgttcctggacccagtcttgggtagagcagaaaaggtgctgagctaatcgtggacggtgaaacacgagggcccggtgagtagcacgtagccccaatttggcctccctgagagggcatgacacacgagaccaactgtcgaagtgcgcgctcacacactacaagtagtagggcaaaacgcagtaacc

SEQ ID NO: 673652 - DNA, 827 bp, Homo sapiens
agcctttttatgctgttaacagatgtcagagtgattctcaccaaaaaaagttaaactatgtggtaagcagccaatgtaaatgtctatttggaaattccctatgctaagggtgccttagaatcatggtgtctctttatatccagcttatactttttgctccacatttaatgcaaaagactctgtgatgtcctaccaggggagaaagggggacatatatttcccttctgtgacactataatggggggcacaacaagactcgtctgaagagtatatctttccgctgctgatacggttgctgataaagacatctcaaaatgtttaccaatgttttaagaagctttgtgtgatattcttccaaatgtagttaccaaatataatatggtagaaaaggtaaatcatacttaatgagcaaaatgtgaagtaagcttttaaagtatattctcttgggggaaaggacaatggagacatgtgtgaatttaagtgaacattttgctcaagatgttaactataaaacacactgatacaaattttcttttcgtgaataacaaaatgaatgggtaatgtgttgcagtgatggtacagcaaaaggtcattaatttttgcctaattcattgtgaactaaaggtaatggttaacacagtgtttgggagttaaatatctcaaaacataagatctgggtccatgaggtgtatgtgggatctggttacaaaaatataacaggggttctttaacaggattccaggggacactgcaggacgttacttaagacatcccagtggtctggggctaagaaggaaatgagctgggtacgaaaatgttgtgatcaa

SEQ ID NO: 673653 - DNA, 998 bp, Homo sapiens
gattgaggggcggttggctttgttgggtgagcttgtatcagtgtccctgatgtggctggacgtggttggtgattggcaggatcctggtatccgctaacaagggtcataagtgcacgagtcattcgtgaaatacccgttatccgggcgaatggactgatcgactcactttgaggttggagccgctaggtgacagcctttcgaataggtgaagcgccaggcatccattgattaaggaaggcatttcctccgccgtaaacagctagaggcgtcgattctttgcattagcaagcaagctggatacgatgggccgtacatcttgtctgactacattacatcctaggaacggaagtcgaactccctgtcacacctgggtccttgcgctctgacacgggtggaatttgccagattcttatcgatgaaataggccatgatccgagtattagagccattacaacgcctgtacctctggagacccatagtgaccgtcttatcgtgaaatgtgctgaatgggcccatgattcccggtattccaccggaacgagccaatcacctgaccgaatcagtaccagagggctcaatcttttttggctgggatacttccagcttctgtgtaacgtataggcatcgaaacttctttttctcggacttcactggttatcccgtgcattggatgtcggatcatctggcaccctgtggtcactagcgccttgaaggatgtggggaattccccgatcctcgtcctgaggacagttgcaccctggggcaccgacttttggacacgaactatccttgtaacgtattgagtagtaccaacgcaatatatggtcgcaagggttttcaatggacggaaaatcctgcgggctaccaagtttgttatcctcctccggaaaggggacgtggtgcttctatctcttgtaaggctgggcaggatgcgaagattgccatcccgcgtttcctggattacagctgttgtgagacttgccgagtgcttgttcacg

SEQ ID NO: 673654 - DNA, 411 bp, Homo sapiens
  misc_feature (356)..(356): n is a, c, g, or t
  misc_feature (409)..(409): n is a, c, g, or t
tatcatgtgtaatctttcaaaatgaaaaaagaataaatcaataatatagtgattttgtttggcttcacgtaataatagcagggggatcccccaccgtgtgagtcattgatgtatagtcatacactgcagctgtgactgtctcaaatttagtcatttccaggcgaatttgcagttaaatgattaacctataggtactatgagttgccattaaaaagccaagcctctcctgatgtctttcctgtcctgggcctattgtgaagcctttaggtgggcatctaccttcagttcatcaagatttaaaaagacagtttggaccctttttgtccaaggctttcccggggtcttttcatgccccnggggaagggtcctcctaggcacgtgggcagggtggcattacttcttcaggcantt

SEQ ID NO: 673655 - DNA, 534 bp, Homo sapiens
gccccaacaccgctcatgggggaggtggatgctgactgcatggatgtcaatgttcgaggaccagatggcttcacacccctcatgattgcctcctgcagtggagggggccttgagacaggcaacagtgaagaagaagaagatgcacctgctgtcatctctgacttcatctaccagggcgccagcttgcacaaccagacagaccgcaccggggagaccgccttgcacttggctgcccgatactctcgttcagatgctgcaaagcgcttgctggaggccagtgcagatgccaacatccaggacaacatgggccgtactccgttacatgcagcagtttctgcagatgctcagggtgtcttccagatcctgctccggaacagggccacagatctggatgcccgaatgcatgatggcacaactccactgatcctgtgcgcgcctggccgtggagggcatgctggaggacctcatcaactcacatgctgacgtcaatgccgtggatgacctaggcaagtcggctttgcattgggcggccgc

SEQ ID NO: 673656 - DNA, 324 bp, Homo sapiens
gtttgtttgagatggagtttcactcttgttgcccaggctggagtgcagtggcgcgatctcggctgagtgcaacctccacctcctgggttcaagcgattctcctgcctcagcctcccgtgtagctgggattacaggcatgtgccaccatgcccggctaattttgtatttttggtagagacagggtttctccatgttggtcaagctggtcttgaactcccgacctcaggtgatccacccgcctctgcctcccaaagtgctgggattacaggtgtgaggcaccatgtcagcatagcttcttctcaacagcccttctgtcgtcttctc

SEQ ID NO: 673657 - DNA, 231 bp, Homo sapiens
agtgagccgagatcgtgcactgtaccccagcctgggggacacgagcgagacttcatctcaacaaaaaaaaaaaaatcagttgggcgtggtgttgcacatactatagccccagctaatgtgggaggctgacacgggacgattgtttaaccccaggagtccaaagtaacaggaagtaggaaccacccaactgcactccagcctgggtgacagacttgagacactgtctcacaa

SEQ ID NO: 673658 - DNA, 749 bp, Homo sapiens
ttaagtaggtatgagctcaattgtgaattcattttgtaaattgtgtttgtaaggttattatagaatcagatctagcttacttttagttcttattcatgtttatgagttagtcctggccaggcgcggggctcatgcctgtaatcccagcacttgggagtctgaggtgggcggatcacgaggtcaagagatcgagaccatcctggccaaaatggtgaaacctcgtctctgctaacaatactgaaattagctgggtgcagtgatgcgcctgtagtccctgctacttgggaggctgaggcaggagaatcgcttgaacccgggaggcggaggttgcagtgagccaagattgtgccactgtactccagccaggccacagagtgagactctgtctcaaaaaaaaaaaaaaaaaaaaggtcccaatttaattctctttaatccaggatgattaattttggttcccggggatttgggacagggagacggtaattgttgtaactaatatttgggataggtggagagaaggctccataaagcaggggacacagacggtttttctaccatcctttaatgttggggacgtgtagggacgtgggtaaacttcagaggggggtctttacgtgtggggagaaccagtgtctattcaccagggagtggtgggaacttgtggccgtggcataatgtttaggggagtggttaggaaccattaattataattcttggggaaggagttacgggtcctggagagagaggga

SEQ ID NO: 673659 - DNA, 1054 bp, Homo sapiens
  misc_feature (1054)..(1054): n is a, c, g, or t
tgtcgctccagcgtcttatagctcccggagcctgccggctaggttctgtctccctgatcgtctctggccggcgccctctccctcgcccggcgcgcacctgagcagccggggcgccgagcagcaccgtcccgagcatagcgccggccctgcccgcagcggcaggatgaatgatttctggaatcaagaatatggaccaggtagcccctgctggctaacagttacagagggacaactcaagcgccagccagccttagacacctttgatgggtccctgtttgctgtttttccttctctaaatgaacgagcaaatcactgcaacggaagtgccaaccaggcttgcgattcgcagtttctcatgacctccgcgcgaacgtgtgcaacttgccctattgttaaccgccgttgcagacaaggcatgtgactgacgctcaagcccttacacaagctaccttcagctggcttcacgcacaggaactagcggcgccttggcgcattcccacccgaacccctggctgtgcacgtgagcaacaggtatgccagctggccttcctctgggccaaccaatgcagcttcacgctctgctgaacgctgacatctgctcaaggcttccggccatgaactggccacactgcatgtgtaaactctgacaagcgaaacgacttcatggaccctgggcaccatgaccctccgtgcggctgacactcctcctgcacaaccatctgagaccacaatgaactaaccgacaaaaccacggcaacacgcacagcaccgactcccactctgaaagcacacaatacccacgcactcaccctccgcactccctccactcggcgcactaacccagcccaccaaccccttcaggctcctcgcacacccggccaccagcgcacccccatcactgcgcagctgcccccacccccgcacatctcccccacataggtgccccgcctcccctccgccacacccatgctcatccgcgccgtcccacaccccctcccgctcccctcacccactgccccccgccacctcccccatgtccccccccacatcaccn

SEQ ID NO: 673660 - DNA, 1020 bp, Homo sapiens
ctagttctagatcgcgagcggacagttctagatcgcgagcggcgcccttttttttcttgttttcccttgaaatctgccagtcagaacgggatttctgaggtaaatctggttctgttaatcctcaattgaggcctttatcatttatctactgattagagacatccatgaaagaagccacctgtatatccacaggggtcctgcgccattcagggaacagccaaaccgagaagtgcagaaagccagtaggatagcattaatgtagtgtgtaacataagcttaaacgtgggctgtgatacaatatcacagtgcctctggtggtccaggttggctgacatactgctcctttatagtaggggcaccagcaaatgggtggggtaggggactacaggtggagaaaagacctacgacgattatttgtggctctatgtagaaaatggcgactctataaaattcctgcgcctccgtggcatcagcgtcgatttcattctagaccttgtcggtgaatctatcgtccacgtttgcaacatagaacaacctcttatgccagagtcgattcctcgaggtacatctgagtaaaccctgggttggattccagaattgggtgctgcggtggggagttgcctattttgggaccgagtttatgtcaaacgcagagattgttccacgggacgagtcctggaactcaattggtcaaagtccgcactccagttgtgcttgaactgaggcctttcaagggtggtctacgaagaaagaaactgtctttgtccaggggaaagacactgaggagtgacaacactgggcggcctggggcttggatcctgatttgatcgagcgtgttaacctctgctctctgaaccttcgtggagtgatacccccggtgccttggggagcctcgcccgaagtcatccttagagttctccccagttaccgcaagagaacccacgggactcgcacagggtcctacacggtagaaggcagggcacccggtctggctctgaagacccaaggctcacagcgccc

SEQ ID NO: 673661 - DNA, 121 bp, Homo sapiens
ccggggttagtatagcttagataaactttcgtttattgctaaaggttaatcactgctggcccttacgcgcgggggtgtggctaggctaagcgttttgagctgcattgccgaagcttgatca

SEQ ID NO: 673662 - DNA, 162 bp, Homo sapiens
  misc_feature (12)..(12): n is a, c, g, or t
aaagactactgncaacgaagccggcctgcctttcccatctgctatctatctggtggcagggaaggaaagacttgcatgttggtggaaggaagaagtggggtggaagaagtggggtcagtttattttgatcacatttttattgcaaataaaaatttaaaaact

SEQ ID NO: 673663 - DNA, 990 bp, Homo sapiens
agtgagcgaggcctatgttccctgcagttgtagacctactgcgccggcagcggatcatcctcatgcttcaggcgtccgcgcctaggcccggccccgccttgtgccatgtcggactacagcacgggcggggggtctggacggggtgcccctctcagccacccggcggtaggctggcccggagaatccgcaacggacgctttcgccgactgccgtgcagcgtggcccgccagtattgcatgccgaaaattggaggcgatgctgccacgacagtgaataacagcactcctgagtttctggtataagggggccaaaagacgacaggttggaagcatggagactcaagccggatgagcaaggaagcgtggcattcccaggggaagactcaaatcagtgttcatcagacattgtgacaccgatccaatccttcgcaccaacaagggacttacaaattgagcagcagagcagtaacagagggtcccaagaaacggccatgggatgcgagccttggcatcccatgtgggccaaggagagcagggttggaaccaaaagagttaaaccaagatagtccccaaagacaagaggacatttcaaagggcattgccgaaaaggtgatcaacgcaagtttatcatccccgaggaaccaaagccaggggattgggcccagtaacacccgcagaaaggacccgaccaagcatcggatggagtaccaccgatttggtgaaaccaaataggcggcaagcgaccaaccacgccagaggggaacaaagcgatccagtaggggctccacccagagggtaaacaaagaagggccccccgcaaacatgaacacatgcggcaacgttggggcccgattggggcgacacgagttagggaaaacacgagtatcattaggggatgcggatacacggttacaacggatgcgagagggcgattacagcggaaatagagagaagagagaaggaggaacaccaacgcaccgacacacaacaa

SEQ ID NO: 673664 - DNA, 295 bp, Homo sapiens
tccccctaatgctgctaaattctgtatttttactagcagacagggtttcatcattttggccatgctggcttccaactcttgatctctctgcatcagtccaccccgacctcccaaacgtgctaaggattatatcgcattagccaccacacccggtccatctttttatttcttttccttttattaatctgaacactgattttatgtattctttgtcctgcctatggggcaatatatcttgcccccatatgcttgactcttgcccttcttaggcatgatggtttcgatttactaatct

SEQ ID NO: 673665 - DNA, 888 bp, Homo sapiens
  misc_feature (157)..(157): n is a, c, g, or t
  misc_feature (235)..(235): n is a, c, g, or t
  misc_feature (253)..(253): n is a, c, g, or t
  misc_feature (294)..(294): n is a, c, g, or t
  misc_feature (374)..(374): n is a, c, g, or t
  misc_feature (387)..(387): n is a, c, g, or t
  misc_feature (424)..(424): n is a, c, g, or t
  misc_feature (438)..(438): n is a, c, g, or t
  misc_feature (443)..(443): n is a, c, g, or t
  misc_feature (446)..(446): n is a, c, g, or t
  misc_feature (451)..(451): n is a, c, g, or t
  misc_feature (466)..(466): n is a, c, g, or t
  misc_feature (469)..(469): n is a, c, g, or t
  misc_feature (491)..(491): n is a, c, g, or t
  misc_feature (500)..(500): n is a, c, g, or t
  misc_feature (502)..(502): n is a, c, g, or t
  misc_feature (507)..(507): n is a, c, g, or t
  misc_feature (515)..(515): n is a, c, g, or t
  misc_feature (536)..(536): n is a, c, g, or t
  misc_feature (547)..(547): n is a, c, g, or t
  misc_feature (570)..(570): n is a, c, g, or t
  misc_feature (597)..(597): n is a, c, g, or t
  misc_feature (629)..(629): n is a, c, g, or t
  misc_feature (697)..(697): n is a, c, g, or t
  misc_feature (735)..(735): n is a, c, g, or t
  misc_feature (737)..(737): n is a, c, g, or t
  misc_feature (810)..(810): n is a, c, g, or t
  misc_feature (879)..(879): n is a, c, g, or t
gaggcggggaggtggccactggctccgccccgctcccctctgacccggtgtctagtctctccgtcttcctgttccaaaccacgtggacgcgtctgggctgctgtgaggcagccgagccgccgccgtcggtgtcgccgccaccaccaccatcggagtnacgagtcccgcgtctgtccgaagtcgccgctctcgggctgctcacgtctcttcggagagcgcgcacatggcgactcangcgcactccctcagctangcagggtgcaacttcttgcgccaacgtctggtcctgtctancctgagcgggcgccccgtcaaaatccgaaagattcgggccagagacgacaacccgggcctccgagattttgaagccagcntcataaggctatnggacaaaataacgaatggttctcgaattgaaataaancaaacaggaacaancttanatnagcancctggcctcctgtanggnggatctgtggaacatgactgtngcgtccttngnggcantgggtatnacctggagagtcttctttgcntggctccattnatgaagcacccgtgaaaaatagntctacgaggagtgaccaatgatcaggntgacccttcagttgatgttcttaaggcaacancactccctttgttgaaacaatttgggattgatggtgaatcatttgaactgaagattgtgcgacggggnatgcctcccggaggaggaggcgaagtggttttctcatntnctgtgaggaaggtcttgaagcccattcaactcacagatccaggaaaaatcaaacgtattagaggaatggcgtnctctgtacgtgtgtgaactcagatggcgaaccggattgtggattctgcaaggagcatcctcaacaagtncatacctga

SEQ ID NO: 673666 - DNA, 91 bp, Homo sapiens
ggggttgaccttcctccatcccctggtccttcccttccctttccgagggacaaaaagacagggcaggatccccgtgcccattgtggaggca

SEQ ID NO: 673667 - DNA, 116 bp, Homo sapiens
gtgtctagcagcttttgcaaaccagcagtcccattggcagtgggagttcagggagtgtagtggatgccaaatatgtttttcttcagtgcttaagagaactgtttcctgaagtccag

SEQ ID NO: 673668 - DNA, 84 bp, Homo sapiens
  misc_feature (3)..(3): n is a, c, g, or t
gtngacaacgaatgtaaaattctgaaatatccttgaaattcaaaagaggttcatgacatagacccaaaggtatttatgagttat

SEQ ID NO: 673669 - DNA, 721 bp, Homo sapiens
tatacttgggtgtttcacttcatgctctgaatactgaataaccatgaatgactgaatagttaatcccaaatttttacagaggatacttctatttttatcattattgggggttggaaaaattttttttataccccttctaattccctttatttctcaaaggcaaataattctctctggtgtagaaaatggtttccttttttaaatttaagggtgtataaaattccttggccaaatcatggtggatttcggctctatggcttttcacgtggtctggaaaaattggtgggcgtaaattggcgcttcgggtatgtgtccctagatggctctcctgttgagcacaaagtgagacgctgccacgtgagacagcccgtgccaggggttgcgtgttcacaggcggggcactcgcaagggggcctcccctggaaaccaagggcggggggcaaaggggcatgtgactccaggggttcccccagggggggctcagcatccagggagaggccacccaggttgggcagccccacctcttgaaaagccccccagtgccggctagcaacaagaggacccgggacccaagaaggacagaatactcggcggggggctgcgacaacacaagggctacaagcttcgcccggtggcaagggacattaaaccccggagtaaaaaccccggtaaggaagcgccgctcaaacaaaccaacagacacacaaacaaacaacaaggt

SEQ ID NO: 673670 - DNA, 1279 bp, Homo sapiens
ctttgtcgggtgagcttgtctgtgtccctgtggcgtggacgtgattggtgattgggcaggactcctgggtatccgctaacaggtctacaatgcacgatcttcgctgaaaagcccttaccggcaagaccatcacccttgaggtggagcccagtgacaccatcgaaaatgctgaaggccaagatccaggataaggaaggcatttccccccgaccagcagaggctcatcgtttgcacggcaacgcagctgcgaatgatggccgtactcttgtctgactacaacatccagaaggcagtcgacccttgcaccaggtcctgcggtcttgaaaaggtggtaatgcaagagtcgttcagtggaatgacctcttgtagccggcgaggacccagtctagaccgcgtaggaacgctggacgcccatagctgacatccattcagacaacatgtgagaggggccaacagaatccacctagtggcatacgaacgacacgggcaattacacgctaaccctggaagacgacagccaaagaaggtggctcctcactccctttgtttgccacacgtggccaaagcctacggcgtaggagaacacgggactgtgcgcccacgacactcttccgtgtttggcacttagcaccatgaaccccatatgcgactccaccgatgcgcaacgatggcaccgtctgcgaagcgccgccattgcgcaacgccctagcgtttccacacgtagactgccatccgcttggacaagaaagatcagattggtgtcaaacttggtccatacgaagtccactataccaagatgcgaacagtggagcaccacagttggtaagccaccgggaggacgaacccggtacacccgcagagtcagatcgcgttcccattcgacgcacgaggcatggagagagagcccacacagaaggacgggaacctatacccacactccagtcaacacacacagacttgttttcagaaactagtgtggcgccaacacgaaaacttcgccgcagagcggcatactctacaccacaacggtcagaaagcagtctaccagtttgagccgcctccacagccaagtgtagctgccccagtgcgtcaagcaggggaggacagtacagctagtccattgtgtcgtgaccttgcggccacaacgcaccgacgggatcgtgatcgtgtgaaacggaagatggcgcaacactaggccgacgcgcgatacgctcagtcgtcgatgttcgagccggaccatacacaggtgacttgccggcatcggaacagactcaccagc

SEQ ID NO: 673671 - DNA, 361 bp, Homo sapiens
ccccgggtttttgccaaagggaaaaccccccctgtaaaaaaaaaagggttttgccctggccttggggggaaaaaaacgggggggaaaaatcccaccccccgggggggggggcccccctttgcccctgggaaccccccgggacccccttttttttttagggcctttgggggtttgaaacccccccccggggggggggggggggcccatttttttggaacccccccattttttttttgaaaaaaaaaaaaagtttcccttttccccccatttcctttttgtccggggaacccaacccttttgggggccccttatccaatgggtttcccccccccccaaaaaaggtaaatgtggcccgccccca

SEQ ID NO: 673672 - DNA, 926 bp, Homo sapiens
  misc_feature (569)..(569): n is a, c, g, or t
  misc_feature (828)..(828): n is a, c, g, or t
gctgtgtcgtcctgcctcagagacgaattcatctatagtaggcctagcccctggcctgtgaacatacaaggaagaggtgggtagaacatcaactgagcatggatattgccagcggaggtctcattacagaaatttcataaagaaacaagtaaccatctggtactgctgtgagtggcgatgagttgaaactatggcactgagtttggactgagaggataagtgtatgcatcgagaacttgttgactcaacgaccgaaggaggtcaaaagtgactacgaaggtcgtgtgtatgaacggaccagccctttcgctgataactatggtcgtgaccggagctgattcctggaagatgctccggacaaatagatccatgctctgtgaacataccaatattggtcgggtgggttatttagaagtccactggtgaggtgatcccagccagactgttgcagaaggtagggtagtcaaagtcgggtatatctgggtgtggtcatgagtacgatacaatggggtcctgtcgtggcgggcccctgaaacgtggtgagaacgtgatctgagagcgtgcgactntactagctaatgaattaggatcgatgcttttgccgggatcataccctcttatcgagacgttgaaacgaaggaccggatccactggcctgagccgcgtaggggctatctgggaggctgtgcacctaatggtctcgtcgctttcatttctggatcatgctccagttggtgtccgaggcccacaggtacgcgtgatgtggcttcggaccacgctttgatgaatgtcggccttgctgtggttctcgccctgctcagtcgtgtncggccgtggatccaattgcttgccttgttctgcttatgtgcttgggcatggtcctcttgcattctcctgtcctggattttcttctccccggcctgcag

SEQ ID NO: 673673 - DNA, 1137 bp, Homo sapiens
ggtggggggaggggtgtggcgcgcgcgcgatttctagtcgtatttcaaagcgcctcgcgctgattctcatgggcccgagtggctggccccgcgttctgacctggcataataaagatggctcatccgcgtgaactggtaatgtgctggtcacagttcgacgaagaggaagaaccaatggattacttccagttgtagactcacacatgaacgacttacaagacactgatagaggcatggccttcccacgagaaggtggcagagagacttgactgaggcatatttcacgaacaggatctggtagccttatgtcgattcttgatgcacaggcaggcacatggagtagcgtcctcacggggacctttaatggaacgacaggtagctcttgtcttggtagctacagcccagtttcacatgggaaacagttcgactgtattcatcatggttcacgaaaacgaaacaacgctcgacagttcacgaaagtggtgagacagcttgactgcagaagaacccttaccaaggggccgagacgaacgtagcaaacaacaagcgtgaggatgccaaaaggtctgctatgaaaggttcccgcccaatgggctacccttgaacttgcagaggcggacagcattctaccgagccgctttgtccgtgtgcatgacagaaaagtgaggttttagtaccatccgcggagaactggataacgcccccgaggggaccaaggacgacgaaaccgttatggggtggtgatccgcatcccagttcaaggaaaacagttgtagttacagtccttggtgagcggttgcaagacgcctggacaaatttcgggcaaccgaggacagcaatgatgataggtacaagcaattaccccaaaggggaccttgtaatacttgcaagcgaatgggagggttgggacggcgcccatatcattaggacgaaatgagtatccgatagcgcgaacatgtgattcactccatacggatattatttggatagggcaaccctacttaggtctggggatgcaacttcaagaagggggtagatgcaactgattgttaccgcgttcattacttcgaacagggacatgcgttgacaaagcgttacaacccggataaaaacgatgatgtacaagtaattactgaa

SEQ ID NO: 673674 - DNA, 260 bp, Homo sapiens
tgcatgctttccattatatctaaccttaaagcttccaaagatgtgataggtacctggaaatgattctgagcccgattattcattttgttttctacgggaatacttgaaaaaaattagaatgggaagaaattccagcttgtttacaccttgacttatgttgttactggcaagatgacttacctctagtccaattgaatttctagccgagcttaatatttctccaacctgattagcttagagcacattaacctaatatgact

SEQ ID NO: 673675 - DNA, 656 bp, Homo sapiens
tggaccagcgacatttgcgagtgtgactgtcatgctgaacatggatatcaacaggagtcaaggggaagaagcttaagtttatattgtttgtgaaacatagatgtttgctatgatcatagaaaatctttttatatattccttaaatattttggcctggtggttcatacataaagatatgtgtacaggttcttttaaaaacacttagtaatttggcttactcaacaaaagatgagtccttatgtaaaatctttggggtcatttcataaacatatgtcttaatggtattgtttgcggataatgcatgacctgtcattttccaagtaatggatccctgatggattcaccatagttacatgactatgtcgtgaattatacatttcttgtccacatatttggaggcccacctgaggatagattattggataattgtcattattttctttcataaaatattgtcatttctccattttctttttcagcggtcttttgaagaatccaatcttccacagtgcttaaatgagcagcttttacaggtactatccgggcaaagcactcagcaggatgacccataatgggactctgcccgggtagccatctttgggtatttgaatagcaagcgctcttttttgagtggcgctgcttaaaaaccgagatgc

SEQ ID NO: 673676 - DNA, 629 bp, Homo sapiens
gacaggggttgtatcatctaggatttatttcagaagtgttttatcagtctctgtagagatctttcacttccctggttatctgtactcctaggtattttattctttttgtggctttgtgaatgggattattttcttgtttaggccctcagcttggacattattggtgtataggaatgctactgatttttgtatgtcaatcttgtatcctgaaactttgttgaagttgcttatcaaatctaggagctttgagcagagactatggcattttctaggtatagaatcatatcatctgcaaacaaatagtttgacttcctctttttctatttgggtgcctttatttctttctcttgtttgattgctttggctgtgactaccagtaatatgataaataggactggtgagggtcagcatcctcgtctagttctggttctctaagggaatgcttcccacttttggccattcagtatgatgttggctgtgggtttgtcatagatggttcttattactttgaggtatgtttcttcagtgcctaatttgtcgagggtatttaacttgaaaggatgttgaattttatcgaaaggtttttctgcatctattcagatgatcatgtggtgcgcgttatccgttct

SEQ ID NO: 673677 - DNA, 522 bp, Homo sapiens
atgtgcaccttagcccaggagttcaagaagcctgggagacatagcaaaaccctatctctacaaagaatacaaaaattaagccaggccacagtgactcacacctgtcatcccaacactttggcattgctgtgtgtacagaagtttgaggttgcagtgagctaagatcatgccacacacgtctgagcataggggacagaccaagaccttgtctcaaaaaaacaaacaaaaacaaacaaaaaaagacagaagttgtatccgaaggacaatgagacataccagttaagatgcaggagaattctgcgtgaaactacttgaaacaagattcagggagatgcaggtcaaaatggctgtgtggaaaccccacagggcttagaaccagacagacttggtttccaaatcccagcacactgtacagaaactgcacacctatctctaggagttgttcacgattagaaacacatttcaaagacttgcccaaggcgggcagtagtggctcacacctgtgatcccagtactttggga

SEQ ID NO: 673678 - DNA, 354 bp, Homo sapiens
tcggcccgtcgacgcgacaaataattctttataaaatagtgtaacaaactatatgatgtctcgacgatccagttgaacgacagaagaaggtgtcgaccatcatggtggtgaacatgaattctgctgacagagaaggacacagtggggacgagcgaacttgatgttggagtatccgccccccctcaacatactagagtgcaaagattggccgggtgtggtggcgcatcgtgtagtccaagctactcaggtggctgaggcacaggaatggcttgagcctgggaggcggaggttgcagtgagccgagattgcgccgctgcactccagcctgggcaacactgtgagactcctgtctac

SEQ ID NO: 673679 - DNA, 287 bp, Homo sapiens
  misc_feature (212)..(212): n is a, c, g, or t
tgctttcttaaccttttgcttgatgctggccacatcaatttgagtttcagtagaagctagacaaattaagagcacaacacatgtgatactttagattttaccaagtaaaacagagaatatatgtgtaacaaagaatatatgtgtaaggcagttaacttcagagtattcttataattgagtaattgagagatgatcacagtataagatataanggcacttgtcctaaagcagttagaaatttgcttcagattaagataaaacaaatcataaaatactttatatattag

SEQ ID NO: 673680 - DNA, 239 bp, Homo sapiens
gccaacatggtgttcaggcgcttcgtggaggttggccgggtggctatgtcttcttttgagctcattgccggaaaattggtgcgcgattttaagatagttattgatcagaaccaagggctttggtcgatgggaccttgccactcaaagtgaaggagacagggccatgccttttcaagtgcatagcagctcactcgattttcatacctcaaagtttcccgcacacgtgcccaccacgaaga

SEQ ID NO: 673681 - DNA, 97 bp, Homo sapiens
  misc_feature (29)..(29): n is a, c, g, or t
  misc_feature (54)..(54): n is a, c, g, or t
aattcaagacttctaaccgatgtacgggngacatggttgtggttaatctggttntatttttgttccacaagttaaataaatcataaaacttaaaaaa

SEQ ID NO: 673682 - DNA, 340 bp, Homo sapiens
  misc_feature (33)..(33): n is a, c, g, or t
  misc_feature (102)..(102): n is a, c, g, or t
  misc_feature (217)..(217): n is a, c, g, or t
  misc_feature (332)..(333): n is a, c, g, or t
  misc_feature (340)..(340): n is a, c, g, or t
caaatttttttttaggacgggaccttactctantggcccaggctggagtgcagtgatactatcatagctcactgcagccttgaactcctgagctgagttgancctcccatctcagcttactgaatagctaggactacaggcatgtaccaccatgcccagctatttttaaagtttctctcccttttttttttttaaagagatgaggtctcatttatantcgcccaggctggtcttgaactcctgaccacaagcagtcatcccaccttggcctgtcaaagtgttggtattacacacctggctttatattgtattcttacaataaagtaagctanntttattn

SEQ ID NO: 673683 - DNA, 153 bp, Homo sapiens
cataggcaaatcatttcaaatgtggtaatacaacattctcgtagtaccagtggctggaccatcatctccccatgtcatctgaccagggccgatccgatgtcacttcagtcccactggatcctttacttgcagcagcaaaattccatcatgaca

SEQ ID NO: 673684 - DNA, 100 bp, Homo sapiens
  misc_feature (1)..(1): n is a, c, g, or t
  misc_feature (24)..(24): n is a, c, g, or t
ntgaggaggagctgaagtggacancccgaatacttggggaaatctacattctagctccaaaatcggcagacttgtaacaggaaggcgatcttgactctgc

SEQ ID NO: 673685 - DNA, 495 bp, Homo sapiens
ctgattagaccaaatggggtctcgaagtcttagcgctcaagcagatctgccctgcctcagctgcccacagtgctggatgacgggtgtgagccagctcttatatattctaatatatagctcccttgctttccaaagacagaaagggaggtccattccgaggatggggagagtataaagaaacgtagattaggaaaagcaaaccatgagtctaaatccagaatcgtaaccagtcctgtaaaactgagaagcccgaggctagggaggacctcagcatcctaaggtgggaaggagagatgctaccattagaatccttcttccgctgaggctggcgcagcgagtcaggatgtcctttctgcatggattcccgagcaactgaggaactggagtgacacaggcagtctactacgttcgggcacatcttaggtgctgaccaggtcctgtgcttaggaacggaagttttcatcaagaagacgaggcatgcaagcattccatatg

SEQ ID NO: 673686 - DNA, 219 bp, Homo sapiens
ggacgggacaagaaatgatacactcatcatcgtctccacgcagaagcaagcaggctaatatactgatcatgctccgcgaaactttgccccgtggggatctgtgctcccgtaagcaatgaagatcaaactagtaacaacaatctcattaaaatgctcttccttgactgggcctggtggctcacactgtgtaagtcccaagacttggggaggctgaggtag

SEQ ID NO: 673687 - DNA, 331 bp, Homo sapiens
  misc_feature (21)..(21): n is a, c, g, or t
  misc_feature (27)..(27): n is a, c, g, or t
tttttttattctttattgagntggagntcgctctgtcgctcaggctggagtgcggtggcacaatcgcggctcactgcaagctccgcctgccgggttcacgccattctcctgcctcagcctctccgagtagctgggactacaggcgcccgccaccacgcctggctaatttttttgtatttttagtagagacagggtttcaccgtggtctcaatctcctgaccccgcgatccgcctgcctcggcctcccaaagctctgggattacaagcatgagccaccgcacccagcccacttttctttctctatattttggatctgtgtctcttgtcgacg

SEQ ID NO: 673688 - DNA, 272 bp, Homo sapiens
cttgggccgggggggggtttgccttttcccccgggggcccccttgggcccctgggcctttgccccggggttttcggccccccttttgggggggggccggcggggcccgggggggtcttcccgggccccccccggggtccgtggggggtcccggtggcccctgttgggccccttgcccccccgcctgggggtttgggcccgcccccttttctttttttttatttatttattaattaaaattaaaataaataaattaaataaactgaataaata

SEQ ID NO: 673689 - DNA, 1407 bp, Homo sapiens
taagtctctaaaccgttaatttctcccccaccaaaaggtgggggtgggggggcctaaaacaacaagcggggcggggggtgttcccggggtgggagccagcggcaaacagcgtgggtgtccctgggggctcttaaggcgaaaggtgggagatggttccagccccacatattgggccgcgtacaatgtcgtcaatcagttggactgataaagacccaggcggcggggagggagagggccgggacctcaagcgggggtggcactcaagcacccggaggccagggccggacggcggccggccgagcccctctcccccgggcccatcccggagacataccggagataccggtgctccggggcggtggagtgccgcagggcggcacggggcacaacacaggcgcgcagaacacacgacacgagctggcaggataaggacgcggagatccaggcgcgccgccccgccgagaatcctggcgcagaacagacgtggcgccacggccgtggcaacaaagacggcggcaacgagtgttcagactggagaagccggctcagaaagggcccatagaaacttggagctcccgggagcaccacgggtgagcaccccgaaagaagaggtacctcggggggggggcatagcacggggtgaggacctgaagcgccaaatatggcagggagatagaagctccggggaaaagggaaaaccacgttaccggagcagcgagaaagccgcacgaggggcacacgatgcgggtggtaacacaccgagagaaacactgcggcacttgaaacagggagaagaaacggacccaaagggaggaaccccgccagtcagcaaggggcacaaacacgaaccgcacgccacacgagaagaaagagtcgatgatacccagggaagcccacgaaagcacccgagaacaacgttaagacacacaaaaaaggtgcaggaaacacacagaaatacaacagaaataacacaaccaccacaggaggggggcatccgcggacctgaaaaaccccacaggaggaggtccaggaagcatgacaagggcgcccgtgaggacacgctgcgcagagcaaagcaccacgctagagaccccagggagccccagcgagaggaccatcaccaaaaccaccacggatgaggacagacaacacaacgtggggggacccggacagcgaccaatcagaaaagcctgggacatacaaagaagcaagcggtgcagcgacacggagacaagaagcacagaaacaccggagtaacaaacgagcacagaatacaccaccaacgtgcagaacaccccgagaggcaacacagagcagcaagaataaacagatgacgcgcacaacgagaagagagccacacacgacgaggcacacacgtcgcggggatcagcgactcagggtaaggag

SEQ ID NO: 673690 - DNA, 938 bp, Homo sapiens
  misc_feature (442)..(442): n is a, c, g, or t
  misc_feature (449)..(449): n is a, c, g, or t
  misc_feature (453)..(454): n is a, c, g, or t
  misc_feature (460)..(460): n is a, c, g, or t
  misc_feature (464)..(464): n is a, c, g, or t
  misc_feature (478)..(478): n is a, c, g, or t
  misc_feature (489)..(489): n is a, c, g, or t
  misc_feature (493)..(493): n is a, c, g, or t
  misc_feature (495)..(497): n is a, c, g, or t
  misc_feature (615)..(615): n is a, c, g, or t
  misc_feature (624)..(624): n is a, c, g, or t
catggctcctgggaggtgaaaggcgaaactacagactatactgatcaggtgctagattgatgctcgtgactgcccacatatatctcagagatctcagacagaatctgtgagcttctggggtaaccatgatgacagtcgggccctctatgccatcccaggcttggactatgtcaggcatgcaagacatcctacccctacgaggctccacgtgatcaggttcccatccaacatgaactctttgaaggatttcgttctgtatgaccagatagaagcacctccttttgtggcctcgggagacgctatagggcctgtcaagagaagaatctgcccgtggctggagctctcccgagtggttcatcgggaaacaattgaggaacatacgtgtcacttgtcatccccttctacatgggcgtgagggaagcccagaatacccacgtggtantggtggngctnntgtatncgtntggagaaccttganagtgatgtggncagntnnngtagcggcactggaggatattcagtctctctggcaccttggagacagtgcgaggccgaggggtagtgggcagggaaccagtgttatccaaggagcagcctgcgttccagtatagcagncacgtctcnctgcaggcttccagtgggcacatgtgcggccgttcgtttgaaagagctgatgggtccaggtggaagttcggatctcccttctcgctgggaagaatcaagatgtgaagaacacctcaggcttcactgtgggcagtggcccagttgccagcttgggcacgggaaaaaattctctcccaatgtggaactttcccctttagggcaggtcctcatgaggggggccacgggggggagggaaactccaacccgtggacccgggggcgcaaacggaactgacgccaagggtcagaagagaccggaggaaacagagtcacgcc

SEQ ID NO: 673691 - DNA, 271 bp, Homo sapiens
  misc_feature (9)..(9): n is a, c, g, or t
aattttttnctttttttccccccccccctgggggtttgggcccccgggccccaaattgggggcggggggtttttttccccccccccccgggggggggggctcccaaaaagggttcccccccccccttttgggggggtttttttttttggggaaacgggggggccaaaaaaaacctttttttttggggggggggtttttttttttaaaccccccccccggggggggggggggcccccccaaaaaaaaaagaaaagggaagccgggaaaacca

SEQ ID NO: 673692 - DNA, 265 bp, Homo sapiens
accagattgcgtgatcctttgattaacttctgaatactcaatcaagtcactaatccttttgctgctgtatctcgatgtcggtttgatactgttaacacaccaaaaagaatatggaagttgaaatgagctatctttataaccctgtgtgaattcgttttccgaaataacatccaattatgactgggtaataagtgtgaaaattttaatttgtggttttcatttattaatgtctgcccatctgtattgttgctcctacattcaaata

SEQ ID NO: 673693 - DNA, 229 bp, Homo sapiens
ccaggatctgtagtgtcggccatacgaattccagggctgtaatctgcctatattcctgtgatagtgttgctgttcatagataagcttcctccttgcctttcgaagcatctttgggcaaacttctttctcaggcgctgatcttcacctctgcgaaattccttcgcttttacttaagggtttctggcacagcaggaacctccttcttcttctcttctacaggggcgacact

SEQ ID NO: 673694 - DNA, 316 bp, Homo sapiens
  misc_feature (51)..(51): n is a, c, g, or t
  misc_feature (53)..(54): n is a, c, g, or t
  misc_feature (58)..(58): n is a, c, g, or t
  misc_feature (123)..(123): n is a, c, g, or t
cgcagtataatgccagataccacatctgacccccatgactgtatctctctnanncganccaagattcacttcatttccccatatttctttctttcctgttccttaccctgttcacacttggtntattgatggcagctccaccaggcctaatcaccactcaccagcaaaggcaggctatgctatagtatcttccacatctatcattgaggctaccactctgcccccctccactacctctcagcaagctgaactcattgccttaactcgggccctctctcttgcaaagggactacacgtcaatatttatactgactct

SEQ ID NO: 673695 - DNA, 386 bp, Homo sapiens
tggacagactgactatagttaagagttagggttagagtcatatgtgtatggttggtataccagggctgtatagcagctatcgccacattggtgctgtatatcaaccagccaccaaggttggtggtatggctggggtaagcatttatcgcttacacatcagagtaaactgggggcctggctcttaggcgatctaggctggcctcagttgggagctctgctcccttggatctctcatcccttttcttaggaccattcagctggttacagagatgtctttctcacagcaacattacaagatacagggaaagcgatgcagaaacagatgaaccttggaggtcgggtcttagcaactggacagtgtcattttcacttcattcttgtactct

SEQ ID NO: 673696 - DNA, 254 bp, Homo sapiens
agagctctacataggaggatgatgctttataactttcgtgttcaatagttggccgctgaggtgttgaggacctagagttctagctgaagttctagggactgacaggacccgtcaattcaagttagccgttaacagctagcatacctactctcaggcggccagtacgtgctagctacatgtgggcccttaacagcccatatgagtgacgataatcttaactcaggccgacgaaaatcttcgacgagtcagggttt

SEQ ID NO: 673697 - DNA, 312 bp, Homo sapiens
  misc_feature (26)..(26): n is a, c, g, or t
  misc_feature (49)..(49): n is a, c, g, or t
  misc_feature (299)..(299): n is a, c, g, or t
ttgctaccaattctatttatttcggnattacaagatagcgggaatcctntctgcaggctggaatggcaggctgtggggtgggcgggacacggctcttaacattttcagagggaaacgcgcagatgtccaaaagtctaaataaatgcattccagaggtttttggggtccatggccaagtggagttatcccagagggggaggtggggtaagtgcctccaggaaggcaggcagcctgccttagacttgcagcccggctgtgggaatgaatcattggagtaataaactacagtggttgatccncaaaaaaaaaaaa

SEQ ID NO: 673698 - DNA, 236 bp, Homo sapiens
acaacccagcattggttgccaaattgaagggtttccagcaggagaatgaagaattgaaagctgggatggccaagcacatggcaatttcaaggcagctttccccggagcaggctgttttgcaaaagtcgctggaaaaggagtcgaaagtcaccaagcgcctttttatggaaaacgaggagcttttgtggaaattgcccaatggggacctgtgtagccccaaaagatcccccccccta

SEQ ID NO: 673699 - DNA, 866 bp, Homo sapiens
cgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaaaggttagcggaaagaaagggattccctttagaagtgtgggaaagaaaattcttaaaattattggagctgtgatgtgccgtgatatttattagaaaattaaggggttttcttcgaaaagcgtgtcctagtgttgggcggtaattaagagtctaaatcactctctccttaagcgtggggagaaccaaggtcccatttggaagggagatacttcaaatatcgggtcattgagggttccgggtcaggtagaattacccatttggtggctacccacatttttctggtgaagaactggtttccagcgggttatcatcatattctaattataacctccccacatagttatggaaggagtacacctgaaaagtggcccttatgtgttggacctgaggattactcggtactttcgggtgacacgaatttacttctcagcggaacttctttacaagggtttttaccgttacacaaggatcactatgaattggcaacgtggcaattttaccctttctatataaccctggccatggtgggttgggcaccaacaggacgagtgctatactagtaagcctccgagaaagaaaatatcacagggcgggtcacaggaccgtacagacactccaggatgcacggcgaattgggtgaccctttccactttcaatggagcgcgccgttcggtatacccctcg

SEQ ID NO: 673700 - DNA, 1013 bp, Homo sapiens
gaaagcatgtaaaacaatgactcaaatgtaaatgaagaatggaaaagcatgttctggtgtcactgtacccatcaaatcatgccacaggccctacctaacagggagtgatcaggaggtgattcaccgactgggaaatctcctcgcttccgagtactctgctggcattggtgtccctttgtcaacttcttcagaggttccagaggtgacaactgtccaacattagtaacaaaaccaggtaataccggttttaagtacgtacaatcttaaccatccacctatcagattcgaattacaacttgtaaacaactgaacttcatgcaactctatccagctaaaagcggagagcagtgcaatgctgagagaaatagctaagtcagatgatggaaatatgctgaatgggaagagtaaatacaccaccacctggtatggcgtcctaaagggctgtatagttgcccatcttcactgagcataatctgctgtgaactcgaattagagtctctgatgaagactcactttttgcaacatgttcatcatgatggcaccagtgaaaatctggaacagtcaaacagatggaggggaagaccaccacgtaccagatctatgcttacatacagccgaattggaggacgagtcacgacgctcacattctgccgggtccactatttaggccataggattctgataatggtgctgtatccagcttcttgcaactagaggtttctaagctggccaaggtctccgtaaggttcaatccttttagagagaattgtcaatacgaaagaggacggagggtcggggattggctgactcacatctgagacagcggtatgtgctagccgggaaggactcggggggggaacttgggttaaccaaggggactacggatgtaagtggcctattgtgtttgtggctcacggtctgtgacacgcacactcgtgaaaggaatatgtagcaacacggaagcaaccagtatgatgtgtggggaggggacacacactgccgaacagtccgag

SEQ ID NO: 673701 - DNA, 1061 bp, Homo sapiens
  misc_feature (383)..(383): n is a, c, g, or t
aagtcggtctgggattgcctatctgcttaccgtagacgagaaatgctaggttatatagccaactacggcatgggcatcgaatgttgtgggcctccgtacgtgcctactacaacccttcgcgtgacgaccattataattcttcaccaacagagacccctaaatgtccgtgactagtctaccgatcacccgtgctacatcaccgtgccgtgaccgttagttcatcaccatcgtctgcgtttctacctatagaagcccccgctccagccatacctgacatgccacctggtgcaacacttaaactgactgtgttgctcatttgatccatagcacaacctctcatgccgttatacgatatttactttaagtagcgttgctttgtctgngggctggaagcgagtccatgactatgagatgttagctcgccgtgtatcatccatggcatgaggtaggcgggccaaacaggacatagcaaatcgtcttagttagtgtagatcttgagccgcatttactccagtcagagtactgacagtgagtcctaacaatctcaccatgaatgattttggtgcgtcctgtgtccatgcatctatcccaccagtctgagtcagacacacactggtttagaaaataccctaccgtgtagtaacacctttgtgtgcttatcgcactgaaggctggtttggctccagtactgattgttgttgcatcgtcgcaatccataagcctggaaaggatcaatgcgtaggaccctggcttaccccactttgggctgaaaggagtgtggggtccctgaaaagataagccccctcctggggcttggacaccaccagtcgaagactatttgtcgggaagcgcccccacatgaattgaacataatttgttcccatacgacgcacactatctcaggacactatgataagtgtggggaaagcccactagaccgcttagaacattgtccctaggcaagtaccatatagacgtaattagtgctcctgcattgtgctagctgatctttcttggggtctgccaattgttcgtacttttataaagactctcctgttacg

SEQ ID NO: 673702 - DNA, 437 bp, Homo sapiens
  misc_feature (108)..(108): n is a, c, g, or t
  misc_feature (131)..(131): n is a, c, g, or t
  misc_feature (160)..(160): n is a, c, g, or t
  misc_feature (172)..(172): n is a, c, g, or t
  misc_feature (203)..(203): n is a, c, g, or t
  misc_feature (264)..(264): n is a, c, g, or t
  misc_feature (422)..(422): n is a, c, g, or t
ggcactttatggcaattccaagaaggggctgaaagttacagcctggatgcctgtcaccaaatccctttgagcagtgacctgagccacctggtcgagaaggtacgagcnctgagagggcagctggagcaganattcaggggaacaattgtctgcgactccncttgcaacagcntggaggagcggtgctggcaaagcacttcaancccctcctccattaaccagaacttcccagccagcactgaccctggaaacaagcagctgctnctccaagattcagctgtgtcccctccagtccgggatgttggtatgaattccccagctctggtcttccccagctctgcttcctctacttctgggttcagaaacgcccataatcaacagagcaaatggctttgggttttggataatttttccagtaattnaagaccccttcccaa

SEQ ID NO: 673703 - DNA, 123 bp, Homo sapiens
tttaaaaaaaaaaaagaattttacccttccatggggaaggttttttgttccctgggggggaaaattttttcatttttcaaaatcccttttgtaagtcttttactttataaatattccagggga

SEQ ID NO: 673704 - DNA, 522 bp, Homo sapiens
tcgatttcattgcggttacgctggctctgtgaaagggggtaatgactagtcgtgtgggactacgcccaccagcacggcatacctgacgagacctgcaacaactaccaggccagacggaccaggagtgtgacaatgtttaaccaatgtcgtacatgcaacgagttcaaagagtgccacgccatccggaactacaccctctggagggtgggagacaacggctccctctctgggagggagaagatgatggcagaaatctacgcaaatggtcccatcagctgtggaataatggcaacagaaagactggctaactacaccggaggcatctatgccgaataccaggacaccacatatataaaccatgtcgtttccgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcac

SEQ ID NO: 673705 - DNA, 150 bp, Homo sapiens
ttttttatcactgtactatatggccactctcactggtacactataaacattattaaaatggtaacatgtatgttacatgtatttcccacaataaaaaaaaacatttttaaaagagaagtagtagagtcctaggggatccttattaaaaat

SEQ ID NO: 673706 - DNA, 157 bp, Homo sapiens
ggccagacaacgttacagtgaaaacagaaatacgaagacagaaatgcagctagactgaagaaagaaaagagactcaagaattcctatttctaaaaatgttcaaaaatattcgaagtacattcaccagtcttctcgttctgcttcccattaacatctt

SEQ ID NO: 673707 - DNA, 442 bp, Homo sapiens
gtacaataaatagtataggcaggcatatttctcccttcaggcactcgtcattgatccggggcatatctttcggctgcctgatatttgattgcatatatttataatagttatatcttcatggtagaatagatgcttatttcattatataactatactttaatgtctcttgtgcacagtttttgacttaaagtcgattttgtctagatataaatagagccactcttgctctctttgggtagacatctgcatggactgcctcgttccatccctgacaggagccatcatagttctgctcttctaacagggcaatgattctaatgtttctctgtgggtcgggagaccaggaaacgacagaccaatcacagaaaatgtgacatagtgcactgccttaagaattcttttctgtccttgtagacaacgggaaaccccgggcatcctctag

SEQ ID NO: 673708 - DNA, 112 bp, Homo sapiens
tacccaagacctgcttctaacctccctggttcttatgaatcgaacagcatacccccgattccgctgcaaaccagtaacgctgcaaacaccgctgcaaaccagtagcaaacca

SEQ ID NO: 673709 - DNA, 1074 bp, Homo sapiens
gtgggagagagcctaactcctcctgacagagtctcaccgaggatggatgagatcatgcgagcgtggtgaatgcctacttggccaacccctcccccgagaggccctgcagcagctcttctcctccatgccaagacctgccagacgactcccctcgccagccagcgcccgggactggacgagccccagggcacagtctggctgcttgggagcagctgcacggactgagcctgccaagatggtcacgacttccactcctgacctgcacgcctgggcccaggactgctcatgacgatttgacgggaacacatggacccattatggccctgccacggaccacggcacatcccacacccaacgggctaccaactggcgtgctggctacacttcactacgtccgtctcttcactctcatctcgctacaacacacatcccaccccaccacctcacactcccctcactcccccccacacaccccccacaccaccccacccccactccccccctcctccactttcccccctcccaacgccatccccactctcatctccgtcgcccccgagcgccacatctccacacaacatgtcccccccatacactagatcactcaaccacactacacgacccggaccacacaccacactacctccccaccaccctcataccaccacacacacacccccgaacaccataccgccaccctactcacccacacaccaccccacacccccccaacgcacaccactccccaacctcactcccccacccacccacctacacacaacactcagaccaccccccccgccctccacacatacagcaacctccccacccccgtcatcccccggcgtcacacaccccccccccgccaatctccaccaaaaccaccacctccaccaacctcccacacaatcccgcccctccaatcactctaatacacaccactcaccacccccgtcccacccaccccctacacccccccccccccccctccctaccccaccaacccccccccccatacaccacaccacaccccccccaaccaaccccccacagacaccaccacctcacccaccc

SEQ ID NO: 673710 - DNA, 119 bp, Homo sapiens
tgttaacgctgaactatgtgtcacctgatggatcatacctgctccctgttgagaaccactgctcgaccctgctcctgtgacaggcactcacaggacatgctggcactaacatgagcttt

SEQ ID NO: 673711 - DNA, 481 bp, Homo sapiens
tggggccgaagttaaagaccgaacggatagagaagaggagggctgctggattggcgttggggccgccccgaggacctgtgcctatctgcccatggtcgaggagccctggcggagtgcagccgcgccgttgcctccaccgacatcgcactggcccacaggactgccactgctgctcggcttctgcgcccccaccagcaccacagccacccagtcccacaccagaccacccggcgtacctggccagagaggaaacgaggtacgacgaggctgagcccacagagaccgagacctccgacggaaccaacatggagacataactgataatggagggctctccagctgaatggcatgacgacgaccaacctccaggaccttcgcccccctaacagatgatctcacaacaccgcacagtcaagcatgcatgtccaccttgaagaaagagacacccaaatcgaacgcaccaactgcaaagcaaccaaaa

SEQ ID NO: 673712 - DNA, 255 bp, Homo sapiens
acgtactaaagggcaggtgattttacccaaattaggatagctttgatccatttatggcaagaacaaaaggggataagtatgccacttacctgtagatttgagcccactataaagcataaagatgtctcatatttttaagtctaaccgagttagcataaaccaaatcatttggacattagttggcagtattatgaaataaaacacaaaagtattctttccttttttattttttttatagaaatggattctcactct

SEQ ID NO: 673713 - DNA, 210 bp, Homo sapiens
tggtcacacaggcaaacgacgctcagactcttgtgcacataatgtctggagactgctgtgtgggtggcagtggctgtcactgtgctctggaatcatgattttgggactggtctgcctcctcaggtggaggagaaggaaaggtcagcagctggactaatgctataaccccagtcatgtgaatccttctaaaacatctgaggagctgtggtt

SEQ ID NO: 673714 - DNA, 433 bp, Homo sapiens
atactcgctgtatccttgaactcctgagctcaggtgatcctcctgcctcagcctcccaagtagctaggaccataggcatgtgcacaatgcctggctaattttgaatttttttttttcataaacagggtcttgctatgttggccatgctggtttcaaactcctggcctcaagctatatttcctcctcagcctaccaaagtgttgggattacaggtgtgagccaccatgccctgccacttagggagttgttttatttttatcttgattgattggtttttctttggggaaaagtattaactggataatttatgttgggtgattcatattttaatatttctggaaatattccatatttcgagtaggaaagttgtttttaactggaagtgtaaggaggaaaggattatggcccttaaatggaattttttttttccccc

SEQ ID NO: 673715 - DNA, 163 bp, Homo sapiens
tgtatctgggaggttgaagataccagggaatcatgacattccgggcatgcgttgtgccaaccctcggccatctgagaaagcgtgcattcataatgggtcttacttgtgttgctgattgtaccgattatgtcatgtcaaagcagatcattcaatgaatgcccat

SEQ ID NO: 673716 - DNA, 345 bp, Homo sapiens
aaataccgcagtgaatttctagtcagcgagctaatgcgtggaatagggaatagcagacaacttgatcatcagagtgtggagtcgattctagaccccaagctacagaaaatgaacttaaatctagttgactgtcgccacatactttcttgggtgtaattttgctggcagcgtcttcttccagcagagcagctggaacagaagcagcatcagtaggcaaatcaggatgtttgccggggggtccctgggatttcagcagcagtgcacagtcttcatgggaggttgaccatagggcagttggggtgatgagtccttggtgcagggcatccagtgtggccgccagccatg

SEQ ID NO: 673717 - DNA, 603 bp, Homo sapiens
atagtgatatttaagtggtagacaccccacctcagctggtcctgaagcttatctcgtataaataatcactggataaggggaagttgtcggtggctaagggatctcaaaccggccatccccaaggaaaatcatgtattagtatggctaaatgagggtcggtatcttcttggtttggaagggggctagatgttggcggtaaactggaaggggagaataatatccttaaagttacaccccctataagcctaaagccatttaattggataaacggagagagactattagatttggctctagggtataaaatccataatctgatcatatccctgacctcccccggattccaattaaaggtgctgaatcagcacatttagtgtggctaaccaagagataccggtaatggtgacatggattggctctaactacagcttcagtgatggggggaggaaaagtcccaacccaaggtgctcaaacttctaaggggtactcttctcatccccttatccttctccctcgacattttctccctctgtcttcccatgaccccaaagccaggggcaaaagatcagtacagaacgtggtcagagtagaacccctgaagta

SEQ ID NO: 673718 - DNA, 194 bp, Homo sapiens
attccccggtgcgggggcggggaaaggaacgggagtgactgcttaatgggctccaaagctcctcggtgggggatgaaagtgtttgaggagtaaacaaaggtggcggctgcccagtgtggcaaatgtgctacatgcccccgaaccccccttgttaaagtggtcattgtatgtggtgtgaatttcccctctgttta

SEQ ID NO: 673719 - DNA, 209 bp, Homo sapiens
attttttttgttttaaaaaatttccaatggtattttaaattaaaagggacatgggcaggtttgttacaggggtatattgcaaaaagttggggtttggggggcaaataatcccctcatggggggagggagcaaagaatccaaaagggggtttttcagcccattttccccctaccccccacccccgacatcattacggggttttcttttta

SEQ ID NO: 673720 - DNA, 871 bp, Homo sapiens
ccctagtgtggtttaaacagttaaaagggagcattgactatgtaaggggaacacaggggtttataaacattctcagaatgtgtacaagagtgtagaacgaccaatttcgggcgtataaaattggttcaaaagagatggcgattgagtcagaatagccgaggtgacaacacccacgagggtggtgggtagtagcctggtaatatattagttttctccagaattgtggtagtgatgccgcacagatagtctctcacttcatctgcatcccctgtttaatgtaggagtactaccgtggggcagcgcggtgcttcttcacacgggggcggtgctacctttttgctcgagagcatcaatattttgtgggaggaccggttgggagcaccaccagaagggtttgttgttctcgccaaggctagttgttgaccaccgcgtttgtcgtaaatagccacggcggcgccccgtattgtctctccgccccggggtgtctcccccggcgttgttagggcagctcgtagcaacaacggctgttgtacacacggtgtgcccactttttctcccgtgccggtgatagtaacccctcgtgcttatcttctttcgcctggtcatactctttgtacacacacgtctggactcgtggttgattgcctcccacttcgccacccggggccctctctttccatccattctggggggggtactccccacttcctcctgcatgcgcctgggagaccccccttcgcctgtgggtatcccacgccgcgccactattctcgcagccctgcccataccaggggccccccgccctttttttatatttttttccccccccccccgccccccgggggaataaaaaaacccccctttttttcca

SEQ ID NO: 673721 - DNA, 543 bp, Homo sapiens
agtactaaaaacactgatatgatttaaaaaaaaaaagaaatacaaaaaggtatgggcactatggaggaccagtctggcaatttctcaaaactaaacgtattgtgaccatataacatagcaatggggtcccttgacatttatacaaacaaggtgaaaacttatgtgcacataagaacctacacgagattgtttagagcggctttatccctaactgccaaaactggaaacaaccaagaggcctttcaataggtgaatggccagacaagctgcagtacttccagacaagagaatgttatccagcgataaaggaaaatgagctatcatgccacaaacagacttggaggattctcaaaagcataggattaagtgaaagaagccattctgaaaagcctacatactgtatgattccagctatatgacttttgggaaaaaagcaaaactagagacagtaaaattaccagtgatagctcggggtaagtggggtgaaggaagggatgaccaggtggaccagaggactttaagggtagggagactattctatgt

SEQ ID NO: 673722 - DNA, 825 bp, Homo sapiens
  misc_feature (232)..(232): n is a, c, g, or t
  misc_feature (544)..(544): n is a, c, g, or t
  misc_feature (658)..(658): n is a, c, g, or t
tggccatccttcggggaaaccttttttgggaacatgttctggatacacccgcgtgcgagaccttgtttatggaaagcatagatctgcaagcaccgtgccaccgcctctaggctatgtgttgtggggagcgcggtcgatttcacagtcgattgttctctctcatacaaagcaagctagcgcctcctggatacctttcccccgtggtgggagccactctcactggctatgtgcncatggcacgcgacgcgctctttatagatcgaaccatgctctgtgtgagagaaggtgatctttacataaatggtgcccacacacaccagtgactcttatctttctctgtgggatataatagacgatataaagaatacggtgaccacacaccctcgttgttattatacgagggctgttatctagtgccacaccccctctttcttcgttgagacatatctgtcctatagtgggagacacgacagacacaccgcacaccacaggtgtttcataggcgaggtgggttctctttggcacttaccgctttatgtgtctntctcatacgccacgtacatatatgatacaccacctcgggagagactacatctttatatacacaaaaaatgcgagatttatacacaacagccccccacataggttaactaatcanaattacactgtcctcgctaaacaaatgggctccatctccatccccattcatctacaataacagtcatagcccttttttttggatgacccccatgcctccctatcctttgatgcctggaaatcaaatttaaaaaatacattttattattcttcttcccacaatagtca

SEQ ID NO: 673723 - DNA, 168 bp, Homo sapiens
tttgggggatttcctggggggttcccccccccccttttcccccaaaggggggggggggggttttccccccctttttttccccccccaaggggccccggggggggggggcccttttccccccgggggccgggctttttttataaaaaccaggaaaatttttttttttta

SEQ ID NO: 673724 - DNA, 319 bp, Homo sapiens
atgatcaccgcgctatgtctggccaatggactgtctgtgacgtaatccagagtaagtgcctctccaaggagaccgctaccacggacctcctcactattctgcctgcgcacacagtgggggatgtgcaatgtgacatggaggtgagctgcccagactggctataccttgctgcctgtctacagtacgggggcctgggtgctgctgccctttttacccagtgctgtgtgcatgtgaggaccacactacactgctgtcgccgcggagatttacggtgtgacacggcacgaatttttaccgtgtgcaacagtgggccccaacc

SEQ ID NO: 673725 - DNA, 363 bp, Homo sapiens
gctattctgttcctcctaaagaggatataaagccattaaagagactcgagatgaggatgatgctgattataaacctaagcaacaattaaaacagaagataccaagaaggagaagaaaaagaaaactagcaagcaagaagcggatggtcaacatttgacaaaaacccaagaatcaagcattaagataaacaaagttcctgagccagataacaagaaaaagaagccgaagaaagaagaggaacagaagtggaaatggtgggcagaagagcgctatcctgaaggcatcaagtggaaatacctagaacataaaggtccagtatatgccccaccatatgagcctcttccagaaatatcacgggggtac

SEQ ID NO: 673726 - DNA, 608 bp, Homo sapiens
ctaatgagtcctctgagtatcacgaactgccagggcgaatgctgagcccctttcctgggagccgagctcgtcccatctgctgtcacaaagacctcccagcttctggcacgttcttcagaaggcggctcctgtgcatggtgggaggctcacagggcgtagtgcccatgttttctgtagcttcctattactgcagcacaagcaaaaggtcacttaggccccttcggcctcttttcatatggagtctctacttcatatgaaccctttacttagattgaagactttgaggtaatataaaggttcaggtgggtgacatgaatagggtagatagaaattactagagccagagtaaactggagagagggtggaggtttctcagctacttctcatagcccaaacccagcagacaggtaccgtgtgtcacagggcacggggacgagaaggtgagagaggagggcgcctgtctgctcagcacagatggggagctctgaaggccacaggaaaggacagggatggattttgttgtagctgctttttcgggtacggtaacgtggactttggtttgtaaacaaaagtcaaattcatatttttcccaccaaatctatgtaaaa

SEQ ID NO: 673727 - DNA, 1014 bp, Homo sapiens
agcgggacttgctttagcgtcagcagcgccggagccggacgagaaacgcggaagatggcggcggcggccgggaggccgtgaggagagcggcggctgcgagtggcggccgatggctggccgtggaggcgccctcggtaccacttgacgggtcgttagggcgctgacgtcctggtgcaggctatgtcgtgagcacgtgggagtcccgcgaagctccggggcccgggtccccaacgggcggcggcggcgggcccggcctgcccgcgctgcgggggccttcgtacccccaagtctcaagcacccaatcgccgctctattgaagcgtgtggcgctgaccgggcgtcttcccgatgcgcgtgtgttcttcgagaatgtgcttgtgtcaccctatttcgcgggctccttccccgtgccgccgttcctcgacggtctccttcggaggttccttgcggtgacttgctcaaggggccctgggtggggtgcggtctgtcggctaccctggggccgtatcattcccaacagtcgttcctttcgttgccggcttcgcgcgccattcaaaggttggcccttgggagggtaccgttgcgttggacctctggtgtgcgcggcgttgacggggcgttcccggcctggtgtggacaggtggcgggggacgatattcggaggccggcggcctgcgcgggtcgtatcccttgaccgaggtgccatggtgaaacattccggtacgggcctgtcgggggaggcctcccgcggggacgctggtgccggatggtgtagaccagggcaggtggattccccttgggtacacttgccacggtagtggagggaagggaggggaaaagaagccttggaccaatggggcaaagtgtatgggggagacaggtccaagtgcaaagtttagagactggtgaccactcggaagcccccaaggggggcttccatgccgggcgcagatagcaaacaaagtgccgtgcgagtgaggtcgcaggagttccccctttacgcggaaagcgagca

SEQ ID NO: 673728 - DNA, 288 bp, Homo sapiens
  misc_feature (96)..(96): n is a, c, g, or t
ttcttcacagatgagcgaggctccgtgacttctctgcgtatcaagctctgcactccttagcacttttctgtcagatgcctggaatactacctgggntttcttcaaagcaaactcgggcatcccgggaggtcagtctccttacccccggacaaagcacaaatacttccctaactgtatatgtaatttttgtctgatgaaaatactctcaggcacatttcaactttcatgctccaaagtccatattattccccattatgacgcacccactggttatttcaggccacgtgg

SEQ ID NO: 673729 - DNA, 621 bp, Homo sapiens
gtaccattggaagagtttacagcctaccaggactacttagaaggggatcatgtttatttggatatataacccctgattggtttgttttaaaaataaacgttattatgttagtgtcatacctcatggtttccttggaacattctcctctaatcctctttgagagagtgggagggagagattgtgaggggagagagaaatattaaacatacatcttcctaatgaagaccataaatcctaaattacctaaataacccacttaactatctccactccttaataacactatactaatatatcatacacttcattaaatcacaatttatctttcaatacaaatataaattctactccccattttcaacactcagttataactaacatcttatttacttatcactcatttatccttatccattcaaataatccctccacacattatcccacttatcacacaacatacataatttctaccaaccttttaaccttaccctctataatttccctcttacacctacatttcctacctataatcctttacaacttatttactcttattcctcattttctctttaatttaaacatacctttcccctttatcatcttatatcatttactacttcc

SEQ ID NO: 673730 - DNA, 155 bp, Homo sapiens
ccccctcccatcgcagattgctatcctgcctggcgctgagcatgtccctggtcggcagctatttcgccctagtggagcccttggtcgccatttttccggtgctgttgctggcctggctgcgctttggcataggagccatcgccatgctgcgatgg

SEQ ID NO: 673731 - DNA, 239 bp, Homo sapiens
gccggcatactcttacgacggaaggggagtgtgctccggctgctgagatgccaggaacggtttcagatagctggccacttgactgcgtttcacgggcctttcctgacagtatccagccccctgccaatctgtggcacccagaccactgctggcccccaaggatgggctcttgggtgcttcttttcatagatgggctgtaccttcggcgcgttacgacataccgcgtgtgggtaccgagc

SEQ ID NO: 673732 - DNA, 740 bp, Homo sapiens
ggctgcagtgagccaagattgtgccactgcactccagactgggtgacagagtcagaccctgtctctaaaaaagaaaaaaaaaaagggttcttggacaattggcttatagtttattagtagattagttttcatttaacaaattatgattccttaaattattaagaaaattttaaaacggcatttccttagtagaggcatttttaaaaggtgataccttttaaattagtattaccgagtattaatatttaataagcattctgattatattggattgcaatacctgaagttgttgcacctgacactgaaacataactctttttggttggttttccctgtggattgttaaaaccaatctaaaatgggaagttaaatctcagtggagctatatgattggtttaaaatttcccttagtggatggctcaaaatggatgggtttcattaatagggaagcttttatatcgaagtctaattcaaacttttatggttagctattgggtggctggggaagttacattggtacattggatgcaggattttatactactgggacacggtcactatagtggctggttgctgccttaaagttgcaagttgagtattcacatttggtaccgaatgtccttcaactttaaatggctgtttctaaaacatagggaaatgccttgaactattttcaatcttgtgtactactactattctttctaacaaatatcttggttgcttcctttattggtcatcca

SEQ ID NO: 673733 - DNA, 102 bp, Homo sapiens
agtgataaaatagggtaggaggccccgagagccccagcaagtgtagggaggcacccagcacatacgtaggtagcttcacaataggtagaggtaagacggggg

SEQ ID NO: 673734 - DNA, 306 bp, Homo sapiens
gaccccaggcaggccccaccagtgggagccactgcagaggaaaaaaatgagtgggaggctttgggtgtgggggttaaagccagggcctgaccttgtttgtttcaggagccggtggaaatagggctcccttgggtgggtggaggcccaggggaatgccagtgggcagttgggttgcaccctcaccccttttgttgctttgcagacggagaccctattgctgcaggcagagccccgtgccctgtgtgcctgttggccagcggggcattgaggaccacgttgctccgtgtgaataaatgcccagtggca

SEQ ID NO: 673735 - DNA, 268 bp, Homo sapiens
taaatcagcataggtgtgtataacttaaccttgatttataagggcttaagattatgactattcattgacatgtcatgagaagctttagaagactttctatttttaaacaccatttatatgtggacttctgttgccactgacttcgggctttatattcccatatagtctttatggaaaaaatagaatctattggccactctcggagctatagctgctgcacactttcaccctgatttattttgttgcttcttagctgtgatgttgccaa

SEQ ID NO: 673736 - DNA, 208 bp, Homo sapiens
ttgcacgccggttatgtcatgccatggagaagatgtaagtaccatagcaaggctgcaaacctgtcttccagtatggagccgggattgtaatggacacatttgggaagtcaggccaggaaggagagaagactctggtacaagtgtgctgctttgtcccatttgtgtgctatccaccttaaacaaagacatgtccttggagaaactatcc

SEQ ID NO: 673737 - DNA, 104 bp, Homo sapiens
cagatcgcgtaagtcatggcggggtcaggccataatgtctcccaagaggccctggccattaagcggatgctggaggtgggagcaccaccagtacaggagcacca

SEQ ID NO: 673738 - DNA, 151 bp, Homo sapiens
  misc_feature (130)..(130): n is a, c, g, or t
tcccaagctctcccatctcctagatctggggactgactgttgagcctgatggggaaagaaaagctctcacacaaaccggaagcccaaatgtcccctatctcttgaatgatcaagtcacttttgacaacanccaggtgaatataaaaactta

SEQ ID NO: 673739 - DNA, 108 bp, Homo sapiens
ttaggataatttctttcatattttttcctagctgtccctggcgtcctcacaacttttcttgagagacatggtctgcactctgtcaacccaggctaagaaggcagtggc

SEQ ID NO: 673740 - DNA, 344 bp, Homo sapiens
cgactttttttttttgagacgcagctcgctctgtcgcccaggctggagtgcagtggcgggatctcggctcactgcaagctccgcctcccgggttcaagcgattctcctgcctcagcctcccaagtagctgggactacaggcacgcgcaccacgcccagccaatttttgtacttttagtaaagatggggttttgtcatgttggctaggctagtctcgaactcctgacctcagatgatccacctgcctcatcctcccaaagtgctgagattacaggtgtgagccaccgcaccagcctccactgcacttttctttgacatagagtcttgctctgtgacccgggttgg

SEQ ID NO: 673741 - DNA, 360 bp, Homo sapiens
actacatacttccgtgcgattatcaaaaaaaaaaaaaaaacgcgcagccataaacccacaaattttagcttcgggggattgactccttagccaagcacatacaccaaatgtctgaacctgcagttcctctcgtactgagcagaataaccattacaacaactccttatccttaggggaaaactattctgaatcacgacggcctaatcccagctcacgttccctattagcgggtgaacaatccaacgcttgaagaagtcttctctacattttctaggatgagccgacatccaagaattaaaaagcgtttttgatatgaacactcccccgccacaagccatatatccctgtgatatctttgct

SEQ ID NO: 673742 - DNA, 349 bp, Homo sapiens
ccctttatgtgtatattttgttatgaaggtaggttgtagggaactgagtcctcataactttaaaaaaaaaactcgctttaagtcaacatttcttatttgccatatgacaagaacgtgaccccatacctcccacccttccattgtagtcccaggtaatggtgggaatagaacgattttgctaaatactttttaatggactattgataacttggggttatgagttaaccggggaagattccaccatttgtccatgtgtcttattttatattttttaccttttaacaaatgctaaacccaagcctaccttttagtctctacttttatcataatacaaagctgttgtacctgg

SEQ ID NO: 673743 - DNA, 428 bp, Homo sapiens
  misc_feature (322)..(322): n is a, c, g, or t
ggtcgacctatgaagaactcaaaaattatccaggcacggtggtgtgcatgtctagtcccagctacttgggagcctgaggtgggaggatcccttgagccttggaattcaaggtggcagtgagctatgatcacaccactgcacccagcctcggtgacagagtgaaatcctgtttctaaaaaacccaacaggccaggtgcggtggctcacacttgtaatcccagcactttgggaggccgaggtgggcagatcacctgaagtcaggagttcaagaccagcctggccaagatggcaaaaccatgtctctactaaaaattcaaaaatntggccggccgtggtggtggacatctgtggtcccagctacttagggggctgaggcaggagaatcgcttgaacgggggcaggtcggggcagggcggcaactccctctt

SEQ ID NO: 673744 - DNA, 235 bp, Homo sapiens
  misc_feature (22)..(22): n is a, c, g, or t
  misc_feature (49)..(49): n is a, c, g, or t
  misc_feature (92)..(92): n is a, c, g, or t
  misc_feature (125)..(125): n is a, c, g, or t
  misc_feature (215)..(215): n is a, c, g, or t
accctcctgtaagcagaaatcnctagggtccagacccttccctgagccnccacccccaccccaattcctgcctaccaagcaagcagccccangcctaaggggtcaagacaagggtgaagcctcantacagacttgtgccttgattggccccaagccttgggaagaaagaattttacttgttaacctggaagactactgaatcattttacccttgnccaattggaataggacctaa

SEQ ID NO: 673745 - DNA, 220 bp, Homo sapiens
ctcggacttgctctcctggttactccatctgaggacagctgcctcctgtgtatgatggcagcaccccaaaggagtcctaaattggtgtggacccatctttctcaaggcttcaaggctcacactttcagctcctaattagtgtggctattggtatgtagatggccataagtgcacttgtgtggctagccgtcctgtgttggctgctatcttgcacaagtgt

SEQ ID NO: 673746 - DNA, 795 bp, Homo sapiens
gccgtgatgcccgcgcgccaggacgcctcctcccgctgctggccggccggcggcctgactgcgctgctgctgctgctgctgggccatggctggctggcgggcgctggggcgcccgggcccaggaggcggctggcgggtgctgaggacgggacccccgcggcagactgtgcgaggacgtgacaggacccgttcagcaagcacactgtacacggccgacatgttcacgcacgggatccagagctgccgagcacgttcgtcatgttcttcgcgccctggtgtggacactgccagacggctgagccgacttggaatgacctgggagacaaatacaaacagcatggaagatgccaaagtctatgtggctaaagtggactgccacggccacatccgacgtgtgctccgaccccagggggtgcgaggataccccaccttagagcttttcaaggccaggccaagaagctgtgaagtaccaggtcctcgggacgttccagacactggaaaactggatgctgcagacaactgaacgaggagccagtgacaccagagccggacgtggaggctgcccagtgcccccgaagctcaaagcacagggcctgtattgaggctctccaggcagaggcacactttgagcctgcaccggttgcacagacggcggcaccacgtttatccaaggttactttccgcttccagtggatgtgagtcacttgcgaaggcccttggcttccaaagcgtggggagcagctggctcctggggcttgaacatccggagatggtcagattgccacggtgcttgtc

SEQ ID NO: 673747 - DNA, 200 bp, Homo sapiens
catacatacttccgggctggctgaaacagaccctgtaaacaatattgcaacattctacatggaccaatagcaggcgtctcaggccttctagggctcccataactgcctgaattacatgaggagatttctcaaacacattgggccatacatagttcaacaggtgattcagcgaatcttcacaaccaaatccataaacccag

SEQ ID NO: 673748 - DNA, 254 bp, Homo sapiens
gtggctgatctagaggatcccggtttcgagaagggtatcacgtctatagtccaggctgagtgcagtgggcgatctcggctcagtgcaagctccgcctcccgggttcacgccattctcctgcctcagcctcccgagcagctgggactacaggcacccgccaccacacctggctaattttttgtatttttagtagagatggggtttcactgtgttagccaggacggtctcgatctcctgacctcgtgatcctccca

SEQ ID NO: 673749 - DNA, 1430 bp, Homo sapiens
  misc_feature (277)..(277): n is a, c, g, or t
  misc_feature (417)..(417): n is a, c, g, or t
  misc_feature (1028)..(1028): n is a, c, g, or t
  misc_feature (1278)..(1278): n is a, c, g, or t
taaaaatcaagcccatttaatggtatctttgaaggtaaacaatatttggagctggatcacaaccccggtaggtatgccagagctagtgggtctccagaaacatgtgggtggtggtatttactcaacgagagtttcaaaagggctcgtgaactcttagcgtgtgtttaccagagaaacattaagtgcaatctcagtgcattctccactttagcaattttgtggtacagaaatcaccccagaaacacgagacaccccgcgagagagagagtctttctcnagagagagtgagagagaacagaaatctctacacctctcgcgtggtgctttctagagagacataaacagtgacaagtgaagagagagtgtcacccaaaacaaaattgtgtgtgtgtgacactatctctctcatactccaanttcttctctctctaaatatccaatgttctgatggaaagcccgcgatgagagagcgtgtgatctatatctctatattatctcgtcccaaaactctcgaccgagagcgagcgcggaaaagagtgcgtgtgcaagtcttcccaagaaatttgtggaggaaacatcgaagggtctctctcatattctccatctttctcccacacgttatatagaccaccccacacgagacgcaagagagagtgttgtcacgccgtgagaggggcccagaaagaacaggccttccttgtgagtggggggggctccacagccttttctctataaaaatatagagcccgatttgttttcaacgggtgtgtaaaacacagaaggaaaaccccccttctttaatagcgaggcccaccacccgtgagaattttactacagcctgtggtgggaaccgaaactttttattaccattgtttcacacacatgttttacaaccacagagacgctcgctaagtgtagtaaccatcaccacgtgttttggtacaaccattgttcagcccatccccttatattttctccactccccctctatttagtgctctttaaaacgagcttccacacgctctctntttatggtccccctaataaattgcattttaaaactccgttatatccgctccctagtggttgcccctttccatattattcccacaaaaaaatcccctattttagagaggccgcccatccatatcatttatacatacgcgtgtgtcgccatttactttttcactatctctcgtggcgacactccccacggggtggggagcagccacctcctttggtgcgtcgtctacgcaacaagcaggagttttcttcgcncacgtgggcgacaccccatcggggaagacgggtggtatctctcacggaaggcggccacaggtatatcatactcccacccactttctggtggtgagcttgtggtgctctctctgagcagactgaagggcggccggagtagaaaacacccctcc

SEQ ID NO: 673750 - DNA, 347 bp, Homo sapiens
  misc_feature (301)..(301): n is a, c, g, or t
accattttaaaaatgtatagtcctgtgatttttcgtatcttcagtgttgtacaactatcaccactatctaattccagaacatttccatcatcctctaaaaaaaaacatatacccattagcagatactcccagtcacccctactcccaagccactggcaatcaccagtctcctttctgtctctatggatttgcctattttgagcatttaatataaatggaatcatacaataaatttcttttgtgtctggcttctttcacttagcataatgttgtcaaagttcatccatgttattaccatgtnatcattgtattttatgggctagttaattccactgtaagggataata

SEQ ID NO: 673751 - DNA, 305 bp, Homo sapiens
aaggttataacaggccggcatggcaaaagctgaaccctgcctgccccgaggtgtgcacacaggcagagagggcctgatactagggctacgtcagagggttcctgtgcgcgcccctgcgcttgtgcccttgccctcatgtcactcagctgatcatttctggtttactttatttctctagggatggtgcaccaaaatgcgcctcctgagcccgacctatactccctgcacaggtaggagccactcacccagagatgatcaggtgcctgtcccagccgtgtgctgtcctgtctagcctgagtctagcc

SEQ ID NO: 673752 - DNA, 139 bp, Homo sapiens
  misc_feature (14)..(14): n is a, c, g, or t
ggagctgcagaggngcccagaggaagagaagaaagaatggattcagatcatccaggcgacgatcgagaagcacaaacagaacagcgaaaccttcaaggcttgtggtggcgccttagccaggatgaggactccgcctctc

SEQ ID NO: 673753 - DNA, 130 bp, Homo sapiens
gcatcctacgtagagtctgtaatacaaaccataatcacaggtcgttttaaaattaacacacgtatctgtcagttatcaaatcaaacttcggatgccggcatttatgtgaccatctgagtttagatacaat

SEQ ID NO: 673754 - DNA, 351 bp, Homo sapiens
ctcctacaggcagccagacacattgattacctgatagattttaggatagaagtcaccgtacagcacgttcacatgagcctgtgtgtctcactacatcatttacgtctatatcgttagatgccactacttctgtcgttacacgtttaccgactgccatgagctagaccaggcgttgacattagaacatggttcactagacatgtatctgggatgccgacattatatccataccagtcctatgcactgtacactgcagcagcgtgcatcctatgggacttagagggttgctgacatctgtgcatgtgtgaagtaccttgcttttctctgactgtgcatttggatgtgtgcttg

SEQ ID NO: 673755 - DNA, 483 bp, Homo sapiens
ctgctttgctacactatctctttgcttgcagcgacggatatactcatcagcgcgtgtgaggactatctgtacctggatcgttctctgtgttttcgactcttgaaattaagatgcattctgcccatatggaggatggcgtcacgaagctctgatacgagaagaaggcctgtctcagtcacagtagagatgattagaaagcatgggcacaaatgatttatgcgcaattgattgggaagatatactcactgagctgatgagaggctcacatagacccagacccgttacccagaagacttatctcagtgatcgagagagaaatcctagaattatatagataacatgcatctaaacatctagatctgactggatatgaagctatagactcgacttcccatacaggtgagatgcaaccagcgtccacactcgacttagcgctcaagaactcgctgtctttttgccatgatagttgtgacagctcctgtc

SEQ ID NO: 673756 - DNA, 808 bp, Homo sapiens
  misc_feature (3)..(3): n is a, c, g, or t
  misc_feature (65)..(66): n is a, c, g, or t
  misc_feature (72)..(72): n is a, c, g, or t
  misc_feature (82)..(82): n is a, c, g, or t
  misc_feature (88)..(88): n is a, c, g, or t
  misc_feature (96)..(97): n is a, c, g, or t
  misc_feature (119)..(119): n is a, c, g, or t
  misc_feature (130)..(130): n is a, c, g, or t
  misc_feature (142)..(142): n is a, c, g, or t
  misc_feature (164)..(164): n is a, c, g, or t
  misc_feature (185)..(185): n is a, c, g, or t
  misc_feature (201)..(201): n is a, c, g, or t
  misc_feature (204)..(204): n is a, c, g, or t
  misc_feature (227)..(227): n is a, c, g, or t
  misc_feature (261)..(261): n is a, c, g, or t
  misc_feature (264)..(264): n is a, c, g, or t
  misc_feature (320)..(320): n is a, c, g, or t
  misc_feature (329)..(329): n is a, c, g, or t
  misc_feature (342)..(342): n is a, c, g, or t
  misc_feature (426)..(426): n is a, c, g, or t
  misc_feature (443)..(443): n is a, c, g, or t
  misc_feature (603)..(603): n is a, c, g, or t
  misc_feature (663)..(663): n is a, c, g, or t
  misc_feature (672)..(672): n is a, c, g, or t
  misc_feature (684)..(684): n is a, c, g, or t
  misc_feature (725)..(725): n is a, c, g, or t
  misc_feature (734)..(734): n is a, c, g, or t
  misc_feature (738)..(738): n is a, c, g, or t
  misc_feature (799)..(799): n is a, c, g, or t
tcncatttaacttttttaatgggtctcaaaattctgtgaaaaatttttggtcaagttgtttccannaaaaanaactgatttnaaaaanaaaaaacnnaaaaccgccacacgcaaaaaanaaaaccaaagnggtccacaaaanattcccctttccttctgaaggntttacgatgcattgttaacantaaccagtcttttacnacnaaacttaaatggccaattgaaanaaacagttctgagaccgttcttccaccactgatnaanagtgggggggcaggtattagggaaaaaattcatttagccttctgagctttctgggnagacttggngaccttgccagcnccagaagccttcttgtccactgctttgaagacacccaccgcaaccgtctgtctcaaaacacgaacagcaaagcgacccaaaggnggatagtctgagaagcnctcaacacacatgggcttgccaggaaccaaataaacaatggcagcctcaccagacttcaagaatttagggccaacttccagctttttaccagaacggcgatcaatcttttccttcagctcagcaaacttgcatgcaatgtgagccgggtggcaatccaanacaggggcatagccggcgcttatttggcctggatggttcaggataatcacctgagccgtnaagccagcngcttccattggngggtcatttttgctgttaccagcaacgttgccacgacgaanatccttganaganacattcttgacattgaagcccacattgtccccaggaagagcttcactcaaagcttcatggngcatttcga

SEQ ID NO: 673757 - DNA, 209 bp, Homo sapiens
aggagttcccgactagccagacaggggcgacaggatagaggaacaggagaaggtgggaagaggagaagtggggaacaggagaagggagaggaacaggagaagcggggaataggagaaggagggaacagaaggggagacagaatgaagcggggacagtgagaagggggaacagtgagaaggggaactgagctgtctgggctagtctgggg

SEQ ID NO: 673758 - DNA, 997 bp, Homo sapiens
gggcaggcctgtgttcttatctcaggaatagtaagaaaagggggttgggaacagcggaaatccagaaataaagacttgagaaaggaacagagtgggtgatggcagctatgaagaaaaaacagatcaggaagaagcgtcctggcagcttaggaagagaaagtgtcacagacacgaggcctaggctagagagatggtgtaggtggtagcgtgctgtgaagaaagaaatgacaacgaggctggagctgttccctgataacctgtgggaaggcaagagagagctgcacagggcggctaccttagcttgtggagaaggtccttaactcaaggactgctgactttaagctggcgttaaccttgtccaagttccagatgaccactggaagcaccagctatagacgactctaagctctgtgccaattacccataggccttcagggtccctgggacctattccagtgatagtggtaccctaacatgaacccatttcagccactcagattgatagggtggcaaaagacagggcaaggtggtagcagcatgtgaagcaaacacgaggaaaagcagacgggtggcctgataatctcgcaggcactgtaagagaaggactacatagcgcctctgtactttggccctcaggagccccgctttcctagtaacgcttgcgacgtccagtactcggattcattccgagtggagaacaagtgggtcacaaacacgtgcatgaagatgccacgacgccatggggtagcagagcctcctagtgaaggtatcgtaccccgggcacgactcctgacgaagtagagctactgggttgggtccatggttcttagctattcccgcttcaggcaatgactggcgcataattgattttagcccctggtaacaaatcccgtcgaattacaagggaataagcactcgcacggataaaaggcttaccctgctgttggaagcaaggacacaaggaactgagtacacaccccccagaagacagacacat

SEQ ID NO: 673759 - DNA, 1910 bp, Homo sapiens
  misc_feature (1148)..(1148): n is a, c, g, or t
cggacgcgtgggcggactgcgtgggtcctggacgcgtgggaaaaaaaaaaaaaaccaacaaaaaaaacgtagcctttgaaacgttttatacaaccattaattctttcatacccacgaaatgtggaaggttgaaattttcattagttgagggtttaccccacccaaacaacgccaccaagggacgttgacgacggggctacgacagacgagaatttccagtgccaacgcaagtgggcacagagtggacaagcaatttgtggtccaaggcccagtgtggaccatttttcgcttcattgtgtggttgtggccgtgaaatatattattacgcagcacacttcactcttggggagaaacgacctccgagggcacagttacaaattaccacaacagagcatttgggagaacacttcttcgccacaggaagcgttccaaacacaacagatacgacggggccatttcgctttacattcacacacagcgggccacattattatccattgcacacgtttagggggccattcataaaattaactatacacaactccttccctaacccttatccccctgttggggggtgtgtagacgggggccacgcgggcacaccggccctacgtgaacacaggtttgaaggggatatccacctgtgcggggggaggtcaataaacaaaacatttcaatctttacagagcagaaattatacaaaacgttttataccacaaagtttatatacaaaagtagtagggagtacataaaaaacgctttaccacaagtgtgtagtgacaggatttatgagcccaaacgaggtacccagctgtggggaaaacacatgttgaccctagcggatggtagttaaaattaaacgttggaacacaattactaggagcaaggtgttgttaacaacggtgtgacagcacgcacaagagtgcagagtatgctcattcccaaacaaacgagaggaagtattatcacggagcattcaaagaggggcacaacgagaacacagggcacaaccagggcaaaaaagatgcatgattagtacagaacaagaaaatcttgctcctaatattccaaagacaaagccactttacaaatggtggaaacaacgtgtttagcacgcacgcgggggaacttatacacagacagacggnggtatgtattataccacattttgtgggacacatacaacggccacagcgagacagacacaccaggtgtgatgcatacgaaagaaaaaaacaaggaccatgataatgtgaaaccagcagttaactagaacagaaacagcatctatttaaagccgtgtagaggaacacatcaacagtcgcaggtcggtgaagacacactaatagttagtacggatgtaaacacggacacaatgtgggtgtaaatattcaccaacccacgttatgaatgtgctggcacacaatcaacaactgccaacaactagctgtgtgcaagacacacgacgggacaaaaccacacacacacgaacgtgatcgacagcgtgccaatcgatcagccacgcacacacaaagaccgcactatcaagaagcgaagcatcacgtggcaagcgaaccaagcggacatcatgctggtcgaaatcaccaacctatgggagcagacatccggaggaggcgaccaaccacgccgaacccacacagtaggcacacgcctctccacccacggtgaaacacccgctacctccaactaaaacaaaagaacggcgcgagctcgacgcccagatcaacgccaacgtcggctgagccagcacacaacaccgtgagtagatcagcagaatgacgctaacagccagatcaagaccgagacacagaacaaacgacagatgccatccgagaggctgcgccattgcatcatcgcacgcagcgcacgacccaagtcagacgcacaca

SEQ ID NO: 673760 - DNA, 435 bp, Homo sapiens
  misc_feature (52)..(52): n is a, c, g, or t
  misc_feature (156)..(156): n is a, c, g, or t
  misc_feature (408)..(408): n is a, c, g, or t
tggggaggaggggagagtgggaagcagggaggaggaagaagataaaattganctgacaagtgattcgttggggggaaatcgtaaaaacaaagcaaaacccgttatgagctgtacactgtgatggtgctggggaaacgacgtggtgactgaggattntcttaaaaaaaaaaaaatcactgcggacaaggtctccaaaaaggaaaaaaggtctcttcgcgtctctccctccctcctgctcactcgggttcttcggtgtgaggacagaaagtctacttctggctgtcacttgcaatattattcttcaataaccccgaaaacgcgcattgggaagccacctcgcctcccttccaatcacccccacccccctcgccaacaatcgcgactaatattaacaaaccttaaactttncccacagcctcgacccccaacgagggc

SEQ ID NO: 673761 - DNA, 861 bp, Homo sapiens
tcgaccacggcgtcgcccacgcgtaccggcccacgtcgtcgtgcacagtggtttttaattattttaggatgggtgggtagggtgcaagtgggcatcattatttaatctctactactatttttgcagtacctatttcagaatatctcaaactcaatcttaaccgttaccctgaaaatcgattccatatcttgcattacattcataccgttcattgattcttcttgactgcgcataattattatccaaccaccacctccatctcttccaactgacgttgcaaatatcaagaaggttactgacagatattccagtcaggttaactggaacacaagactagacgaaagattgtggaagtctatcagcacagttatatatctgaccgtcatgcagcaggcttactcagaaccttaccagggacacacagttaccagacgcacgccagtatccaggggcaaccattctgtgatgacgcggactcaattatcagcccacaggtggctgtcgacgtgcttgcacatgtggcctacgtctgacctgatctaactaccaatttatataaacttacttattttgacacacggaggttctacgctattgttcgacacacaagcttgccaatggcactaagtatgtgactcttgtcactccctatgcaatctcttgcctacccacggagaaacaacgccaccattactcatgcgtgcgactacagcatcttcaccaaagtactaatgtggcattcacaccgggtacaccacgatcaacaaaggcatcacgcatcaattctcagggacatctagcttacagcacagaaataggggattaccacacgattttcctccgtgattatgtcccgcaatc

SEQ ID NO: 673762 - DNA, 151 bp, Homo sapiens
tagaggatccccatcctcatcagtggtacacagaagcaggcacagccagctcgagtggcttgaggctgctggtgcatacagcacactcgcgcgtgcgcgcgcgcaacacacacacacacagtcgccttcctccaccctgggagccagcccc

SEQ ID NO: 673763 - DNA, 106 bp, Homo sapiens
cactaggtgcagttcagcctgcgatgtatcccactctacaccacgacgctaggtgcctcagtgtaggccaaactctggagtcactgactaggtttagactattcat

SEQ ID NO: 673764 - DNA, 310 bp, Homo sapiens
  misc_feature (14)..(14): n is a, c, g, or t
  misc_feature (16)..(16): n is a, c, g, or t
  misc_feature (84)..(84): n is a, c, g, or t
  misc_feature (291)..(291): n is a, c, g, or t
aggcaaagtgcctntnacatccaggtagtggcgggaaacgcatggggctgtgtcctgctgtcagagagaagctgactttgtcangtgaacctgggtgttctgctgaggggatctccagacagtggaaggtgcagcctggcctgtttctgctgcttatggtgaaatgtgagcagaagacctggacattcagctgaggagatctccagacagtggaaggtacagcctggcctgtttctgctgcttatggtgaaatgtgagctgaagacctggatattcagctgaggagatctncagacagtggaaggtgcag

SEQ ID NO: 673765 - DNA, 391 bp, Homo sapiens
  misc_feature (391)..(391): n is a, c, g, or t
agcttatctgtcaggtatatcagaatctcatattcatagtctcataagacttggttaaaagcagatctatcttaggtaggaaaaaatagtaatcgattatacttagctgcttttatctgtagtgtgggtgactttttataacctattatgttttataatgtcttcctgagagaatttcctaatttggtagttcatataagagaaatacaattttctagcattttctggaccttacaataaatcaattcatgacatgcatttttaagcagaaataatttaaagggtcaggcattaagaccgaagcaggaattcaaaaacgtggcgtatttactttacattggaatatcatgcaaataaactcagaaaatgtcaccaaatactgtgggctaan

SEQ ID NO: 673766 - DNA, 231 bp, Homo sapiens
ttttttccccttaaaaaaaccggggggggattttttttatggacccccaatcccttttaaattttttaaagaaaattttttggggggccggttttcccccccttaaaggggggccggtattttcgggtttccctttttgccccccaaggattgaaaggtttggtatttggtaaccccggtttggtatttggtttttttagatggtttaaataaaggtggttttttccttga

SEQ ID NO: 673767 - DNA, 299 bp, Homo sapiens
  misc_feature (113)..(113): n is a, c, g, or t
  misc_feature (221)..(221): n is a, c, g, or t
  misc_feature (237)..(237): n is a, c, g, or t
gagaatctttatgtctagctccgggattgtaaatacaccaatgggcactctgtatctagctcaaggtttgtaaacataccaatcagcaccctgtgactagctcagggtttgtnaatgcaccaatccacactctgtatctagctactctggtggtgctttgggaaacctttgtgtggatactctatctaactaatctggtggggaggtggagaacctttgtntctagctcagggattntaaacgcaccaatcagtgccctgtcaaaacagaccactgggctctaccaatcagcaggatgt

SEQ ID NO: 673768 - DNA, 212 bp, Homo sapiens
tagcctgagcaccaggtcctgcctgaggacatgcacgctgtgcttacttacaacgtgtatcaagtggtcccacgtaataccagagaggccaccatagagaagatcatccgctgtcctgcagggccgcttcctcacggcgactcatcatgcaggctctgacaccagatttgcactggtgctgtacccataggttccaaccatacccagatccc

SEQ ID NO: 673769 - DNA, 523 bp, Homo sapiens
tacagagggcaatcagccgggtttgaattggatgcaaagggggtctcgtgaaggcgtaacgttatcattatgttctttccaactgtgtgtcacctatgaccttttctgatggagatgcattttcttatttccaggcgtaaagcttcctaatgtgctgtgcgtgcttcctacccacccaccccgagcagcctgggcgggcagagactggggctccatggggactgtcacccctgagccctggacgggtgcattgcgctgggagcatgcctcagcagcgctgaagagtgggacggcaccgatgaatggcagaagcttggagaaggccgtccaacccgtgcactggctcctgcagtctgctgactttggctctgtcccattgttccatcctcgtgctcgtccagggctagctggacctctagcttcatgcgcgaccagcgtagctcgcctcgctcgccttgtctcttcccctctgttcccatggccatgttcgttgcccttgggaaccaggatgatcacaaggcca

SEQ ID NO: 673770 - DNA, 399 bp, Homo sapiens
ggtcgacgcttcatagaatgatttagggaggattcctctttatcttgtggaatagcgtcgataggattggtaccaattcttctttgaatgtctggtagaattcagctgtgaattcatctggtcatggcttttttgttgtcgttgttgttgttgttgataatttttgtattaccattttaatctcgctgcttgttattggtctgttcaggctttctaattcttcctgacttaagctaggagggttgtatcttcccaagaatttatccatctcctccaagttttttagcttatgtgcataaagctgtttgtagtgccttgaatgatcttttgtatttctgtggtgtcggttgtaatatctcccatttcctttctaattgagcttatttggattttctgtcg

SEQ ID NO: 673771 - DNA, 863 bp, Homo sapiens
caggcgtagcagagtggtcgttgtcttcataggtctcagcccggtcgtcgcgacgttcgcccgctcggctctgaggctcctgagaagccgaaacccatgttagactttcctccttcccgcccgtgccctgtagcgggctgttgtgtgccacttccgccaccatgtaccgaggcgcgccggtggtccaagggctccatcctcagagacaggtgttggaggcacctcaaggggaccctcatccaagggaaggcctgctggggaatatttaggctcccaggtggttgtaacccctgcagaggcgagtggcactcgcccacaaggttctctttggagtgcaagcctcaccccgttgcgggctcttgaaggggacttcgacaacacttaccccgtttgcagaacccggaaagctctgccactagtgggcgtagaacttccaccacagttatttggttccaaaacattactaaaatttgcgcccgggcaaatgaaagattatcatttacacataatggccccgaagatcacggcggaaataccttgggccgcatagttacctttgagcggccacccaaaccagggagcaaatgttccaagaccatatgaacaatggcaggtctgctggcctcaacgactggtggaaccacgtggggaaattccaggaaccagggacttacaagctggtgctagtacaagactgccttcctgggtgaaattagcaggttattgcccagagatcccaggcataatgggagatgcggcggaattcccggtgcaaacgacggatgtggaatttcctgccggggcgcacttggaatggcacttaattgcaccaacattagtccacagagggagctcgccccgag

SEQ ID NO: 673772 - DNA, 327 bp, Homo sapiens
tggtgctctgctgttaccacgccttcgtctccgagtttgcgactcgcggaccggtgtccccgagtgcgaagcaggtggactcgagattctgttgcctgcagcaatggctgccatccgggaagcaatgggtgatggtgggtgatggagcctgtggaaagacatgcttgctcatcgtcttcagcaaggacccagttcccacgaggtgtatgtgcccacagggtttgagaactctgtggcagatatcgaggtggatggaaagccggtacgagttggctttgtgggacacagcttgggcaggacagattatgactcgcctgaggccccctc

SEQ ID NO: 673773 - DNA, 324 bp, Homo sapiens
ggtccatgcttgtggaggcatgaggacagcaatggttgtatcaactatgaagttgtgaggcatatcctgtcggggtgacgggcccatggggcggagctcgtccgcatggtgctgaatggctgagtgaccttcccagtctccccagagtcctgtgcctttcccttgtgtgaatttttgtatctacgcctaaatgtttcccatagtgctttctatgtctcatgcaagctttcgccatctctgtctcgttctgcttgtagtgggatccatctagatgtctgaccttgcatgtgcatgcaatgcttgtgcacttggccagtctgtttt

SEQ ID NO: 673774 - DNA, 822 bp, Homo sapiens
  misc_feature (815)..(815): n is a, c, g, or t
tcccaaagaagcatctgaagcgggtggcagctccaaagcattggatagctggataaattgagacggtgttgttttgctcctacgtacattccaccgtgtccccaacaatgttgagacgagtgtctaccccctacatacattttgccttgacggagacagcacttaaagtatagcccctggacaaggacgactgaacgtaacagacagattttgcattgcacgcgtgtatcacttacaaactcgcatggcacaggtcctgacactgcatatacaccgtacacctggctgtgacttcattggactggtcattcagccatttgaccaacgacggtgacgagcaattttccggtcttgactctactgacacccaaggggtcgctattgcgtgtacagtcgctattacaccctgcaggcaggcccaagtacaacgttcgtgccccatgtggcgaacagaattctctggtggggcaccaaccaggcaatcccctcatactgtgtgacctcactgactgcgccggcaccgatccgggtataccccgaattgcgcctcactcacaggttgcaatgtatacgcacttcacgaatttgattctgggagaactgtgcaaagattacctagatttgcattcaaagcttcagacacctgggtagcgccggtgctctacggcgacatggacggttgcgtaccctacggaagaacttggtggtgcatcccaaccacgagacgaaggcgccctggtctattgaccgctggtcaccagtgacaggattgccaactggacccgccttatgtcacccacagctttccagcatanatagagg

SEQ ID NO: 673775 - DNA, 84 bp, Homo sapiens
  misc_feature (27)..(27): n is a, c, g, or t
aattcaagcttctaacgatgtacgggngacatgacgtaggattgtgtcacgtggtttcctagatatgccatccaaagtacaaga

SEQ ID NO: 673776 - DNA, 113 bp, Homo sapiens
  misc_feature (32)..(32): n is a, c, g, or t
atcacgaaaccctcatcacccttcatcgaaancctgtatacaagtagaccactacagccatttaggtaagggttgatgacagggtttaatgagggttaatgacagggtttgat

SEQ ID NO: 673777 - DNA, 325 bp, Homo sapiens
  misc_feature (97)..(97): n is a, c, g, or t
gcggagtgatgctgatgtcgatctagaggatccggcacatgtgcggatctggtggagcggacatcccctcaattccaaggctatggactcactttgnacaaactcctaccaacacgtaccaataaaagaaaagggtggtttttttcttttttttttttttttttttttttttttttttttttttttttttttttttttttttttttttttttttttttttttttatttttttttttttttttctatcccccccactcttttttttgaaaaaaaacggggttttttttttacaaaaaaaaaaaatttggtccccccaaagaggggg

SEQ ID NO: 673778 - DNA, 228 bp, Homo sapiens
agtggtacacacgaagcagcgtgacgttgtttacacaagcaagcaggctaggcatctacagataatccagtaggggctggaaactatagtgcaggaatcatcaactagattcagccgcgggccgatttgtttattgagcagatggtcggggggccaaaaatatttgtagactgcaaacagatatgtttggtcgacgcggccgcgaatttagtagtagtaggcggccgc

SEQ ID NO: 673779 - DNA, 1011 bp, Homo sapiens
tattgggtttataaacgccctttaataaacccctttttagaacaaaaaaaaaaaaaaagtttcaaaaaaaaaaaaaattaaacaaaaaaaaaataactggatcaatttttcccagaaaagaaaaatgatagtccaagggcggacaagctgcagaattgcgtcccacgaaaatcagcggctcatcattgttgacctgttatttctttcacacaaaaactgacaaagcaaagagatcacacatcccggggagactcagggcgcgtgggcacaagaaccacaacctgagtgtcgcagttctcacccagcaacgaattgttaacacttgtagagaagccaaacagccccactcgcggcgtgataatgttacgagccaacccgcgcaacactcccaggggtggagggcacaaaccatcacgagggcgcacaaatagtggataccccgctgtgcgccgagagaacgccatcaccgccgacaatctacacccgtcgcgagataacaccgggtggtgaccaacggtggggaccccacgctgcgcgttgttacaaactaccgcccaaccacgccttaaactattataaaaccgctgcggacgcccctgatcataaagaccgttggggcaccccagaccagaaagagaaaaattccatcatataatggatcgcggggacaacaaggagggtgccctggcccccaacgtgggggcagtcccccactgtggcgaagccgcggccttcgagaaaagaaaaacatgggcctgacatacagaaccctcagcgtggatccacacacgtgagaggaagagcctccagaaaccttccaaaaattaccggacgtgcacgaaacgaacttgacctggctgcccaaaagatcccgggaacagcggtgccattgggtccgcccaagggggggcaggccacacgtggtgcaaacgtacccgcccagcaagtgggatgcaacgcagccacagagatatgccacatacccgtgagggaccacccgatagagcgaag

SEQ ID NO: 673780 - DNA, 252 bp, Homo sapiens
atgtggataagaaagggactggaagaaagcaatcttttaagatatcattataggccaggcgtggtggctcatgcctgtaacccccgcacttcaggaggttgaggcgggcagatcacctgagctcaggagttcaagactagcctgggcaaccccgtctctactaaaaatacaaaaatcagccgggcgtggtggcacatgcccgtattcccagccactcaggaggctgaagtgtcaacgtgggtaccgagctcg

SEQ ID NO: 673781 - DNA, 220 bp, Homo sapiens
gctccagcagtccactggggcatgcaagctggccaaaggcagcaacatgtgcacaacacaggcttctttccgcaggttttcattcaatgtcaagaccttcaggcatgttgtcaggcaatggcagcagcaccagtggcagtggccccaagtgttgccacgcaaatgttcaaggtccatgcagcaggtgggttctggccaaggccagcgagggcatcctctc

SEQ ID NO: 673782 - DNA, 233 bp, Homo sapiens
gcgcttttacaacacagcacaagctcctggcagcgtgtcatccgggataacttggagcgagctcgtgctgactcgatacaattgatccgcaagcgggaaaaactcaacagggagacgatcaaggtacagaagattgccatgagagatgcaggcatagactccctttcctcaatccctccttccgcaagaaaccttgggagacaagctcccaaggaggaaaggacacaagggca

SEQ ID NO: 673783 - DNA, 315 bp, Homo sapiens
caaagaagggggaatgtgggaaatccccgatttattagctttgtcagccagaaggaccaggtcacaagtttgagggcagtcttggggactgagccaacaacctgtgtgatctgatgctgtctccaggtagggagtgtcagaactgagttgaattggaggacagtttcacccagggggtgtccatgcagaactacttgcttggttggtgtgtggggaagccccctccccacatttgctctcagaagacttctgtgttgattgttgtgttgtgagagcagaggaaaagtttgagtatttttccacaccatgatgtta

SEQ ID NO: 673784 - DNA, 122 bp, Homo sapiens
cacgtgatagtaggtgtacttactgcaaagtagagagtaatcccatagacaccagtttcatttgcatcagcgggcgttgcagcaggagtagcaggagtcacccctattaccagcattgctgg

SEQ ID NO: 673785 - DNA, 688 bp, Homo sapiens
  misc_feature (21)..(21): n is a, c, g, or t
gggaggccgaggtgggaagantgttcaagagcagtctgggcaacatggtgagaccccatctctacaaaaaaaattttttttttaattagccaggcgtgatggcacatgcctgtggtcctagccactagaggctgaggtgggaggatcactggagcccaggaggtcaaggctgcagtgagctgtgatcacaccactgcactccagccttggcgacaaaccaagaccctgtctcgaaaagaaaagaaaagaaacattaggcaaatcccaacagggggacactctacagaaaaaccgaccagccctcctgaaaacttcccaagtcatcaaaaccaaggaaagtgggctgggcgcggtggctcacaccttaatcccagcactttggaaggctgaggcgggcagatcacaaggtcaggagtttgagaccagcctagccaacatggtgaaatctcatctctaaaaatacaaaaattagccgggcgtggtggcaggcgcctgtagtcccagctactcgggaggctgaggcaggagaattgcttgaacccaggaggcgggggttgcagtgagctgagatcatgccactgcattctggcctgggtgacagaatgagactctgtctcaaaataaaaaaaaccaaaaaccaaaaaacaaccaagcaaagtctgagaaactgtcacagcctagaggaacc

SEQ ID NO: 673786 - DNA, 150 bp, Homo sapiens
ctgcagttgtcgtgagcagagatcgcaccattgcactccagcctgggcaacaagaacgagactccgtctcaaaaacaaaacaaacaacaacaacaaaaaaacagcctcccgacccccaggcctcacaaagctcctcacgacaactgcagc

SEQ ID NO: 673787 - DNA, 146 bp, Homo sapiens
tacttgctgttagcgcattcgccctgaagatggtgatcaagggcgaaacctatgagaacggtccccgatcacagcgagtgcgtgatgccgtggtcgcaactatcgcaaccttgtacggcatctggctcgttgttgccgcaggcgcg

SEQ ID NO: 673788 - DNA, 1767 bp, Homo sapiens
gtcactcgcttgtttgactctaccgcctgtacgaactacagataccctaccctaccatgacgatgatgggtcgtgccgtatcgtagatcgcttgtctgccccgtatgcatataggaggaatagacatggctagcagggaacttggtgagaagagttcgcagagcgaagagcagagtgtgggagtcccactgtatactaggctgcgtagtaccacatacgcgtccacttcccacacgatgcatggcaagacatcgtcacacagttgttttggatagtggcgtctgccctccgtgtagacgtgtcaagtgatgtcgccaccatatgaccttggcgaagagtattgtgctcacgtcgaagaggtgctcacaagcgaagactgtgctggtcctatgagctacattcttgtgccagacaggtgagtttgcgtggaagcatggggtatcagatgtgcctcaagtgttagaacgacgtaaacctatcaactgtgctcatatccacgagaccacccgcgaatggggtctcccctagaaattggctcctctgtgggtgcctttgggtatggactttagggcatggcgtaacgcccaatttttaggggctatatttaccccatgtgctagggacgttactttgctcgtcgattgcataaacgatagcttcgcctaggggtctccgtgcgcctttagtcacgttgcaagtacgtacgaatagacgtgcctaagtggggggagggccgagcggatcgtccggccaataaattgtgcgggggtaccttcgccaaacaacacgaagggaccacgccttgcatacgcacggccatgaacgaagtcttacctagggccacgaagggagcgacgccgctgtgagtacccctttggagttggtggggggtcccgcccccgcgggtggtagcggtagacagcccatttgtggtaggcacgccgtaggccaccgccgtgggaccagagtcgccttggcgccacgggatcaggcaccgctggtgttgggtgggccctgtgttggcggctatgggtgtggccgtgtttgtgcgttgccaagtttgccccccgcgtttgggctttgacacgtgcggtcagcccgacgccggtcaggcctgtcgagctttggggagaccgcgaattgggattcccataggccagaagtacattagcttggcgatggttgggcagatatgtggtcccccccccaagagcggtttggtgccccccattgtgcggcgccacgtggtttgaggagaggattgaggcgcacactcggaacgcgtgggtccattggcggcagcatcgcggcttgtgtgcctctttgtgtgcccagttggacgcaccgcgggataccaaccagtttggcacagaacgcccccgttgtggcggtgtgtatcagattctcatgagaggtccatctgcggcttccccctcatttttatggcgtcccgcgcaacatcccttataaagctgtccatgtagacccaaggaagtgggggcccacaggtagtgttgccctccgtgtgtggcagccgttccctagtgtcgccgccggtgtcacacctaacgggttcccagggtgagaccgttgtggtaactacccgcaggaagagtgacttattggtgaaccacaatcctacaattgatgcgccactgtacagtgaactagagaacgatagttacaccccacaatattgtgtgctccaccacaatgagaggcgagcatctcgtcaactaaccacagcagacaggaggagatacacag

SEQ ID NO: 673789 - DNA, 303 bp, Homo sapiens
  misc_feature (47)..(47): n is a, c, g, or t
  misc_feature (162)..(162): n is a, c, g, or t
  misc_feature (188)..(188): n is a, c, g, or t
ggcttttcccgggggggggggggtttttttttttagggccacttttngggccccccttggccccaaattttacctttgttttaaggggccgtttggggcctggcccggggggttttttttcccccaagggaaaaggggcccccccccccccccccggccccngggggggcccccttgggaacccgggnctttttttttggccccccggggggggggcaaaaaaaaggttttttgcctttttaaagggggggggctttttttttttttaaacccccccccctttaatatttttttttttttcca

SEQ ID NO: 673790 - DNA, 580 bp, Homo sapiens
tctgtagaagttctgaagatgtctgcaatggaattcgagtagggcacccctattggttccgaatcggaaacgctctcgaaactgtaggggaagccggacgctttagctaatatgaatctctataaacctaatatgggtcataattctcgtactgcaacttatgcttaagaggcccttaagagattgattaacgcgagaaacgatcctctgaccgaggcagcgaaacggaacgttataaactcgaacttaaaagggaacgaaaccaacgactggccgacccctaagtgggcctgggccttaacgtcggagaacgagtacttcgctaccgaaagtttaaggattttgctctattattaatcttaatgacctcctatctgggaagacgaaccggaaccgaccgttattaatgacgtgtttacgaatcagcttggatagcttttaaatatgtggtactgacgcgacgaccgactctagacctcgctcttcgggtactatgggacgatttacgagaaggaaatggcgccgtgatgttgtaccctaaaaactgcggtagccgtactatgcagcggggggagttata

SEQ ID NO: 673791 - DNA, 792 bp, Homo sapiens
ggggagcatcctggcgtggcgaggggtaccctgtgtgaggcttggcgacgatgagacgtgggtgtcatttccgctgcggaaccgagctagagtgctcgggctataggagacgcgcggctggcccacctggaatcctgagccatgcatccggggattgagattcgtgcctggtcttcagaaggctcgcgttatagcttccgggaggacgcttgtcgcacaccagatggcacctccgaaaggggaaggatagataccaaggaagacacaggtcatctagccgtcggacctccacggtggctgacaggagcaggaatgtatttggtgatctgccatagtctttgcatccttcaatgagcacttgttgtccatgatcgactgagtctgtatctgggcagaagagaacccagtctggccgtgttgactggtggcgatgaagcgtaaaggcagaccgagaatgtgaatctctcaccgatatgcatgcgtatgttgtgctgcccagggatgtggcaccgagaggtgcaaggagctgggtatcacctgcccgtacatatcgaaactccgggccacaggaggacaataggaccaagacccctggagctggggcccagtcaggccctcagagcccttggccgctcgggtatgaagatcgggcggagttgaggatgtcatccccatcgcctctgacagcgagctcgcaggaaggggggtcgccgtggtcgccggtctgtgaaccaagattcctcaacagatctgctggttcatacactttgcccttcatgttcgatcttggtt

SEQ ID NO: 673792 - DNA, 171 bp, Homo sapiens
caagcgatagcggggccgtggccgtgaatgttgatgacacttgttttccctggtctgtgctgttgcagtctgtcgtcaccagccttgtttttagtgtgtatatatgtcgcccccgtgatgcatatatacacaggtattaaatatatcgctctatataatattatatatgtg

SEQ ID NO: 673793 - DNA, 258 bp, Homo sapiens
aaatccatgtgctaggcaacctggatacagtaagagattgtgatgacatacagagagcacgattattgtgcaccgtcgcggtacctgtactacgtcagagtgtaaactaaacagcactatacttgccttataggatcatcgtgaagagtaaatgatcacatgcaatataatgtgagtatgtaacataggtaacatatgttcatcaatatgtggtagtcgtctgggagacagagtctcactctgtcgcccaggctggag

SEQ ID NO: 673794 - DNA, 167 bp, Homo sapiens
aatatgtattatgtgtatatattgtctgcagacattattgttcatgccttagaggattttagcatttcattttcgtctgaaggtgaatgatagctatacagtctgtacagtagattatcctctaccaccactgtggcgtctcctcaatcttggcagtgcctgccttt

SEQ ID NO: 673795 - DNA, 178 bp, Homo sapiens
aatatatctgactatatatactaccactgagtacacaggtcatatcaagagaattagtatagccagagcacagtggctcatgtctgtaatcccagcattttgggatgctgaggaaggaggattgcttgtgtccaggagttggagaccagcctgggcaatacagcacgaccctatctct

SEQ ID NO: 673796 - DNA, 426 bp, Homo sapiens
cacccaggctggagtgcagtgacatgatcatgctcactgcagccatgacactttgggctcaggttatcctttcacctcaatttctcttgagtagctgggactacacctggctatttttgtattttttgtagtgataaggtttcacgcctgtaatcccagcactttgggaggcctaggcaggtgggatcatgaggtcaggagtgcaagaccagcctggctaacatggcaaaactccgtctctactaaaaatacaaaaattagccaggcatggtggtgggcgcctgtaattccagctactagggaggctgaggcaggagaatcgcttgaacctgggagatggagggtgccgtgagcagaaataatgccattgcactccagcctgggtgacaacaacaagattccatctcaaaacaaaacaaaaaaaaa

SEQ ID NO: 673797 - DNA, 876 bp, Homo sapiens
agcaaaacaagaaactggggtcttcctctcccccggaactctccccagctagtcttccctctggttcttcctgcctccatccgcccgctgccagatacttgaaatctcgcgagactaggaactagtactgtacgataaatcttttttgtactgtatttattgtgtataacgatttctctcaaaggacaatctgtacatttagaactcttgtaaattaaaaaccgatcctttgtttaaaactgtccaagcaataaatagaaaagataggatcaacaccaatacaggggtggcgcgactcgaaaagggtacacccgccggagggcccccgactgactctcccccccaagatatttgaccagaagctgtccccggttgtcgaagccttcaaaagcagcacagccgaggagccagtggccagacgcgtgggagagcgaaacaaacgtcgggacaggggaggctcctcccccagaaagggaccgttaccatgtgtggcggggggcgaccttttctggcggaagaaccgcccctggcactttaaacgtctccacgacgggggagaacttatagagccccctcgagaagggcgttgacagcgggggctccgcagcgtggcctatatggccgcttcccggacacaattctgcgcctaggccgacaggtgttctcccttctccccggaatgcttcttgttcccccagcgaggttctctgttatttactgggcgccccggccggggggcccactccggggctagcgggtgattgatgcccccgggccgcccgggggggccgctagcagcaagcctagagggtagatagttccctgctgagggtagacgctggccctgctgttgcttgaactgaccgcctgtagccg

SEQ ID NO: 673798 - DNA, 148 bp, Homo sapiens
  misc_feature (3)..(3): n is a, c, g, or t
tgngcctcactttgaccagagacctctggtcccattctgggcctcaaactaaactggttactctggttccccctctgggcctcacccttacctggtgactctggtcaccccatgggcttcatttgggcctggtgaatctggtccttag

SEQ ID NO: 673799 - DNA, 814 bp, Homo sapiens
gtgtctgatgatgaagacgaggacgcaccccaacatcgagacgttgccagtctcttccgctggcggtatcatggcccgggtggaacgcatggaaacagttctcagaaggagaaggaggaactggtaccagggaggcgtgccgcgagtgcatcggcgcaagggggccgagtgccagaggaaacttgaatggagctgtgaggtggccgagtggcggcagaggcatgagctggaagcgcctgcatgccgagtgcactggctagctgcgtcaaggagtgagcggtagctgggaacgcagagagcgtgccaggagaatgcgcaagcaaggatgacagacgcttgcccgtggaacgtggacacgctcagcaagagaactggatcttcaggtccataggaagccaatggggttaaaagtagccgaaagcccgatgaagggacaggaagtgaggaatcgtcagcaggaagtgtgaggtgagcagaaacagaagaccttcgtggaagagttgccgtaggaaactagtatcaagcatctttggcatgctgcgtcgttgggatgacaggcaatgagttgctgtcatgatccacgtctcacctgtgtgtgcagaagtaagaacagccaatattagcttggtcatgtggtgcattgctctagaaggtggtgggagagatgttgcactccatggagcaggggggccacacagacgaatcgttgatgcaattttatcctggagctggacaggagccgtagaggttggacccccgtggctgctaccgggggtacttcactacagattaacgacagccgatcgccagtcat

SEQ ID NO: 673800 - DNA, 827 bp, Homo sapiens
ggtggggaggatcatatgagctagtacagcacgtacttagcacagcacctggtgtaaagtaaatatacatactgacaaaagctggggaagcactgctcaacatatttgcagctgtttctcttcagatagacatataagcctcctaagtgggtgatctccagcacatttaaacttttttacctcagttggagaactgttgaaaaccactgtgtcaaaaaaccgggaataaaatatcagaattctaaaacaaagcaacagtgatggtccttctgggcctaacaatgttgaccatatagcagaaagctatttccagagacaagagctgaaggcctgtaaaaagcgggggttggaaaatcatggaataaatgtaccggtggaatagtcctttgtaagaaccggaaagacatggtatagtggcaaaaacatggactgattctagagaacattatactagtagaaaaaggtctagatacaaaaagaggtacacaccttgttggatgccatgatatttaaagtgcaaaaacgagaaaatctaaaccatggtactggaagtcagacgcaggggccgcctggcacaaggcggtgcagagaaggggcaccaggaccgtgacagggccatggggacgagtgccgtaacgggcccatgagaactgggggacaagggtaatggaatggcctgatcggagggggcagaacggggggaaatatgcggaaagttcggcgtcaacctacaacaacggtggcatgtccaatacgttatacccccggaggcgacctcgacacaacaggccggattccccaaaacatgcgcccggactcgaaacatg

SEQ ID NO: 673801 - DNA, 285 bp, Homo sapiens
aggactctgaaatgcgtggatgggtctttggaactgcatgcgggcgcctacttggcattgtccattgtgacgcacttgtccattgtgaaagcaccaccggtcctcatcacggattggtggagagggagtataaatccccaggtttggtaaaggatggcccagaccgaataatgttcggtggataacagaacctttttgtctccctctgattgctcctaagcctcacgctcccttgccccgtcgtgtactgttgcttccctgatcttctccgtgacctgtagctaa

SEQ ID NO: 673802 - DNA, 110 bp, Homo sapiens
cgtggggcactggaatgtgcatctctccttattagcaagatcctgagtaagaataccctgatcgcatcatgaataccttcagtgtgagtgccttcacccaaagatgtctg

SEQ ID NO: 673803 - DNA, 211 bp, Homo sapiens
tcttctcccctgacagctattttgaaagttggagcagaggatctcgttcaaagaactggaaggggaggaatcagaacctcaggaaatggatatagatgaaatttcgcggttggctgaaacgagagagaatgaagtgtcaacgaagtgcaaccagatgaacttctatcacagtttaaggtggccaactttgcaacaatgtcaggggagaaga

SEQ ID NO: 673804 - DNA, 166 bp, Homo sapiens
tagctcggtaccccagagtccaaacagggccttatatatcaagagcaccatgggcaagccccagcgcctatattaaggcactgtttggactctgggcactgtttggactctgagcactgtttggactttgggcactgtttggactctgagcactgtttggactttg

SEQ ID NO: 673805 - DNA, 114 bp, Homo sapiens
cacgaggagacagcttgactttttgccagatttcttaagttccacctgtggccaaggggcccgttcgcccgcggacttcgcttttagctcctcgagtttcttctgctcctcttt

SEQ ID NO: 673806 - DNA, 399 bp, Homo sapiens
ggacgcgtgggtccggacgcgtgggtcgacccacgcgtcgccgacattgaggacagacacatggtggtgtcctcaatgtcgggcctattcatccaggatgaaggggatgatgtgtggctcaagcaggaagagcacatcactgtgctgcaccgtctccttgtagtcggggtgtacaacttcaccccttattttcctgagagcagaaacctgtggccaggtccatgtctggggagctagccataatactagtgggccagccaagaccgcctgctgctgtgaagcccttgtgccagggcaaaagccagctggccagcgccgatgaacgcccagcgctaccatgcatagaccggagaccccctggaccaaagcacccacagatggaccggctccctcagacgc

SEQ ID NO: 673807 - DNA, 851 bp, Homo sapiens
  misc_feature (25)..(25): n is a, c, g, or t
  misc_feature (62)..(62): n is a, c, g, or t
  misc_feature (72)..(72): n is a, c, g, or t
  misc_feature (164)..(164): n is a, c, g, or t
  misc_feature (240)..(240): n is a, c, g, or t
  misc_feature (258)..(258): n is a, c, g, or t
  misc_feature (275)..(275): n is a, c, g, or t
  misc_feature (279)..(279): n is a, c, g, or t
  misc_feature (309)..(309): n is a, c, g, or t
  misc_feature (327)..(327): n is a, c, g, or t
  misc_feature (330)..(330): n is a, c, g, or t
  misc_feature (340)..(340): n is a, c, g, or t
  misc_feature (373)..(373): n is a, c, g, or t
  misc_feature (384)..(384): n is a, c, g, or t
  misc_feature (391)..(391): n is a, c, g, or t
  misc_feature (395)..(395): n is a, c, g, or t
  misc_feature (408)..(408): n is a, c, g, or t
  misc_feature (410)..(410): n is a, c, g, or t
  misc_feature (413)..(413): n is a, c, g, or t
  misc_feature (427)..(428): n is a, c, g, or t
  misc_feature (450)..(450): n is a, c, g, or t
  misc_feature (452)..(452): n is a, c, g, or t
  misc_feature (471)..(471): n is a, c, g, or t
  misc_feature (473)..(473): n is a, c, g, or t
  misc_feature (479)..(479): n is a, c, g, or t
  misc_feature (513)..(513): n is a, c, g, or t
  misc_feature (556)..(556): n is a, c, g, or t
  misc_feature (572)..(572): n is a, c, g, or t
  misc_feature (625)..(625): n is a, c, g, or t
  misc_feature (677)..(677): n is a, c, g, or t
  misc_feature (792)..(792): n is a, c, g, or t
ctgttgctggtgctccacagctgcncagctccacctccggcatttactggtctcatcctganatgcattggntgcccactcactggctggatgctgggctggttcatgggtggcagaaccagggtataccctttggggatgtccctaacccctcaggaccagangcagcaccaagcagcatgtcacagccagtgctaggatcagctgcaccctttgctgggactctagctctcctcaganggcctcctagggccattncgggcactgtgggtggnaatngggagccccggttccctcattaggtcaganaccagtttggcggggttntgnaggcccagcnttgggccctgttacacgtagtccagaatttttntttccattttntttttantgcngttggatggtttnangtnctcctcctcctctnnctcctcctcctcatcctcctcntnttccccagattcgtacgtnancttctnttttccgccatcagccttggctgagctggaaaanagagcaggcctcttggagcggatggtctgccggatcatgaggnacatggtgtccctganctcgtcgctggtttttttgaggcaccacccatcccgttctgtgcaggaattcnctgccccgtcattgcggtgaatgatcttctgcaactcttccacattcaagtngcataactggtagaacatctgccgatagggtggcaaggccccttcccggaagatgtagacagagtccctcagtgtctgaaggctgaccttgagcttgtacttgctggaagctggntttccgagcaccactcgtcccccgacgggcccaggccctgcttcaggtcatgcatggtg

SEQ ID NO: 673808 - DNA, 1082 bp, Homo sapiens
gctactcctcattgtacccattctaatcgcaatggcatcctaatgcttaccgaacgaaaaatgctaggctatatacagactacgcaaaggcccctaacgtaagtaggcccctacagggctactacaagccttcgctgacgcattaaaactcttcacctaaagatgcccctattaacccgtccacaattctaccattctatcctctacatcaccgacccagaccgttagctctcaccatcgctctactacgtatgaacccccctcacccatacccaaagccctgtgacaagactcaacctaggagctcctatgtatactaaccaactctaacctagaccgatgtactcaaatcctctgactcagggtgacgcagtcaagacgtcaaagctacgcccgtgatcggcgcaactagcgagtcagtgagcccaacacatagtctcagatgaagtcacccgtagacatcattctactaatcaacattcacctacatacaatggctccttcaaacctctccacccttatcacaactacaaagaacactctctgactaactcctgccccatcaatgtaccctagcatcctaaatatgatcgaatgctccagcactagacacaagaccgaaccgacacccgcattcgagcttgccgaaggggagtaacgagctagtctcaggcttgcaacatcgaattacgcggcaggcacccttcgccctatactccatagccgaatacagatcactcacttactacactagtccaccctcaacacactaccaatctatcctaagcgaacaccataactaacgcaactcgtccccttgaaacctctacaccacaatcattttcgccaccaagcacgctatacatatcctaaacctacccttctcatctcctcaaattcaagaaccatacttaccccacgaactccgctacgacatccaagtccatacacctccctctgtcagaaacactgcctaaccaagtcaccccgtaccataccttaaaaagaactaagatacccaacaacccatttaacatattctcacaaaatccacacataaaatcattaacacacacaaccca

SEQ ID NO: 673809 - DNA, 539 bp, Homo sapiens
  misc_feature (28)..(28): n is a, c, g, or t
aatggttaatgtatctgccagctaatantaatggccccggagccgtgaagaaagggagttcgtgctccaacttggcatccttagaaaactgtatgaagctttcccagatggctgttcaggggctccagcagtttaagtctccccttctgcagctccctcatattgaagaggacaatcttaggagagtttcgaatcataaaaagtacaaaattaaaactatcccaggatttggttagtttaaaagaatcagatcgtcatagtctgctacacttccttgaagatgaaaagtatgaagaggtcatggcggtccttgggagtttcccgtatgtgaccatggacataaaatcacaggtctggatgatgaagatagcaacaacatcacagtaggatccctagttacagtgttggttaagttgacgaggcagaccatggctgaagtgtttgaaaaggagcagtccatctgcgccgctgaggagcagcccacagaagacgggcagagtgatgccaacaagatcaaggcaaaaggaggatggcagcag

SEQ ID NO: 673810 - DNA, 785 bp, Homo sapiens
agcgggttgaggggtggaaggtgcctactagccggtgcaggtcacttctagcgcgtgtgctggggtacctggtcgtcatggcaggcggtacttgaccgcaacgagcttgatgaggaagagcagctgcctgagaacggcatcgcaaagagaatgaaggagtttgcactgccacgacattcatgggcatgacatgaatgctgttcccaagcaatgacaagaagaggaaggacagcagtctcaccgaacgactgtggccacagttggacaaaacgaacactggacacacgacaatcactatcgagacgcgaacctggcagcaacttgacacgtctgactacctaccggaggaactaacgcactacgacttctgattcgctgcttaacactttcacgacctctggtcgctctgacgacactcacgccagcctcggcatacttccccacgccacatcaccgcacgacgcggaccccacgacaacgcatgcactcggcaacaacaggcagcgacgcaacgaaccgaactacgcctgcacgacttgcacacttgcacgaaactttacaacacgtgacgccaggcacgcatactgtgcaacacgtcgaagacaacccgttcgcctccacaacttactttggcgccacggcgtaacgacacaagctctccagacaagtctacacaccaaggaattacacaatcctaggactggtcccaacctggttattgtccctcaacccgcccacttagtccacgaactcagacctggacacagcacaatacgggactacga

SEQ ID NO: 673811 - DNA, 212 bp, Homo sapiens
cgatgaagagaagaagggttattggaggagaataaaatgttcaataaaaacagtagagtacttaagcggagggaggagggaagaatctttcaccagaaccaatgccacttgacacagccccatcaataagacctgttgtgacggtattatttgtaggagcattatgaggggccaaactgggcaaaaaaagacatctattaaagaaaagacaa

SEQ ID NO: 673812 - DNA, 1437 bp, Homo sapiens
tcgttcttttctttcttttttgtctctctttctcgtgttgttgtttctttctgtagttttgtttcgtcgttttttccttgtctttgttctttgattgctgttgtcgtgtgtgttgccttcctttgtttggtgtcgtcttttgtttctttattgttcttcttgttttgtgttttgtcgtttccctttttttttggtgtgtatctctttgcttctgtctggctttctctttttcttctcacttttcttttctttgctgtattttgtccttcgtttgtctctcttcctcttttcttgtcgtctgtctttatgtgcttctctctctctttgtgtctgctgtcttagccatctctcctctggtgtgttcatgtagtccctgcgttgttatgtactgggtgtttgatggttttccgtgttttctgttcttgtgtcttgcttactttgtgctttgggggtcctcttgtttcgtatgttctttatttctgtgcaatgtgtctttttcccggtcgctctcttatttgggggttagtcgtgctgttccattgatttgctgtctgtttgaacctttttcttgaactcatttttgatttgtccataactgtgcaatttcttttgaatcagttccatcggtgctctctgggtaatcaaaggattgcattttctgtgtcatattgctccgtatcactacgatttctacccatttcagtctctatccgtatcctatgggttccccttcccttgactgttatattgtgatgggagcattctgaggacgccatcgtgttgccagggatgtcgtcgtgtacgatagttatcatatatgtccggcacggtactgtagtgttttctgttcgacgatgatgtggttgtttcatgctcaatgtaatcgccccttggtagtctctaatcgccattgcaatcatgttatgagcgtctcgtggatggactgtatggggtctgctatgtggcaatgattcagcgacggctcgatcaagaagacaggtgtctggatcaagttgtcaagaggtcatctcgtggctggatcgtccaacaccttggccgagaatggacgatgtttgtagcattaagaggtaaggagctggagtcatgtgtgtgtaacccctatctattcagcggtatctgtatccagggtgccggtggtcccgggcctgggggcttcggggctcagggtcccaagggagggtctgggtcaggccccaccagtctgaggatggtagattaggggccctttccaagattgctgtttttgttttggagcttccagactttgcatcttcctagtatttctgtttgtcagttctcaatttgcctgtcgtttgacaactgctctgaaagttttgttggtgaagtactgaacgcgcttgttatccggtttctacatgcagtagatgaatttatactgccaagtcgtacgagcga

SEQ ID NO: 673813 - DNA, 474 bp, Homo sapiens
ataaaaggtaagtaaataaaagatcactatgctattaacaatttaataacttttcttttattggctgggtagaggtggctcacgcatagtaatcccagcacttagggaggccgaggcgggcagatcacctgagatagggagttcgagaccagctatagccaacataggcaagactccgtctctatcaaaaataccaaaaaattagctgggtgtggaggcagatgccagtaatcccagctaactcgggaggctgaggcaggagcatcgctagaacctgggaagtggaagttgcagtgagctagagaccacaccattacactacagcctgggcgacaagagcgaaactctgtattacatagaaaacaacgacagaaaacgtaatacctgagaattttctacaacaaataacaggtaccatgaacagattcgatagccgtattgaactgaaagaacccatatctaatcaattcctgg

SEQ ID NO: 673814 - DNA, 632 bp, Homo sapiens
  misc_feature (117)..(117): n is a, c, g, or t
  misc_feature (127)..(127): n is a, c, g, or t
caagctgatcagttgtgagcctcaagggtcctcaagttgagcgtcgaaacgtcggtcagtgaatgtactcgactcactatagccaatgtcggtacgtggcatggctatagttggtgncaacagttantatgcctggcgctatatgtatagttaagtctgagctctcaaacttaccttatatcagcggtacaggtggagctctagactagtgctcattgtcagcgcaacggctcatcgcgactgcagatgtcagtgcacgcatctccctgtgcatgtgctctcattaggtgatacactgggtgtcagcattgcgcactatagctatatgctatggatcaatcaggataacctccttaatggcgtatgtgtaatcatcatcatctcagtaataattcagctctctcagagctccctagtggcgttcagctcgctcctctgccagtatctcaaggcttcaaccacactttactgtgttcacgccatgatggacaggcttgccgtgagtcgcacccataggaactggacgcatgcgccctccgcggctaacacgaaccctatatacaacgtaaccttgcttggccctgtagcacagtcggcgcgctataccagagcgcgtgctgcgggcagcgctg

SEQ ID NO: 673815 - DNA, 754 bp, Homo sapiens
ctacttctacgatcgcgagccggccgtgcaacaggctctctcacaacatggtgctcatggaaacaacctcatttgctgttctagccaaatacatctacccaaaaaatgaccctgctttgccacgtcttgccatacagctgcatgaaaacgtctggccacggaggccccaacgtacagagtagtagcaaagtactagggcaatgatgcggcagcccagacgagatgccaatcacggaccgcgagtggcaagaacgcacaactcgagcgacagtgcgcactccacaagatcagagataaactacgagaacctacacattagagagccaaagggtagcacgaccccaagaccagggccatcactccgaaactgataagcattgataaccatggacacgataaacacggacctagcgccacggagcactgagacgtacacaagggaacaattacaaggagaccatagcggaactggttgagacgcaatgaacatcacactgacaaggaggcactggaacgcatagacaggacatatcaccacaacaagccacaagaatccgaataccctagggagacaagcaacacacaaatgactagacacaacagcatggcccggacaataagacccataatatatgacactagcctccaggtagagcaagagaatcaggcacggcgaacaagatggacaaacgccagagtcccatcccgaaacaccaacaacccgaaaagtaaaaaggagacaaactaaacaaac

SEQ ID NO: 673816 - DNA, 116 bp, Homo sapiens
cggcccgatatataatatactataatcttcaaaatataataaaatatgttatcattacgaaatatatctgataaactattctataattattaatagatgagatatagtaatataga

SEQ ID NO: 673817 - DNA, 121 bp, Homo sapiens
tgtcctagctctggtcataatttctttttttttgggttaaaaaaactctcagccagtagaagaggatcaagtcatatttcacataaaccaagtaaatatacaaccttccagatctacatac

SEQ ID NO: 673818 - DNA, 150 bp, Homo sapiens
cattcctgctcagatgtgctcagccctctcttggcccggctgcacgcctcccttcccccaacctgtggcctccaccccaggcgggatcagatatggtctttgtctttctgcctggttgctcccgttcaggggataaaggctctgtgtctt

SEQ ID NO: 673819 - DNA, 584 bp, Homo sapiens
ccttaggtggttgtgggtagcatggcactggggtaagttgggaggaaggaggaaggagagctatgggtaaaagaggagaaaataatggccctccattatgtctggttctctttcaagctaacggtgatagttatggtagtagcggctgcactgaaacgaaaaacatctctaaaaagaaaagttgagtgcttttatagaatctttagatcttacaagatgggatgagatctgggaggacctgctaccttgaacttgctcacaccttcaccttcactggtggaaatgaaggactatggttattaatggaatgatcaagagacccgaacctgggaatacccagtttattcttggcttccctatgctaagaagctaagaatactgtcatggtcaacaactatagactctcttcatctttatggaactctcaagtggctatgtcattgggaaagtcaccatggccctgcctactatgagtttaatatgcattgcttcaagccaatgtaagaccagagtttctcagccttgacattgttgacatattgggccagaaaattctttgtcgtgggggctcttctgcgcattgt

SEQ ID NO: 673820 - DNA, 368 bp, Homo sapiens
  misc_feature (215)..(215): n is a, c, g, or t
  misc_feature (292)..(292): n is a, c, g, or t
  misc_feature (357)..(357): n is a, c, g, or t
  misc_feature (367)..(367): n is a, c, g, or t
ccggagccgctgccgccgcccccagctcccccgcctcgggagggcaccagggtcttgctctgtcgcacaggctggagtacagtggtgtgatcatagcccactgcagccttgaccaccctgggatcaagtgatgctcccacctcagcctcccgagtagctgggactacaggtcactgcagccagaggggtccagaagagagaggaggcactgcctncactaacagcaactgcacccacgatgcagagcatcaaagtgcgtggttgtgggtgatggggctgtgggcaagacgtngcctgctcatcttgctacacaacttaacgcttttccccaaagagtacatcccccaaccgtggttncgacaattanc

SEQ ID NO: 673821 - DNA, 156 bp, Homo sapiens
tggctcacacgtcacgcatccagtccccgagtcgtcgacagcgactgcccgtcgcggagcaaataacgtcgaccctggtcgccgcactcccgccctctccaccttcccgcctccctccgttccctctcctcgccgctcctgtggcccgccctgggg

SEQ ID NO: 673822 - DNA, 325 bp, Homo sapiens
ttggatcccttataaagattatagcaaatgggtgtggtatttttatgtggcaacataagaattttagccctccaactagcactattttccaggaatgttgaagggggaataaggtatattgaatgagtttatgttgcccagaatacaaaaagtggaaggctgaataaaaaacaagctcctgttcaagtgacctccctgctttttgatgaccccccctggctatgccccatttttggtgctgaatggatgcccaacacgtccgtactcatttgggcttcgatgcagttgttcaatttgaaaagtaaaacagtcctttaatggtcca

SEQ ID NO: 673823 - DNA, 877 bp, Homo sapiens
agcgggtttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaaggatggaggaggagcagcggcagctggcaggaggagcctgcccccggggtccgcagcgaccctgaccagtcggcctgccgccgctgggccccgggggatccgaaagagggaatgggcggtccgggctccacacttagcttcgtgggcaaaacgcagaggcgggaacaaactagccctcaagacgggaatagtagccaagaagcagaagacggaggatgaggtattaacaagtaaatggtgacgcgtgggccaaggtacatggcagaagtgaaaacagtacaaagctcaccagtgcggtgacgatgataaaactcgggcccctggtgaaatgacgcccctcccccaacctgcccatggcctgggactctctgcggatgtacataactatttaatgcagcggcagcgggcgacagccttccctgagaggacttaaaagcagaaggaaaccgagatgcttcccgcagcgtggacgattctccaggactctttttttaccttgagcacttgcctcgtgagacttcatagaacagtggttacttggcccccttttactcttatttttgtggctctatgtcttctctttaccctcttccttcccttagcatcagtctggcagtaaaactgattatgcgg

SEQ ID NO: 673824 - DNA, 1822 bp, Homo sapiens
tgtcggagcaagatgtattcatacccacctaggctgggggtcactagtgacaatgcaattcgtttatcagtcaactcattatgtcccagaaatagaggttccagtcaagtggttctagcaggacacggaaagccaagtccgtgataggccactcgctacttagccaagcacatggagctttagaaaataaactggtggacaatgcacgatctcttcgtccttctgggaatggacaagattatgtacttcaaagcatactaagcctgattagaaaagtactagtagggatattgtatactgtggcagttgggagggtctttagccttcataacagtgcgtggatgctgacgtgtgtaaatgcttgagccacaaacttgtgagaataagtgacgcttggcaacgctggactatgctcattcataaggacagaaacttctgtctccataaattctctggaacaactgggatatcagttcctcattcataatcaggcaatttcttcctgaaccagatgtcaaacacagaggatagagtagcacataccactagcatacatgagcgtcagcacggacagacggggcacggcacacggaaatgatctacaggggagcattcccgcacaaaaggaccagtcgcgggcgaaggtgctacgccacgtcacctggtccggagataggcaagaaactcgagcgagacacgcgtacaatcaaagcgtgagccggtcaaaacgcaagggacccaggacgagtcagggcacagcagcaaccacctagatacaccagggaaccacacaatcaataacatcatcacctcttcttcgttccctttctcctctctctctatccttactactcatcaacacaaacacaagaacacgacacgaacaccatacaacaaccaaaaaacaactacaaaaaaacaaacgaaaacaccaacaaactacacaacatcaacaaaacaacaaacaaacaagaacaaagcacaaacaaagacacaatcagacaaaaaacacaacaccaccaaacaaaagcaagcgagaaaagaaaaagacaaagagcgcagggaagcgaagacaagagggccgctaaccggaaacacacgaagcactaagaagcagaacagagacaacaccaagaaaacacacgagaaacagggtcggagcacggaggagcgagcgaaggacagaacgaggaaaacggcaaacaggaaaggcacaccgaaaccaacgggagccgagagagccggacagaaccgcacacagaagaggcagacaacaaagcagcgagaacagcagcacgacacgagcaacaaccgatgagagcgggacgaaggaagcagggcgaaggcagcgaccaggacgaagagagcagacacgccacaagaaaacgagcaaccaccggcagcagcgagtgagagaagacaagcacggagaggagcagaggaagaggagaagcaaggaggagagagggaggagagaggaagacagaacacggaagcaacgaaggagcgggacggcgaacgaagaaagcagaaagagaggagacagaagacacgacagcagcacaaaagacaaagacacgaagaagaggcagaagcccaggcaggacacgacgggagacaaaggaaaagacggagccagaagacccaggagcgagacagagagcgaaaacaaaggaaagaggaagacgaagagaacggagaaggagaaagaccaagtaaaggaaaaaggaggaacagaagaagacacagaacgacagaaaacgccacagcacacgaggaagcacgaagccacaaagacaagtaaagagaagagagaacccaa

SEQ ID NO: 673825 - DNA, 445 bp, Homo sapiens
  misc_feature (12)..(12): n is a, c, g, or t
  misc_feature (63)..(63): n is a, c, g, or t
  misc_feature (74)..(74): n is a, c, g, or t
  misc_feature (80)..(80): n is a, c, g, or t
  misc_feature (83)..(84): n is a, c, g, or t
  misc_feature (92)..(93): n is a, c, g, or t
  misc_feature (171)..(171): n is a, c, g, or t
  misc_feature (186)..(186): n is a, c, g, or t
  misc_feature (258)..(258): n is a, c, g, or t
  misc_feature (296)..(296): n is a, c, g, or t
  misc_feature (334)..(334): n is a, c, g, or t
  misc_feature (341)..(341): n is a, c, g, or t
  misc_feature (348)..(348): n is a, c, g, or t
  misc_feature (351)..(351): n is a, c, g, or t
  misc_feature (353)..(353): n is a, c, g, or t
  misc_feature (366)..(366): n is a, c, g, or t
  misc_feature (375)..(375): n is a, c, g, or t
  misc_feature (385)..(385): n is a, c, g, or t
  misc_feature (443)..(443): n is a, c, g, or t
taaattcgtgtncaaactaacacgcacgggaacgggctccagctgcagctccctgggtctgtnaggccggggancggttntannggaagagnnggtacgtgccgtgtggcaggcgcccgctccttactcgacagggcggtctggatgtgctcatacgtgggcaggtcagtnaggatccagggtggntactgcggtttggctcggagcatcttagaagcgactctcgttcacatcttccggcttcacgttgcggatgancgtgcacagctcgtgcggtactttctggagcgagtggncagcacctgcctccccacatcctcgaagatcacaggcntggattncaggttnatnangagcattgatgtnagctgcgtnttggctcgtnccagctccaccgtgtccacggttccgcccattaaaataaactcctttgtgatgatttnta

SEQ ID NO: 673826 - DNA, 128 bp, Homo sapiens
  misc_feature (89)..(89): n is a, c, g, or t
tcaacggtcggcgaacatcagggagcggcacatgcgttgggagcggcacatgcgttgggagcggcacatgcgttgggagcgggcatgcnttgggagcggcacatgcgttgggagcggcacatgcgttg

SEQ ID NO: 673827 - DNA, 753 bp, Homo sapiens
cgacccagaggggaattgcaagtgcctgggggacggtggcaatgggacacgcgagccaacgcgcaccgtgagacgccaggctggctgggctctgcccgggtggcggccctgggagggatgtcgaacgaggtgccccgagatatttggcgtgccgacaccttcgagggccagccctgacaagcgtcgcccaggccgatgaaggataagccagagaccggcagaggaaggcgctcaactcgacgccccgtgcgggtcgagggctgcaggacaacaagcggggtccctgtcccaggccccgggacaatcgtgtgcaagcccagacgacaagatgctcgtcttgagaccccggtgtcgtcgtcggagtgagcccgacaccacgttctccccaaacagtccccaagccaccagctggtgatatccgcatgtgataaggcacttctgtccaattacaagtggaccaggccagaaagatctataatagtccccagccgcatgtggggatagatgaggcgcgacagaggccattcacggtcttgagggaacctggcggcttgtaatgtttatccgtgttgaaaccttttcgtcctatcctgggtacacgaagggaactgttctgcccacggagcctgagcctcaggctgttggagaagcatctgatagcccttttctttgctgggggtcttttacgtgagggtccttggcgttgtttaaggtcgcactccacccaataccagccacccgctggggccttga

SEQ ID NO: 673828 - DNA, 842 bp, Homo sapiens
  misc_feature (398)..(398): n is a, c, g, or t
  misc_feature (752)..(752): n is a, c, g, or t
gccaaaaattcaaaaattagccgggcgtggtggcaggcgcctgtaattccaggaggctgaggcacaagaatcgcttgaacccgggcagcagaggttgcagtgacctgaggtcacaccattgcactcctgcctgggcaacagaatgagactctgtctcaaaaaaaaaaaaaaaaaaaaaaacttacttcttctaattaagcgcctcaatatttaattttttaaccaaggtggggttgggtaccaggtattttcttttggcccattgcgggcaaattccttggtttgggccagcgcattttcccattaacttcttgggccaaaggtggtcccctttgattgtggcacaacggtttaacaggcttcttggcaaatgggttccttgggaggctcctttaaantcctattaaggagtggttttttaacacaacttttttaccattattaaatttcggtggccggtaattagcgctcttttaaaaaaagaaaaaaaaaacctccgagagggccatccataaggcacggcgggcgcgggaaaaaagagcgggtaattgagaatggggcgccatgggggcaatatagcggtggtttctcccgtggacccacaggtttctctttgtgctcaccaaggggcggggaaaaactccgcgcgggggccccccccaatatagtaggagagagcgcgcggaaataatatgccggaataccgccggggttaacccctggggttattgatctctcgcgctacgaaaaangtgatactaccacatgacactaaagactaacagccaagacaagcaagggatatataccaaagtgtgtcagaacataactagctagtctat

SEQ ID NO: 673829 - DNA, 1237 bp, Homo sapiens
  misc_feature (267)..(267): n is a, c, g, or t
  misc_feature (683)..(683): n is a, c, g, or t
acgaagttccacgaagtaggattgtggctccatatctcctgacgtcggccaagggacctcatcttcaagctggaggtccgcgacgtccataataaaggtgtgagtgcgcgcacacaatcgttccatgtctagtctactcgccttgtgagtttcaatgaggagttgcagcccacgagaaggcaacaccatatgacacacaacgtcgcgcgagtggtccttgtcagaggtgtgggtactagtctacttttccttctctctccctcctcncactctctcctgctctgtcactctcgagctggttgactgcaagcttggcacgatgtagcatagggtacagtagaacctgactcacctgttagcacattcgaagattgaaaggaatctcatgggtagtgaaccttcttggaggctccacccaaggggctcatggcgtacccatatcgacctgggggggaaccgagatggagagcgggtcccactgttggtgacatgtggatgtatcgcaccttgatttcttctatatacacgtaccaaaccaggcacacacatatatatacaggcgcggggagagacgtggcactctataataaattctctctccaccttaccgcgagggtaacctaagagttcttgaaggcgtgttatcacagagcgaatatttttagaagccacatagggtgagntctcacttaactagtgggcgagctgtaataataacataaggccaagggggccaagggagggaagagaaaggtttactgtggggaatcgggtgtggaagtacgtgggggtccaaatcgtgggagattgccttgtgggaggagatcaccggcgggtttgacagttgtgacacaggttttcaaacagtcacaggcgagggtgggtctgaaaacactcgtgggtgggggtccaaagatttttgacactttagtgagtagtattttacagaaagtggtttatacgggggtaaaattttaaataaagattttttttcaaaagggttgcttttgatcaagggcacgttctcaacatcctgggtcgagaaatttatcgtcacgcgttcgagatctggggaaaaacatttttggggataaaacacgagagtctaggcgaacctagggggaaactcacagagctttcaccattgcgccagcccacaggcgaagcaaacacaagagatattacgcacaagaagaaatatgaacttgtgcatattttgaaactttttaacccccgc

SEQ ID NO: 673830 - DNA, 235 bp, Homo sapiens
cactgctcggatggcagaccgtgccagtaggagttgaggcacacgatgtaggccattctagcagctccagccatacgtaggcaggaaggccttggtggtccagaactggcccagggtgtagatgctgtatgggacttgcaggatgggcataatcatcactgtccattaggctctatcccatggaccacggcggcatagtacaccaggatggagatgtcacccacccttctcccgt

SEQ ID NO: 673831 - DNA, 222 bp, Homo sapiens
  misc_feature (17)..(17): n is a, c, g, or t
  misc_feature (69)..(69): n is a, c, g, or t
  misc_feature (77)..(77): n is a, c, g, or t
  misc_feature (111)..(112): n is a, c, g, or t
  misc_feature (122)..(122): n is a, c, g, or t
  misc_feature (163)..(163): n is a, c, g, or t
  misc_feature (194)..(194): n is a, c, g, or t
  misc_feature (201)..(201): n is a, c, g, or t
  misc_feature (214)..(214): n is a, c, g, or t
ttttgcgccttcagcgncgacttggtgaccttgcaggcaccgccgctcttcttctccacgttcttaatnaagcctanagacaccgtctgcatcatgtcgcgcacggagaanngccgaaaagngggtactgggagaagctctccacacacatgggctttcccgnaaccatctccacgatggccgcgtctccaganttcaggnacttggggttgtnctccagct

SEQ ID NO: 673832 - DNA, 762 bp, Homo sapiens
  misc_feature (684)..(684): n is a, c, g, or t
aggggagcggaggcacatcgtggctgcagacgtgacgcttcaatcaaggtactatgatacctatatcagaaacttgtttgtgggtcacagactatgagaatacaaatcgaagccacagacatatgcagtcctgatgtgctaagccagagaatcagccacagctgtagtggcagctctttaagctcaagcaaatgttcggttatgcagacatgaatacattttcaaccttcaaattagaagattccaattctgaagtattcgaaacaccccaggccgtgggaaatatgcgaccttaatctggtaataagtcacggatcagtgtgtcagatagttcgaagttccagaatacacatgcatatcatagctgtcaaatgttcttttaactttgtttccaaaaaaatgatttgggggtgttgctaaggtggacaattcgttagtctcacctattgagacgcgcatcgtataataatgacaacacaaggactaggtgggatcattaacttgtacaacattaagctttaaaacacatatgcgggtgggggagatgaattctgccctgttttaaccccacaagaccggaggtataataccggttaatcgctctacgccctgtgaagggggcctcaggccaaatgcgcccagtgctagagggttttcccttaaaaggcgccaaatattaaccgngtgtacctttaaaaacccccgttggggccttaaaaggggggttaaataagtgacttaacgacatatactggtagacaa

SEQ ID NO: 673833 - DNA, 678 bp, Homo sapiens
tcctgaaatgggggcttgccctgtcgcccaggctggagtgcggggtatgactctcagcctcactgcagcctccgcctcccgggtccaagtgattctccgtgcctcgagatcccaagttagctgggactaagggcacaggccaccacaccgagctaatttcttggtatcttaagtggagacagggttccgtcgtgttggcgccaggatggtctcaaaactcctgacctcaggtgatccacctacctcggcctccgaaagtgctgggattacaggcgtgagccaccatgcctggcctgatattacacgacttcattgggggatcccttatatttaaaacataataatagtaattattaatcttccggaaataaggtcgtgtctctgtcaacccaggctgaagtgtaggtggcagggtatgtggcctcactgcggcctccgcctccgtggactcaggccattctcccgcctcagcctcccatgtggctgggactacgggcccaccaccaatgcccagctagttaaggaactcccagtagagagggggtacagcgccaagtggccgggccgggccttgaactcccgagcccaagtgacccgcctggcccggcctcccaaagtacggggaataccggcacgagccaccactctccaaccccataaaacaacttacaaagaaac

SEQ ID NO: 673834 - DNA, 403 bp, Homo sapiens
atccaaatcctagcaaaatcttgtcggctctaccttcagcatagacccccaaatccaaacccttctcaccacttctagctcgagctcctgaaccccactagtttccttcattctttgcccacctacagtctattctccacccaacaggcagaataatgcttttaaaaagttggaccagaccaggggaggtggctcatgcccaagccgggtggatcacttgagctcagcagttcaagaccagcctgggcaacatggcaaaaccctctctctacaaaaaattagctgggcatggtggcacatgcctggagtcccagccactcgggaggctaagagaggaggatcacttgcgcctgggaggttaaggctgcagtgagccgtgatcatgtcaccacactccagcctg

SEQ ID NO: 673835 - DNA, 212 bp, Homo sapiens
aaccaggctcagcttaactgatattatggaggtcagcacggtgctcacgtgtcgacggaacttgtacagggaggcatgcacctgcattggtgaatacacgtcgaccaggctccatctataacgatatttggaggtcagcacggtgctcacagtattgacggaactatgtctagggaggtatgcaaccgcagtggtgaatacacgtcgagctg

SEQ ID NO: 673836 - DNA, 111 bp, Homo sapiens
cgtctgagtgcaattggtcgtcgactggtataggggcgacgctatcgaacattagtagctgtacctccgaatttcctcaggtagctggcgctctcgcgaagctcataacga

SEQ ID NO: 673837 - DNA, 199 bp, Homo sapiens
gcttggatggatcacacaggactgtgtgtgtgagtgtggatgagatgcccgtactgttctttgggatcagtcaacagctcagatgagttaatgggagcctgagatcattgtctctgagacatgctgtctgaggagttggtggttcgagctgagcttcgagggattagaaatgaaggggaaggcaggttcgggactactg

SEQ ID NO: 673838 - DNA, 925 bp, Homo sapiens
ggagtatgctggccttgtgtacatcctatcatgtccagtcgtctcgtcacgggcgttggtggtggtggatagcaggtgggcgggctggtctgtggcggtgcaccgttgtggtcacgggggtgcaggcgccactatgtgcgggcgcctgttgatcgccgctgtgggcagttattggcactatgtgggtagcgtggctgccccataggttttggggccatgggggggcacaattcatttgcgtcgcatattagcccggcaggcgggtgccgccaccatgtgtgccggtgtaatggcgctcgtggctgttcccgcgctggggctgcacctttaaaagggtttctggtcccccggtttttgcgattccaggtgtagaagtgttgaggcgggattagccggtggcgagatcatagtgccgaagtggtggtgatgcgcaataagggttaatgcgttggaacaagagagagtctttctctgtccttgcaaggagcaaccaatcagctgggtgtaatattccccgtctagtggcagatagatgctgacaacacaatcagtggggcccccaaaaatagattgggaaatagtgtgcggcagacgacccactgctgccctgtgtaatacaggccccttctttgtcattgtgggacgtacaaggcacccgcctcgatttggtagaacttcgttgttgtgccaaggtgcggttgtgcggccgatcgttccatatagggacgttgtatatgggtcgtctctcccaccccgcaaggagttgctattttagcaaatgaccgctgcttttttaatggaccccgagtttgatttcaatttttcctctacgatgttacaatttgctttgcaataattctttggtctgacatcagacgatcccccccttacccgcggaaatgaaaatcataattttccacaaaac

SEQ ID NO: 673839 - DNA, 220 bp, Homo sapiens
  misc_feature (51)..(53): n is a, c, g, or t
caggagctgagaaaatagcgacgctatttgcattctgattttcctgctcannncattccagactgagcaatgacccgaaatatgactctttcctatggggaggtgtcctaacctgccaggcctgcctctccccaggacaagtacgccttggggacaattacaaagcaactgcagccttcaatctcttcatggttaaaaggaagaacaccacgccttcctc

SEQ ID NO: 673840 - DNA, 634 bp, Homo sapiens
  misc_feature (555)..(555): n is a, c, g, or t
tacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaagagcccaaaaagccaaagcaatcctaagcaaaaagaacaaagctggaggcatcgcattacccaacttcaaactatactacagggctacagtaaccaaaactgcatgatactggtacaaaagcatggtgctggtacaaaagcagacacatagatcaatggaacagaatagagagccccagaataaagctacacacctacaaccatctaatttttgacaaagttgacanaaatacgcaatggggaaagaattccccattcaggagggggactgggataatagctgccctttgccgagattgaaccgaa

SEQ ID NO: 673841 - DNA, 791 bp, Homo sapiens
  misc_feature (139)..(139): n is a, c, g, or t
  misc_feature (201)..(201): n is a, c, g, or t
  misc_feature (204)..(204): n is a, c, g, or t
ggatagtagtagattgagatggaatattttccagcctcatcctggctgccctctagactccagtcctccaagccctcagcctagtgggtgtcatggatggatctgggggtgtcagacaggctaccctgtgccagggagngggcagaatgggcctgcagcttcctgcagaggaagcaggactgggtagcagagccgggaagntgngtggcccattacaggggggtccccagggtgtcctctggcagggctgtgactgctgcaagctctgccttcaccagtagctggtgccaggacagagctctgggacagcaggcagaggccgagcctgggccacagctcagccactgacttgggtatcagtttccccttctgagaagtacagagtgagacttaaagaacccctagatccccaccagttcaacactccattaactgggaagcccagagtcctgtccggcctgccaagttcatcctggtggacagcgggaggcctccgctaactgttctcttcttttccttattaataaaacacacaatgcctagctggggggtcggaaggcaaatgccctagatggtggggtcacgtctttctccttctccttcctccttctgctggctgaagtgatgactggagctcagcaaccactttgcaccatgaggcagcactgagcacggtagggcagcctggtgagaggggcctagctcgctgccgacagaagtcactgcctacctcagggtccccttacctgggtgggaaataaatttctgctgtgttgaagctaaaaaaaaaa

SEQ ID NO: 673842 - DNA, 176 bp, Homo sapiens
aatgccctcgtcaacgtttcctgcttgactctacctctcctcctcccattgactgtgttcgaggtaactgtataacatcccagtggctataccagtagcacaactggaatattcaggcagaacggtgcggatagaagctagaatacagtctggagaccaggagagtatgtggcgaa

SEQ ID NO: 673843 - DNA, 667 bp, Homo sapiens
aaggacattatgctagtgccattactgtcaacagttggaacaagataaacggcatgcccaatctagttgaggattttggacaccgggcctcccactgggactccgccgagaaaccaggtctgccattgccacctccgccgggccttgctgtcttagcacagtaagtgcacccgaccgcgcccggagtccccctttcactcccacaaccaggcctgtggtgaggctcccgcttgtcatctccaccaggaggtgctgtcctgccgaaatgttggggtttttctccaaacttcctcctgttcagaattcgccatctcagtagtggcatggacatccacctggccacagctcacgcagaaacctaggaatttttgtgaacacgttgtgtgtcttactaatgtgtccactctccactaccactgtttcccaggccactagtatcttttgcccagactgctagtagctcttaacccatgtcccctaatccactcttgcccctcacacagcacacacatacaatccattctcaacacagacaccacagtgaggtttatgctgtctatactggccttccctttcggtggtcaaacgtgcctagctcctgcagccttggggtctaataagcattgctcttccttttgcctaaaaggctctggcctccctctgcatg

SEQ ID NO: 673844 - DNA, 557 bp, Homo sapiens
  misc_feature (13)..(13): n is a, c, g, or t
  misc_feature (43)..(43): n is a, c, g, or t
  misc_feature (63)..(63): n is a, c, g, or t
  misc_feature (66)..(66): n is a, c, g, or t
  misc_feature (86)..(86): n is a, c, g, or t
  misc_feature (91)..(91): n is a, c, g, or t
  misc_feature (108)..(108): n is a, c, g, or t
  misc_feature (114)..(115): n is a, c, g, or t
  misc_feature (119)..(119): n is a, c, g, or t
  misc_feature (125)..(125): n is a, c, g, or t
  misc_feature (128)..(128): n is a, c, g, or t
  misc_feature (136)..(136): n is a, c, g, or t
  misc_feature (139)..(140): n is a, c, g, or t
  misc_feature (165)..(165): n is a, c, g, or t
  misc_feature (174)..(174): n is a, c, g, or t
  misc_feature (195)..(195): n is a, c, g, or t
  misc_feature (204)..(204): n is a, c, g, or t
  misc_feature (213)..(213): n is a, c, g, or t
  misc_feature (221)..(221): n is a, c, g, or t
  misc_feature (233)..(233): n is a, c, g, or t
  misc_feature (246)..(246): n is a, c, g, or t
  misc_feature (250)..(250): n is a, c, g, or t
  misc_feature (252)..(252): n is a, c, g, or t
  misc_feature (271)..(271): n is a, c, g, or t
  misc_feature (296)..(296): n is a, c, g, or t
  misc_feature (304)..(304): n is a, c, g, or t
  misc_feature (307)..(307): n is a, c, g, or t
  misc_feature (310)..(310): n is a, c, g, or t
  misc_feature (329)..(329): n is a, c, g, or t
  misc_feature (332)..(332): n is a, c, g, or t
  misc_feature (341)..(341): n is a, c, g, or t
  misc_feature (346)..(346): n is a, c, g, or t
  misc_feature (348)..(348): n is a, c, g, or t
  misc_feature (388)..(388): n is a, c, g, or t
  misc_feature (393)..(393): n is a, c, g, or t
  misc_feature (403)..(403): n is a, c, g, or t
  misc_feature (418)..(418): n is a, c, g, or t
  misc_feature (425)..(425): n is a, c, g, or t
  misc_feature (442)..(442): n is a, c, g, or t
  misc_feature (447)..(447): n is a, c, g, or t
  misc_feature (467)..(467): n is a, c, g, or t
  misc_feature (481)..(481): n is a, c, g, or t
  misc_feature (550)..(550): n is a, c, g, or t
tcttctacttaanatttcaaaattttattaatcctttaaaaancaccctatttcttttgagtnaanatccccatctcgattacccncaaanatggcttagtttgattntgttannaaantctgtnaanaattattnaannaaatctacaaaaaattaaaaaaaantctagcaanaattaaaaacatgaaaaaaanaattaaaantttaaaccnaccaaaantcctatggcctnttatttagctgtnaatnanaaacgtcaggggtttaaanctgcccttttgactgtaagtaaaanttgctaangcnggnagcgaaaaagtgaaggaanacnggggttgcnaaaanantacttttttttttttttttttgcaaaaagcagtttacctnaaaanggtctcaccnaaaaggccccccccngtaaacncattaatttttctaaanaaaanttggggttttgaagaaaaangtcattagtctatnaaaaaagcatcaaaggacaattagccattttagacttgaccatattttctctttttagcatatagccancttgaaa

SEQ ID NO: 673845 - DNA, 267 bp, Homo sapiens
cccagtcctctcccaagtccccccagggggggtgatagcattgctttcgtgtaaattatgtaaggcaaaatttttttaattttcgccctaaaacttttttattttgttttattttgaatgatgagcctttgggcccccccttcccccttttttgtcccccaactttaaatgtatgaaggcttttggtctccctgggagtgggtgggggcagccagggctttcctgttccctgacttgagacccgttgaataaaagggccccccttta

SEQ ID NO: 673846 - DNA, 178 bp, Homo sapiens
atttgctgaccaatcaaacttgcttgaccccacaggacatcagctgtcaccaaagcccttccaagacagaccatctcacagaaaaggcctataccgacacccccaggaactaccctaaactccttccaggatggacagacctggacatcatgagggtgatccagagacttctccatac

SEQ ID NO: 673847 - DNA, 630 bp, Homo sapiens
  misc_feature (224)..(224): n is a, c, g, or t
ccctagaaatggggcacacaaattgttgttaccatcctaaaccataattattgccttgtccaaagactctcaagcggtggtcttaaccaattgtgtcgtatgcagtagaaaacggcagtaagtgcaagggtcaccaatgtttgcacggaatccatggtcaacagcctcccatgttattagctgtgaaagtcaataatcatacggtcgcaaagagttaatgctcnaacgttcactttccatgcgtatatatgcactctttctgggaaggatatccaaatcaaggtgcacgctgcacttgtttagcttgtcgcagcttttgtatacaagttctgcaagtctgactatacgtagccctgctttgcagaggagggtataaaacttgattctgcaagtcaacctgctttaggcttataccctcacatttgagagcgtctcagccttccttgagagtaagagaaagaatatgcagttcacaggcttgttcacctgtttttctttctggttggtgtaaagccaacaccctgtctaatcatcataaatttctttaatcttgttgcctcttgtcttggtgctgcccttaataaagaatgcatcgattctaaaaaaaagaaaacaatatctcgatactag

SEQ ID NO: 673848 - DNA, 128 bp, Homo sapiens
ccccttaacccccttttttaaaatttggttttttaataacctagggaccccccggtaaaattttggttttccaaaagggggccaaaggggggtttaaatcccccttataaaaataaggctttttttta

SEQ ID NO: 673849 - DNA, 1024 bp, Homo sapiens
tcgaccggttgcccgtcgggtcgctagactcgctcggtgcgcgtcgttcccgttcccgtgtcgctctctctgtgcggctgctggctctcgccgctggttctggccctgggtcccgtcgctatcctgaacgcggctcccgcgaagctctgcccatactcagctggtgctgcagctatatcaaaggctccgggggtcgcaggcgagtcaccggtcgcctgagcgtgtgtgctgtgcacgtatagggttagtagtccagctaactaggaatctatttgagcctactgcaaacagagcgtaccaagacggaaatgctcgtgtggcagacactcatatcatgttcactcttgcttacggacgtgcgtgggtcgctgggatattgacagaagggtccactgcgtgggaagaaagggctgttcacgagccattcgccttatgcgattattcctcgaaaaacgcttttatcgacgacgcacattggggaaggtcggatcgggagtctccaggctaccaacatcacacgttgtttaccttgctggacccggacacccggggatgaaagggctgaatgggactcttgaagcgaatgggacctgaggttcctgcggtgagagcctattcaggccggtccttaggactcccccataagacataaggcgaggggccttggttgtgcttcctttgggcacaagtctgtagagctgacgttgggaataactttccacctgggcgcttctaaggcaccttggcttgccaagcagtttgcaggccttgtcctcggaatgggccactacccgaacataccccaaatggattgggcatgcgcggcccgagaggcaggaaggattcaccgtgggaacctgatattgtgaagacgtgtgatacatcagcgcggtgtgatggaccccccttttgagtgcattccttgtgtggtagccccaagacatttgcccaaattgtattgccccatgggacattgccaagcgaccaaggtaattcccttagagatgggggagatttggctaca

SEQ ID NO: 673850 - DNA, 1967 bp, Homo sapiens
gcagcttcctaagatcatgcagtatgtgcatctaacagtgctcgagtagtcgaagaatgacgaattggatcactatgcccagataacagaaggacatcctgcttcaatgattacgctcgaccatggatatcctcgaccattctacgttgacatagacatgcgtagcgccaaccacagaagcaggtaactcttgacacctaagacttcccatagagtgccgtacgattcacatgcacggcctccactctagcatcgagcactcttcaatactactcgatgcgtaggctaacataacgccggggaagtgatgcaagacatacttctctagcctatgacctgaccttcaccaggaatttcttcgtactgcaacacaggaccctaccacgccgcacatacacatgccagaacatcagcggaaccgttagctatcgactcaaagcactagataccagcatgtggatgagccgctgttaatatatctccgatagggatcgaggtacaccaagacgacgacagtgcgtaatggtcgaaagcagcacgacggctcatatggtaccaacgacaggagtgcccgtctgacttaggacagaagtgatcgatactacacccacggcgtacgcctcattcgaccgtattaggtcgcacgttaacatagcacttttcctccactttagcagccaatacctcacatcactatattcgcatacagcctggacaatacaaccattatcccaatgtcaatcaagctacttcacacacatttgccacgtaagacagcaaataacgtcactagagaggcaaaacaacaatatcaccaatatatcaacaagcacccgacacacgagccaatataaatatatgtcacaaccacataataactcacactcaacgcatatatcaacaataactatcccatcacgacattatgacatcgtaccaccccatatgcctcatccaccaatccacgtatcaatcaccacaaatattaccatccactcacaaccttccgaccatatcacaacttaccaccagtcaacatcttacacacgcaaacattgtcccgaacacaccatactagctattacacactggacacattcatataatcgcctatcaaccacacacagtacaatccaaataccaaaaacaaagaaaactgatagacaaatataccacactattcaaacccacccccaatttacagctacatatgatatacctatctaaacaacaccccacaaagttgctttgtcgaattcgagatgtacgatcctaaacagcacagctacacagtagatatcaacaagacaacgcagtccgccccagcagtaagatcagcgcatcacagtatggacactcacacactcccacattacactcgagccctcacactgactagtctagacatgctgacatataagaatgcagccgacgcaacatgaccaactgggcacgtcgctaactctctgatgtacacacaacagagtaacataatataccaagcatacgctataggagcacctatatagccaacaccgtacagcaaacctcgactcatacaactctctacatacaagcaaaatcttaccaactatagatataacactaactccaccacacataagcacatattgacgacactccatacaagtcacacagactagcttaacaagacacccaaccgcctatacacaccacaccaaagaacatctagaacaacacaacaactagactaacatcagtaaaccaacaacacactcagaagatcaacacccacacacaaacaataagctactcatacacccacaccctcacacctaccctactcaccacacacaaacactatccacacacacgaccacattctacaaccacaacacctgacccacgtcactaccagacaccccaccaatcgctctaatacatacttaaatacaatataaagatacatcaatatacatacgaac

SEQ ID NO: 673851 - DNA, 122 bp, Homo sapiens
ccagattgtaactcctgccgagccagtcagtactatttcacgctggctcagaccccaccgctgtccaagtccaggtccagcacgcacggccagcagcaccaccagctccacgaccaccatcc

SEQ ID NO: 673852 - DNA, 207 bp, Homo sapiens
caaaccccctttttttggcttatagccaacaagtaataggggagttcttttaagggccccccttcgcttgcaatgctatcaaaaaccccccgttttttacacaaacatatttttttcccggcctgttgttttaaggctcttgattattaagttaataaatcaaataaacacagtgattaataaaaaaaaattatttacataactata

SEQ ID NO: 673853 - DNA, 976 bp, Homo sapiens
cacgcgtcgccacgcgatcgaatcacatggccgagcgggaaagtctgtgcgtgacattaaggatgaagctgtgctaccgtcgccctggacttcgagcaagagatggccacaggcatgcttccagctcctccctggagaagagctactgagctgtctgacgtgcaggtacattcaccatatggcaatgagcggttcctgagtgccctgaggccgctctatccagcctttccttcctggtgcatggagtcctgtggcatccacgacactacccttcaacatccatcatgaagtgtgacgtggacatccgcaaagacctgtaactgccaacacatgtgctgtctatggctggcgaccacccatgtaaccatgggcattgccgacaggatgcagaaggagatcaactgtccttggagcccagcacaatgaagcatcaagatcgatatgctcagtcactgagcgccaggtactccgtgtgtgagtcggcggctccatcctggcgctcgctgtccaccattccagcctgatgtggagtcaagcaagcaggagtatgacagagtgctggcccctccaatcgtccagcgaaaatgcgatctaagcggacatatgacatgagacgggtacacccattactgacaaaacacgaaaatgagacaaaagagatgagattggcatggagtatagtgaaacggtcacggtaaggggacaaagcgacacagcaaactgcgcggcaaaccgggaaaccaactggacacagagcaaaaggaccgaagcacacggccgcgagaaccacaggagagcagacgagccgagggcaagagtgacactccgagtaacaacacaaaaacgaaaacacgaacgaagaaaggaacgaaacccacattcacggagtacacaagaccacggcacgagggaacagcaagagacaacgaaacacagaaccgaagcgaaggacgctgacacagccacaagaacgaaa

SEQ ID NO: 673854 - DNA, 637 bp, Homo sapiens
agccacgagacactacgtctatttattcttggccataccgtatatacccataaagtattggcgattgatattgaggcccaatgcgaaagatctaatgccgcgtggagaagatgaagaaatttatgcacgcgttttttatgatggactttcacctatatcttcctgataaagggtactctttcaataactttgtaaggaaagcgctaggtgataggctcgcgatgccacaaggcttcttataacaggtgtaagagcgcacacacttatgtattaccacagtgggtagatatataaggagaagtcaagaaccatacggcctggtgataatgtgtgtgtcacgagaggaaagtagtgcacgtttatgtggcacactgccgtcaaagtattcgtgatatatcagcgtagaacaagagggcaggtcttgtaaacttgtgccttgggcgtaggaagagagacaccccaatgggctcaggcgtcaccactgggcagcggaggcccgcatccccctttaagaaaccacgattctgtgtctttccccgaatgccctaatgaccttatagagagatggtttttataaatggagatttctcccgtaagcgggttacaagagcttgcttctattcaggccaaattccgc

SEQ ID NO: 673855 - DNA, 1034 bp, Homo sapiens
  misc_feature (1)..(1): n is a, c, g, or t
ntgggatccagcgcgatacaaagcgccgccgggtgccgttccaaaattggtgcgccgtttgttccggcccgtaggctccgggttactattgtttgaaccgccgcttgtttcccgcaaacctgcctttgggacacatatggcttgtgaccccacagtactgcgggccaaaatgttgtcggcttataactagtgccacctcctctttaaatgcctttttccgcacgcctttatgctgtaactgctgccgcccttgtttttgctcaccgacagtgcttcaggaggttttcacgcgcacctcccgttatgtgtctggcccacccgactccaatgattcctgtcagccagcccaaaatctttatgtcggccgtccgtgatcttaataacaggactgggttgctgcggggttaaattcaaagagcccccctcctgtgaaggttgatatatgaggcccccctccccctttattagtgcatccagcccagctcgccccgtgatgaagatagtgttgttaccgccgtgttcgggcaagtgcgtcacgctattgccccaccaaggggcgaggggcccttctcaggaaactcgttactgtgagaagggaggttcttacaagattagcgacactatacaatatatactgcgcgttattctcggcgaaatagaatttctctaaatctggctgggcataaacgtctttcgtcgtgttggttgtatggcccgcacgccaactagatccatctcctctgtctctgttgctgatgtagagcgcataggtatgacctctgtttctacaagtgcccacagtggggtttgacataacactatataatcgagtgcgcgcagacagtgctctaagagtgttctgcgctccactaaattaatgcacgccttctttagtccttataattctgccctggtcagtcttcactaaatggatgttctccttatactatatctgcaaagcgagcaatctgaagcagttgggctgatccggtaagataagtaaagaaactattcaccccctgtcccacataaca

SEQ ID NO: 673856 - DNA, 173 bp, Homo sapiens
gcatctcacaccccgagggccctgaggagagggagctgtgggccaccctgggaggggccagctggggttactggccccgcatgagctcggccatctctccctcctcccctctccttgggggactcagggctccattctcggagggcaccacggtgatccaaccatctcagtat

SEQ ID NO: 673857 - DNA, 346 bp, Homo sapiens
  misc_feature (34)..(34): n is a, c, g, or t
ccccaggggggagattgtcttccaatgtttaacnacgtttaaaaaaaaaaaaattgaattttattgttcatttaaaaaaaatttgaacccctgagggaatttcccaaaccagttccaatttttagggcttttaaaattccaaagaaatttttttttaaaaaaaaatccaaaggaaccctttaaattgtagaacggaaattttttcatttaaaagaagaaaaagcctccccggggtttaaattgggaatcatcccccctttcaaatttgtttcaaaattgttaaatgaaaactatttttttggagaggttactgaagttgattgagcaaaaaaagtttacttaatta

SEQ ID NO: 673858 - DNA, 158 bp, Homo sapiens
  misc_feature (87)..(87): n is a, c, g, or t
agatgaaattatagccagcatatatagcaggactaaccctatacctctgcatatgattactagattacttgcagggcaagtagaccngtaacagagagtactagacagtaagagcaacctttagtagtaatagtggagatttagtagagcacaactac

SEQ ID NO: 673859 - DNA, 458 bp, Homo sapiens
tttgggaaggaatagctcctcactatcccaccagttcgtgatttaagggaggagacaaccctcatactgtcttatgcccaatttctgcctccaaagaaagaagtaaaatctaaaaggcagaaatgaaatccacaagcagacagcctggccccacatcctgggcctggtagttaaagattgacccatgacctatcgggtattgttatctatagattacagacattgtatagaaaagtaccatgaaaatccctgtcctgtcctgttccattctaattaccggtgcaggcagccccgagtcacgtacccgctgtttgctccatcgatcacgaccctctcatgcggacccccttagagttgtgagcccttaaagggacaggaattgctcactcggggagctcggtttttggagacatgagtcttgctgaagctcctggctgaataaagccctttcttcttta

SEQ ID NO: 673860 - DNA, 154 bp, Homo sapiens
  misc_feature (110)..(110): n is a, c, g, or t
  misc_feature (116)..(116): n is a, c, g, or t
cagagcatccaaactgtcccgcgccttccaggcgcacgtccagagccaaaagagctccatggcggcggcggcaagccaacaacctttccctggtagtgcacggaccgggngacttncgcctggagaactatcctatccctgaaccaggcccaaa

SEQ ID NO: 673861 - DNA, 202 bp, Homo sapiens
tactaacttcatgagctcatacatataccaatacatgaagaacaaaaacatcccaacattactacagaaacctgccaaactgaagcttgctactgccagaaaccatccaataatataatgtgcatgaaatgataacattaactgtgtggagatcctactagatgtctgacctagcatggcatagcaatgcttgtgcacttgg

SEQ ID NO: 673862 - DNA, 143 bp, Homo sapiens
tggcagttgcagcaactgccggtcagtgattttcagcacagcggggctcttgagcctgaggaatcaggtctcacgggtagcatgctggtctagcggagaatacttgtgttttcccggggctctcttgaccctcaggcctcagg

SEQ ID NO: 673863 - DNA, 399 bp, Homo sapiens
tgcaaactccacctcccgggtttaagtgattctcctgacttggcctcctgagtagctaggattacaggcgcctgccactgcacccgactaatttttgtattttttagtagacacagggtttcaccatcttggccagactgatctcgaactcctgacttcatgatccacccgcctcggcctcccaaagtactgggattacaggcgtgagccaccacgcccagccaaaaggctattatttctttacctggttaactgtcatctcccactagaatataggttttataagggctggactcagcatagtatttagaacagtgcctggcacataagtaaatattgtctgatggaatgcagcatacatgtgtgcatccattaactctaggaaaccagagatcataa

SEQ ID NO: 673864 - DNA, 465 bp, Homo sapiens
  misc_feature (220)..(220): n is a, c, g, or t
gcagcatggagaggactgcacacacgacactgctcttgaaagaggatgattacttgccttctaaactgacaggctgcacttgtctctccagcagaggtgtgacgcagggcagctggttctcactggtctttgaagttggcctttctctttaccacaaacgcggtcatcccttcttcccggtcatcagtggcacaggttgaatacaagagtttcttctccnaacttactaccttctgttaatgtcatttcaaaagctgcattcactgattctttgggcatcgctactacaattgtagaattgctggcaattttttctgcacactggatggcttcttccaccagtgtctcaacaggaccaatcttgctgacaagacctgaaacacaagaaagtcagtgagtgatgtgcagaaacagcacttgtctatcccttctcgagtgagtgtgcggggtacgcagctcgaattc

SEQ ID NO: 673865 - DNA, 1020 bp, Homo sapiens
tgcatttattatttttatttattattcttacactgctgggaaatatctgtagagtgaaggtatgctagtatctactcatagatttgttgcatcaaataatatgcacataagtgcttggcaccacacctgggacatagtaattatacaatcactgttacctctttttaatattgttgttcatactgtgtgttgtttctccttatgaaagcctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaaggtaggtttcctttgtaagcatctgcagtaaccaatggcttattatggctgtgtggccaccttagttgggccagaggggaagtagcttgagtagcctgctcacatcagacccaggttgcgtcctgtgatggtgggacactgtagcacttgaccacagtaagaccttccatttgaagagagccttttagcttgtgaaccactttcagtagattgacttcttgcatcttcttttgtcattttataaatgagaaaggtaaggctcaatcaaggttacagaacctgggttttctgtctccaagttcaagttcagtgctgtttccacattccatgtgctgctgtcctggcatgtgtctgttgtgggatgctgtccattgtaaacaatgtgggttacaagagctctcacctggagctttcattatttccactgtgcatggagaggtggctgatcccagggctcacaagtcccccacgcttcagtcaagtcattctgaaagtctcacttcccatatgttttctgagcatgaccaaaggggtgtggggaggaagtggccaggctgagctggggccagcagtcaaatgagctcaggctcatgggtcctgccctctaggtgctccccaggcctccgtaggcttttggcactaga

SEQ ID NO: 673866 - DNA, 971 bp, Homo sapiens
gtttaaacgggggtatgtcctttccccccttgaggttccctctgtgagccttgaatcaagcaatctagtctgcagtagtgtggactaaaacaaccagaatagcatctagaaagccatgagtttgaaagtggcccattcagaggcactttcctacccaattacccaggtcataaggtatgtctgtgtgacgactgtatctctgtgtagtatcagcatatgacatcgacttgcacactagacactcacagacaaacagataggttggccactagattatatagtatacatatattgtgtgaaagagaactgcgtgtgttgcaaggcttatcacacattgctaggtctgaccacttagtccatgaaacacgaatcagcaattgcaacattaaattccgttgagactccatttgtggcctgcatttcaggacgactcgggatcacagaactagtatccctagttgccgtttcgtcaaggggcgcgagtgacttcttagaaaactgtgccctgctcggtgggattcggacatgtggttaaccctgacagagaacaaaaaagacgagagtttagcggtatggcacctgtcagagtaaagtttaaaatgggtctgtaccggagcagactacttgagagagtgtgtgtgtgatgtctgtgggatgcacacgtttctattttctggaaatcgggaggtgattgaagctgaagcgaaaatatgcgcagcaacaaggggaggagtgtcaatgctttttacagtttgctatggagggaggagggggggggaaaaccggtaagtggggtaaaaagttggttcgccatatgttttttttttcattacatcatatttattgggcaaaagagctacccaaattgttggcttaaaaaaaaaacattgggggcaaataaagggggagaaaaataagtcagcagagtccaaccgcgcatgtattttttacttctttttttcgattaaaaa

SEQ ID NO: 673867 - DNA, 3198 bp, Homo sapiens
  misc_feature (3185)..(3185): n is a, c, g, or t
tgcttaaaaaaacacaacaggattttcgaagaatcctttcttagaaaacaaacaaaaaaaccaaacaaaaacgtactttctccccactagtttacaccacaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacggggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccangcactgtgctcag

SEQ ID NO: 673868 - DNA, 921 bp, Homo sapiens
  misc_feature (291)..(291): n is a, c, g, or t
  misc_feature (908)..(908): n is a, c, g, or t
tttgttttgttttacctgaagtcctacaacctgacttcatctcacactgtccaatatgctgatttctggctgacttcatggcactccccctgcccggctgtggacagggtgaatgagagaggaaaataattatgcttgctgctttacatacatttttttttcttctaagcttcccatgactcctgaaggtccattctttacagatgaggaaactgaggtttgaggaggtgatgtaacttggaggctggccaagctggggtttgagataacaaatcagtctgatgtcagtcngatgttaaattgttcatcctcttgcagtaaaatgtttttgaatgtatgtatttcctctgcagcaattagacggcatccatgtcaccatcttacacaaggaggaaggtgctggtcttgggttcagcttggcaggaggagcagatctagaaaacaaggtgattacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccangcactgtgctcag

SEQ ID NO: 673869 - DNA, 456 bp, Homo sapiens
  misc_feature (16)..(16): n is a, c, g, or t
  misc_feature (20)..(20): n is a, c, g, or t
gggccacatcctcttnggcnatttggggccagacatgagggggctactcagtaatttgtgaccccaagaatgtgtggctgcatagtacactgcatgagacgtgtttacatgcgcctgtgtgcaaacacgggggctgtatcaccccgggctcacttgaagcccagggcatctgtggcctgggagaggagaggatccctaacagagacctagtgtttttctcagcagcagaggccacagtctgcacggtgacactggagaagatgtcggcagggctgggcttcagcctggaaggagggaagggctccctacacggagacaagcctctcaccattaacaggattttcaaaggtgtggggtgtgtctggttctttgcgtgctctccagttgtgggcatgtggccaggcccccaaaaggcttctgggcactttctgggctatgcttgtttcccacaaccat

SEQ ID NO: 673870 - DNA, 123 bp, Homo sapiens
  misc_feature (45)..(45): n is a, c, g, or t
tccacgctcggtcccggaaaggtagctgtactgaatcataggttnagatcagtggcacaaatcatacatgtagaatattatgtaacatatacattgttaggtaaggagtcagagagtacagta

SEQ ID NO: 673871 - DNA, 295 bp, Homo sapiens
  misc_feature (72)..(72): n is a, c, g, or t
  misc_feature (158)..(158): n is a, c, g, or t
  misc_feature (174)..(174): n is a, c, g, or t
  misc_feature (266)..(266): n is a, c, g, or t
ctcgtgcgccaaaaacatcattatgtagtacatgactataccttgaatttcgatcttttcctaggctagtgntatgcagtacatgagataatcaatgcttccttacaaaatgggcttatgttagaagacttttgcccagctgcaggctattgtaagtnttctgagcacatatgngttaacctgggccaagctatgatgttcgatacgttaggtgtattaaatgcacttttgactgccatctcagtggatgacagccttctcactgncaggcagagatcttcctcactgggccacg

SEQ ID NO: 673872 - DNA, 3312 bp, Homo sapiens
  misc_feature (3299)..(3299): n is a, c, g, or t
gcccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacggggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccangcactgtgctcag

SEQ ID NO: 673873 - DNA, 2967 bp, Homo sapiens
  misc_feature (2631)..(2631): n is a, c, g, or t
  misc_feature (2638)..(2638): n is a, c, g, or t
  misc_feature (2643)..(2643): n is a, c, g, or t
  misc_feature (2649)..(2649): n is a, c, g, or t
  misc_feature (2663)..(2663): n is a, c, g, or t
gcccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacggggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcaaaaaaaaaaaaaanaaaaaanaaaanaaaaanaaaaaagagggggngcgccgcccacaaaagaatccccccggggggcccccagactgacgcgctccccacccttctggtgcaccaagggggcccccacatggggcgaccgctctatattaaagagaacgcgcgaggcgccgcagggcgccgccgcgcttgattataacaacaccgtgccagcgagagagggggacaacactccgcgtaataccgcgcggggccaacacctcctgcgaggccaagagagacaacctcctctcatcgctccggggggagtggaccactaccgtgggcggccccacaaacctcctcccacaa

SEQ ID NO: 673874 - DNA, 2951 bp, Homo sapiens
  misc_feature (2615)..(2615): n is a, c, g, or t
  misc_feature (2622)..(2622): n is a, c, g, or t
  misc_feature (2627)..(2627): n is a, c, g, or t
  misc_feature (2633)..(2633): n is a, c, g, or t
  misc_feature (2647)..(2647): n is a, c, g, or t
gcccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacggggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaaaaaaaaaaaaaaanaaaaaanaaaanaaaaanaaaaaagagggggngcgccgcccacaaaagaatccccccggggggcccccagactgacgcgctccccacccttctggtgcaccaagggggcccccacatggggcgaccgctctatattaaagagaacgcgcgaggcgccgcagggcgccgccgcgcttgattataacaacaccgtgccagcgagagagggggacaacactccgcgtaataccgcgcggggccaacacctcctgcgaggccaagagagacaacctcctctcatcgctccggggggagtggaccactaccgtgggcggccccacaaacctcctcccacaa

SEQ ID NO: 673875 - DNA, 1248 bp, Homo sapiens
tcccagaaaaaaaaccctgtgaaagcaagcaacaaaacattacaccttgtgtgctcaaaaaaaaaaaaaactgcctttaccttattaaaagggcggaaaaatgtggaacacttattccctccaggggggattgtcgtgtaggaacccgtggtttatattctctcatacaagcccaccccgcaaatgtgtgcgcgccataacgcgagaaatatattttttttaaaggagaaaatataaaaacttatttagtttacaaaagaaaaaaaaacaaaaaaaacaaaaaaacaaggggggggcgaccacaaaaatcaccccacgagagagggaccacaaaaaaaataagaagcgacaacacacacgaaattatagtgagaaaagacaggcgggccacaatagtaggaggccacaataaaataaacaaagagagaacgagggaagagcgaacacaaaaagaacagagaagaaaggggagaacaagcacaggagcaaacaagagagcgacacccctctagcgcagcaagacgacacaccatacaccagaagagggcaagcacaaacaaaaacaaggagaccaacaccaccacacacacgcaacataacgaccgccacaaggacaacaaaaaaacaacagcctcaaacgatccatcacaccacgagcaaaaaacaagaagaaagaaaaaatgaaagcagcaagcactaaaagaaaataatggggcaccacaagaagaacacacaaaaaccctaacaaaaaagcatcctccaccaccagcgacacaacacactcaacaccatccacacaagacagcaaagacacacaagacgaacgaaaacaagaaaacaacaaaaaaaaaagacaaaagaagaccagaagtgttacaacagaacaaaaaagaaaaaaagcaaaacgacacgacaaaaagaaacgaaacgcaaagaaaaaaaaaaaaacaacacaacaaaaaaaaatagaaacacccaacacacaccgaacaacaccacaatcgcaggaagagaacaagaagaaagcaaaagcaaagatacgctcaaacccccgaaacacaaaaaaaaaaaagaaaacacgagagacgcagccaccgagaagcgcgaaataaagaacgacacaaaaagagaacaacaaggaacaggaaggggacaagcagaacaagctaccgagagggacacgaaggaaaaacagagaaaagaggcgctaccagagggcggtagcgccacaaaaagataacgacgaaa

SEQ ID NO: 673876 - DNA, 2033 bp, Homo sapiens
  misc_feature (291)..(291): n is a, c, g, or t
  misc_feature (2020)..(2020): n is a, c, g, or t
tttgttttgttttacctgaagtcctacaacctgacttcatctcacactgtccaatatgctgatttctggctgacttcatggcactccccctgcccggctgtggacagggtgaatgagagaggaaaataattatgcttgctgctttacatacatttttttttcttctaagcttcccatgactcctgaaggtccattctttacagatgaggaaactgaggtttgaggaggtgatgtaacttggaggctggccaagctggggtttgagataacaaatcagtctgatgtcagtcngatgttaaattgttcatcctcttgcagtaaaatgtttttgaatgtatgtatttcctctgcagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccangcactgtgctcag

SEQ ID NO: 673877 - DNA, 379 bp, Homo sapiens
  misc_feature (52)..(53): n is a, c, g, or t
  misc_feature (89)..(89): n is a, c, g, or t
cattgaaacatctcagaatttgaattttgactacttctggtgttaacatcannaatgcatttcatgggccgggcctggtggctcacgcnctgagtgcagcactttgggaggccaaggcaggcggatcacgaagtcaggggatcgagaccatcctggccaacatggtgaaaccctgtctctattaaaaatacaaaaaattagccggcgtggtggcaggcacctgtagtcccagctattcaggaggcctcggcaggagaattgcttgaagccaggaggtagaggttgcagtgagctgagatcgtgccactgcactccatcctgggcgacagagcgagtttccatctcaaaaaaccaaaatcaaacaaacaaaaaaacccac

SEQ ID NO: 673878 - DNA, 1746 bp, Homo sapiens
  misc_feature (1733)..(1733): n is a, c, g, or t
gcacagggctggcctctgtgcacgagctccaatctaggacacaattatctttaatctttgttggcctaaaaatcctctagcattgactaaccggttcaatcctcctccagcaagtatgtggactggacttgtgtgatttctggtcctgacttcctttggtttgctcaggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccangcactgtgctcag

SEQ ID NO: 673879 - DNA, 102 bp, Homo sapiens
ccgactacttctgtatgtggaatgcacaaatgtgtggtctgatgctgtaaggagtttaggttgtatgaattctacaacccatatataaattttactctatac

SEQ ID NO: 673880 - DNA, 469 bp, Homo sapiens
ggtggtgttcggcaaaaggtggccctggtggcattcggggagaaaaaggtggccccatggattctggtggtccccgtggaattttcaaaggtgcccctggtggaaacaaaagtggcttccctggtggcccgggcaaggaccaaggtggcttttgtggaaaaaaaaaaggtggccctggggggccccccggcccttttttggaacaaattggaggaaaaaaaggaggccctgggggcccttgaaaaattgataaaggcgggccccctccggagcccaaaaattggccctttttaattcaaaacccccccaaaggcgccttggccccccaatttttttttttaccccaaaaatgtttttaatttttaattcccttttttaaattttggccccccccttataatttttccctggtgggcccttagaatttttccccctttttgaaaaaccctttaacccagtttaatggtta

SEQ ID NO: 673881 - DNA, 823 bp, Homo sapiens
cgcctgcctgcctgccctgcggtcctggtcctggctgccctgcgcagaaccagactgtctagagctgccctgggcagctggtggtgatgcatgccgagctgggcttcctgcgagcctggatgaagtgcacatgtgcctgtccctgggtccctggcaggtctcgctgcgtctgttcccaagcgctctgcgatggcctaaaaatggagtgagcaacctgtccaaaatccctgcatggacatggaaaatggagtgggaaatctcgacatggaaaaaccctacaataaaaatgaagtgaaacctggaaaacgatggtgaaatgccacgaagatgaatgtagagcctgatgatgaaggaaagtcagacgaggaagaaaagccagactgtggaggggaagacagaatgcgagggaaagagagaggatgagggagagccaggtgatgagggacaactggaagatgacgggaagccaggaaaagcaggacaggtccgaaaggttgagggcaaggccacaatggcgagggcaaagccatgctcccagggcaaatgccagagagccagccgcgggccgcgaaaagcgcccggctgaggattatgtgccccggaaagcaaaaatggaaaaaactgacagggtggacggacgaattacccccaaggaactctcaggaggacttacaggaaatgcatctgagcagttagggagatattaaagactgtggcgatgtgtcagggctcaaaggactaggaaaaaccgaaacggtgtttcatggatcaaaagattcaggatccttcgccgaggacagggtcaggataagggagaaagcag

SEQ ID NO: 673882 - DNA, 3358 bp, Homo sapiens
  misc_feature (2258)..(2258): n is a, c, g, or t
  misc_feature (2263)..(2263): n is a, c, g, or t
  misc_feature (2267)..(2267): n is a, c, g, or t
  misc_feature (2276)..(2276): n is a, c, g, or t
  misc_feature (2287)..(2287): n is a, c, g, or t
  misc_feature (3345)..(3345): n is a, c, g, or t
gcccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacggggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtccccggganaaaantttnttgggttgntcccaactttnccagagagaacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccangcactgtgctcag

SEQ ID NO: 673883 - DNA, 236 bp, Homo sapiens
ggtcgaccacgtctgtaatcccagcactttgggaagcacggctggtggattgctcgagtccaggagtttgagaacagtccgggcaacatggtgaaaacctctctctccaaaaaaaaaagaagaaaaagagccgggcatggtggtgtgtgcctatagtcccagctacttgtctattctggacatttcaaaaagaaatggagtcatccgttgtgtgatcctttgtgcttggcttcttt

SEQ ID NO: 673884 - DNA, 305 bp, Homo sapiens
ttgtagtccagcactttgggaggcgcggcgggcggacacgaggtcaggagatcgagaccatcccggctaatacggtgaaaccccgttctctactataaagtcaaaaaattagccgggcatgtagcgggtgcctgtaatctcagttactccgcgaggctgaggcaggagaatcgcttgaaccctggaggcagaggtggcagtgaggcaagattgcgccatcgtactccagcctgggcgacagagcaagactccgtctcaaaaagaataggagacacagtgagacgaccattagaagccacggtcaa

SEQ ID NO: 673885 - DNA, 507 bp, Homo sapiens
tagtatatagccaaagtataataagtgcagtcacattctggatcttcagttgctcatagcagcaggataaaactaagacagaaaacagttgtattttcattcttaaaatgcaacaatatctaatgaaatgtataccagatccttaacggttcctcctctatgtaggataaatgagaacagattaataatagacaaacagggtaaactaaaggcattcattcatatttacatattaaaaccacttttgttaacaccaaatctttacatctagcaaaagatataagcatataaagaataaagcagacatcactaaagcagtatccatttacagagccttagattagcacctgaggaaaaaagggtacatggaaagctatgtaatttgccctcaagttaatttgttggcctggagattacaatgccttggaatatgcactgaaagttaaactaaattggaaaataaatgtttgtagttagtttaataaggctgtagaaaagagatacttg

SEQ ID NO: 673886 - DNA, 424 bp, Homo sapiens
ccacttactgcatgtgtcttacctgaagctttgacattctttagaatgttactggcagaacatattgtttgcggtttcacattctgtttccagtgtcgccatataattgctccctagctctgtagaaaacatatttttgttttggacgtgcacgcatgcacttgtctcaaaccaaacaactaacgcaggagtggagatagagcatgatctcttggacttcggtgtctagtgcagtagtagttagaggtcagagttcagaataaatgacttttgtgtcctgtctgggaatagaatttgacaacgtagtgagtaatttaggaagtggcaaagttgtgtttctgtctctaagtccagtattcactttcatagccaagaagctgtctgtatagtttagttcacaggaaggaaataaaaggatcagggc

SEQ ID NO: 673887 - DNA, 344 bp, Homo sapiens
cgggaaacgcacggagggaactcaacggaccacctgctcacggcccagcctggagaaaaagaaaagctacagcgccaggtctgaaggcagacaggtcggttagctctacagaagataaacatcctttctacagaggatcaggaaggcaggagcacacggcagcaaggggcaggctggaggtcacgagttagtgactcttctcagcagcgaggacagccctgaggtcccctgctggaagaggtctcgttacatctcaatgaggcgtgcagtctcacgctggccggacagtacagcaccgagtgtgatggaatagtacttgcggagggtggcctcaccggacaaca

SEQ ID NO: 673888 - DNA, 118 bp, Homo sapiens
aaagggtttttaaaacgaaaaaaaatgttaaaaaaaatttgaaagctttggaaaacccaatttggaaaatccttggattttttattaaaaggtttggaaaaaatttttaaattatcca

SEQ ID NO: 673889 - DNA, 458 bp, Homo sapiens
  misc_feature (64)..(64): n is a, c, g, or t
  misc_feature (182)..(182): n is a, c, g, or t
  misc_feature (228)..(228): n is a, c, g, or t
  misc_feature (278)..(278): n is a, c, g, or t
tttttttaaaaaaaaaaaaagggttaaaagatgttaattgtgtcaaagtaaaggcacttgtggntcctcctttggctgttttttccattccaggcaataataagggaacccttttgattgttttagaaatagggcttatgttcttagaagtattttttctggtggttatttaaaactttttncaccaatttatgagctatataattctttttccatttgccagtaaanctttaatatgtagacagttccacgcttttaaaattatgtagaatctcaanagttaatgagcatggttttgtgctggcaagagaagtcttttgttatgcattttctaaatcttatttttgtgtgtgaacatatttaaaaaaacaaacatcacttaccctaaaatctaagcctcagtaggaacgtgcttttggccctttttatttccattgaaatatacttaaattatctct

SEQ ID NO: 673890 - DNA, 155 bp, Homo sapiens
gcctgacccttacaagacctgtacccaggcagaagcaggaagcagcagaagcaggaagcaggcagaagcaggaagcgcttcctgcttctgccgcttcctgcttctgcccctgctctgctgcttcctgcttctgccccagtggtcttgtgtgagag

SEQ ID NO: 673891 - DNA, 160 bp, Homo sapiens
tagcagaggacacaaatttatttccacatttgtcagtcgccttacaagtatcctttgttcccccagaagtaagagaagtcctagttttttcccgatgtaagaaggtttgtcatgccctcgtgcactacacgtctctagatacatgtgtttctccagcgtg

SEQ ID NO: 673892 - DNA, 393 bp, Homo sapiens
ttacagatagaacttgagctcggtaccctcgataagggccaaagtccttcctcactctggctggtccaacacacaggaagtgaggtgtatcgggaatgggtaggggtatggtggagcatcagtgtgtgtcacgctgacgggggccgtggggacaggcgccaaggaggccagtctcacaaggtgcatctctgtcatggtgtgaaagatggtagttaggcctgggacacacccctgtccgacccttatcgggtgtagtctccatacatgcacgtcgagcctgcacattctggccgcatcatctgagccgcctcctctgagaggcagggcagagacagggccgaggggcagtggagatgggaacaggagcggggctcagaccatgaaaacattgga

SEQ ID NO: 673893 - DNA, 403 bp, Homo sapiens
agcgacggctacacggcagtatcaaggtgttgatcagagctacagtcatctcaaggctggggcaggggccattgcccagctcacttttggagcacttggagacctagacctcagtttcttggtgactactggccaaagtcatcaggcctgtaccatggagatctctctgttgtgcagctcacaacatggcagctggctcaaaaatgaaaagccattaggaaatgccactgcttaatgttcaccatactctattcaatgaaagaacactgtaaaggcagctataatggaaaaaatacaaatcattataaacagaagaaaaaaaccagtgagtcactagatcttatacacactcaaggggaggatgttccaccaaggctgcgtaggataaatttcccgggtaccc

SEQ ID NO: 673894 - DNA, 172 bp, Homo sapiens
  misc_feature (1)..(1): n is a, c, g, or t
  misc_feature (77)..(77): n is a, c, g, or t
nctgccgcatctctctttatttattcttttttcctgtggtgcctgcgaatttattcagttcttcattctcttcatcnctatctgcgctacggggggctgctgacatccaaaactatgtcccttttaggggctactcggagaaaattgcggcattcaaaagtcaggtgaccag

SEQ ID NO: 673895 - DNA, 491 bp, Homo sapiens
  misc_feature (26)..(26): n is a, c, g, or t
  misc_feature (162)..(162): n is a, c, g, or t
  misc_feature (243)..(243): n is a, c, g, or t
  misc_feature (380)..(380): n is a, c, g, or t
  misc_feature (447)..(447): n is a, c, g, or t
  misc_feature (481)..(481): n is a, c, g, or t
agcaacgaaggcccattttccaaacntcccccaaaaaattccttcaacttgccccgaaagattcggccttggcacggttgcttaaaaattcgcggctttgtttccttcccaaatgccagcaagtttccatgtaaaacttgttgttcggggaagaaccaggcntccgattgccgcgttcattttcaacccccggttgacacgtcggaaggtggtcttcaacagcaaggaccaagcttcctgggncgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgcctgnccgtgcgcctggtggaggtgggcggggacgtgcagctggactccgtgaggatcttctgagcagtaanccaggcggcccggggccttggctggcaaataaangttagcccgc

SEQ ID NO: 673896 - DNA, 260 bp, Homo sapiens
tattcgcgaccgcgtcgaccgctgcaccagcggctcggccacacccagctcgttgacgcggttacggaccgtggtcaagttctgcttgatggagtattcgcggatttccgccagcttggccggggtcatcgccagacgcagtaccggctgctcgccgaggtcggccgttacaatgtcgaaatcgttgaagttcttgcgaatcagcgcacgggcctgttcacgggtatccgcgtcagcaaagcccaactggatgtcgacgc

SEQ ID NO: 673897 - DNA, 333 bp, Homo sapiens
cttttactaggaacaggttcattcccttaccctgttgaccaaatactgttgcatgtacacgtgtttaatctcgtctctcttcataatttccagctccacatccgttggctctgctttttcaaattccaaacactttggtatatctaggctgaatgttgatgcctttgatgatctagatattgaatcacgggttgtcaaatccccatcctttctagaagagagtttgaggaatcctccaactgggcctccagaccctgtctgttccactccgggggacttttcatctttacttttcatttgctgttgcttaaaatttaggagagtttcttcacc

SEQ ID NO: 673898 - DNA, 151 bp, Homo sapiens
cgagctgctaatctcagggcgagcagccaactcaggtgctgctcgcccctcagttaggtgcatggtcgcccctcatcttgggtgctcgcctctgatttgttagctcgggccttagtttgtctggtcgtcccctgagttaggtgctgctcgc

SEQ ID NO: 673899 - DNA, 404 bp, Homo sapiens
ctgcgtttcgaagattgtgtggcactgtatgtaatgagacatctacctgtagcatcagaagaactgatttcacagccagtttcgtgggtcagcatggttaaaacttcagcacggatcctgggctcttaggctatccacgacttagtaccccaggacagcaacagcttccaacgtaggaagaatcttgagtatcaccaccaggtcagccacattgtgtcctgtactcatagaccccttattatagagatcccacctgtcgaacttcttcaatatgcacttcaaatgtccctggagccacaatcagattctcaatcacatagtatattatggtcacaagagacaggatagatgcctgttcagcacaatagagagccaggtcatgatacctctacagcaaggcctca

SEQ ID NO: 673900 - DNA, 289 bp, Homo sapiens
accttactactatggctaggatctgataaagtatctgtttccatgtgtaatctcagcttaaataacctatggtgcattcagacgatggaatattattcagtgctaaaatgaaatgaattacacagccatgaaaatacatacagaaaacttaaatgcatatactatgtgaaagaagacaatctgaaaaggctatttaccttacggttgcgattatatgctattgaaacttctaaaactaggagttttagaagtttcaataagccctagttttagaagtttcaatagcaca

SEQ ID NO: 673901 - DNA, 263 bp, Homo sapiens
aaggcaaaattaccgaatgccctttttaaaagtatgctataaactatgctcctctcatccagggggcccattttttaaaatctccagagttgcttacatttagattatccagcccaatcataaagtgaatgcccacccctttgaatgaaattgtggcccaaaatctgtccaggttggtgtcccgtgtaaagtggggatggggtaaaagtggttaacgtcctgttggatccccaaataaaggttccagttttgtaacaaaaaaa

SEQ ID NO: 673902 - DNA, 116 bp, Homo sapiens
ggggcccaggtcccaagccagttttaaagtttggtttttttgttaaatttggaaattggttttggttttccctttgttaaaggtttacaatttttaagtaacccttttttttccta

SEQ ID NO: 673903 - DNA, 3850 bp, Homo sapiens
gacaaatccaactatggttaactgttctttacactaagcaccgcactgagagcaacacaaacaaaactgcaggtgaaggtgtctgcagcacacacagtgagaattcgccctagaaagtacaggatatgtaacatgctgcgggacagatgcagagaggccactttccctctgaagaggaatcacacaccttagcatgtgcctgacaaaaggtattcccttttctctgccagtcccggaatttaacattagcctccaccaaaaagccgtctgattcacttgactgagggcttcactgcttccactggacagaaaaagcaaactgaacatgaagcaaactcagaaatcaaacagctgctctgatggcacagccgggctccatcacacaggcatatttttgaagcataattaatatcaaacgtcaagggtggcaggacagggaggatttagttattctgctacttacactgtcattatgcgttttagcctcttcagaaatgaggtttcttcatcacgtcttttgaaatgcttcataccatcaggtatgatgttaaggaaaaacatctaaattggtttttgtttgaagcatgaaaaagggaaattcatgtttcaggaagcaaagtttttctattatcaacaggttaatgtgtttggtagatcaatgtggatttcggcaatggccggcagaaactccaaccagaaagacccctgaactttactgactttccctggaggccagaggaagtcagagccttggagccagtcagtgcaaaggtggggctggacagggcaaggtactgaaagcagaggtggcgggaaggggaaagctggagaaagacaggaggaaagagggccatgggagccggaatccgaggagaggtttaggctatagggaggcgagcaggtgagggccagagaaggggttctcaaactggggtccccagtggaatggcctgggaagcttcaaaactccccatgcctgggttccgcccacagggactctggtgtcactggcgtggggtgcaggaatttatcctgcctgcaggtgattctatgggacaggcaagttaacaacaattgactgtaagagaatgatgcaggcgtaagtggcagcccccacaagcgtgcctggaaaggagctgcaggtgaggacagaggccccagtgttcatgtgacccgcacaggccaatcctgcaaagcagatctgggataagaataaggaatgcctgaccccagagaccttctctttcaactgaagccctctgacagccagctcaatcccagagtgtcccatctgctcagagccaaaaggagcccagaggttcacagcgtgtgcccaggacagccgccagcctcctgtctgcagaaagatggagaaggttaaacaggtcccccacaacccttccagagcagggctgacagccctgaagtgaggctgcacacacagcttcccagtgatgttattaggagcagctgcacagcttcccagtggtgttattaggagcagcgcttatatttttccataatccagaaaaaaatgtcaataaataggtcttttatgacttggctttaaaatttgtagagggccaaacgccagtcatgatcatgccgtaccataccagtgtctgataaaaagagactgattctgccatccccccaagattgatggccctcaaagaaaacaaggaagaccagtcaataatgacctacttagggggcattttcaaagaaaaataatggtagaacttcatgctgttgaatgactcctatttttgtaaaaatggaatgctgaaataagtcacaaagatcaaaagactttttaacaaaatggcataacatttgaataatctgaatttgacacacagaaagcatttcaatgttatttaaaatagacgtctacctgcttaaacggtatttaaaatgcaatctaattgtgagaaaaaatggaaggaaaggcttgtacacatatttcagagtcagagaatgcattaaaactatcacaagaaaataaaggaattgttatttatcattactaaaaatcaactgtcagtcactcagacaactactgttgaagttgtcaaaacatttctttatataccttaactgggaatttttatcattgatttcaaaatgcagaattaaagataaaccctaattactgtataaaagatactatcaccttcagaaatgagtctgtgggagctttatgcacactccatatgaacttacagatttgcaaagtggaagatgtggccaagatgcatgtttttcaataaagatgttgttcttataaaaaaggtagaagcataacaatatgagctcacttgggaagaataaactgcaggtggaaaaggatgaaaaacaggcagtggatctaaatcttcccaatgtgccacatagttcattagatgccacatttgactgtgaaattaaattaagactaggcttctagctttcctttaaataataaaaactttagttacttgatttaccaggcttttcatgctcacttgaaccatctgcaaaactgttacaaaggtgagcttgaacttgagttccacgtgtcaaaacaattacagttactattttataagcaagttcttcagaagataaatcctctcgaataatagctaagatttatcttatccatgttgaatttctttgaattttaacttatttaaaaggaaaatggcagaaaaggttaatttggatgctgccaaacatgaacaaaaggaagacagaactgtaggaggggctatgacttcaaggaaggcggagcttcctcgggtccatgacacaatactttgagaagtcactgttcatttcacatacaagtttagatatcccaggattacattttcccctacaattagctgtgggctttatttttgccagtctgaaagtagaaactcctaggttcattctatgagaacgtggttacagaaaatgaatcttgcccaaaatgtattatggaaataatacacagatatcttccttattgaatactgacagcagttcagctttaaaagaaaaccaagtatgaaattggtcatgaggccatgaattttatttgtaaagatgatcaagtagaaccaaagttaagcaaacacctctgaccaaaagtagggccaggttttgacaacggatacataattgctcagacgtgagggaaccttcatataccactgggaggaatacaaaatgccacagttgttttggaaaacagtctgaaaactcttccacagatgagaagcagagtgaccatgtgacatagcaagcccacccaagtacatacccaagagaagcagaaactcaggtccacaccaaagcttgaacaccaccgtccacagcctcaggattcataacagccaagcttaaagacaaccagaaagtccatccctcatgagtggataaataacatgttgtagccataaaatggaatattattcagcaatcaaagaaaatgaagaactgattcatgcaaacaacaaaaatgaacccccaaaacatgatgcgaagtagaagaacccaaacacaaaagaccagacgtcctatgttatgtgtatataaagcatcagacgtcctatgttctgtgtatataaagcaccagacgtcctatgattctgtgtatataaagcaccagacgtcctatgattctgtgtatataaagcctcagaagtcgcaaatccagagaggcaaaaagcaggtccctggtggccagggactggggcagggagcatgcaaaatggctgtaaatggcttctttctggggtgatggaaatggtctaaaacctattgtgccaaaggctgcacaactctgtgaatataataaaaacactgaatcacacccttt

SEQ ID NO: 673904 - DNA, 94 bp, Homo sapiens
tcaaattagttatgacactatcccacactgaataccaccatttgccaatttattaatcataaaataacaataaatctctagcttttacaaaaaa

SEQ ID NO: 673905 - DNA, 145 bp, Homo sapiens
  misc_feature (54)..(54): n is a, c, g, or t
gtgtgagccaccgtgcctggccgtgattattgaggctttagctgagcgcagtgntgtaagcctgtggtcccagctacttgggaagccgaggtggtagggttgcttgaggccagcctgggcaacatgatgagaccccatcgctacc

SEQ ID NO: 673906 - DNA, 277 bp, Homo sapiens
ccttgcatgtactgcttatgatgccctagaaactgtgtgcttcctgggcctgttcctccaagcgctctaccctgaaacccataatccatttaagaaactggcaaatgaaaaatcttaacaactactgaatattattctgcctgtctgtgtatttatatgggttgtgtgtgtgatatgaaagcattttgattaacgtggtttaaaaataataggtgcttaaatcaaatattgtcagaaaagtaaaaagtataaatgccttttagttcatgagacttaa

SEQ ID NO: 673907 - DNA, 530 bp, Homo sapiens
aattttgtaacatacaaaaccactgtatggctaaagtcttactgagccaaaaagggaacacagcggtatctccgaattttacacctactgttccctcatctttacggatcattagtgatgaatgcagcagaatttgagaaagtcttcaaagcaagtagagtctatcagtgctttaaacatcatagaaagactttgtattccgaggtcatataaatcaaagcaacaagctttttaaacaaaacagagtaactgtcacaaaagcaatggtacaagcccaggaacaaacaatactttgagtggctctgtggggaatgagaagggaactgttccattaaccactcactagagtagggtttctccagctccattctcagttgtgaagggcagcagagttcctgggccccatggctgtacagacgcctacctcacagagtctgtgcacaggagagagcggaggcgtctcacaagctttgtgatctggagagtttgttcagcatttattctttggaataaaaatagtttatctaaaa

SEQ ID NO: 673908 - DNA, 725 bp, Homo sapiens
taggctaggtacgaggctcggttttaatcggccgagggaagggtcagctgggaggcctgagggcgccgggcgctgcggcaggcgggcccggggtccagccgagagggtccgggcgccaggcaacgctgattcccgcggggtgaacccggggagggggccggcctccccgttctgggacctttcgctcccctgggacctgtggcgccgcccacagaccatgctcctggggcgcctgacttcccagctgttgagggccgttccttgggcaggcgtgcgccgccttggcccgtctctggagtgctgggcagccgggtctgcgggcccctttacagcacatcgccggcggccaggtagggcggctctctccctcgcaagggggcccagctggagctggaggagatgctggtccccaggaagatgtccgtcagcccctggagagctggtcacgggccggtgtgtttctgtgccagacatgtgagtatcgggagagcggggggactgttgtgtctccagcgaaaattataccagtgtgcgacgcagccaatataggggaaggggccgagcagggggatgaaggcgtcgcggatgcgcctcaaattcaggtgcaaaaacgtgctgaagatccgcggcggaagatgaaccacacaagtaccggaagctggtgaaagaagacgcgggttcctgcggaggaaggtccagggagggacgccttgagacgccaaggc

SEQ ID NO: 673909 - DNA, 190 bp, Homo sapiens
tgggctggggaagagggctgggggaagaggggagacagaggcacggagagaaaggaatgtttagcacaagacacggcggagcgagaccttggttcactggtttatctgctgaccttccctccactatggtcccatgacccggccaaatccccctctgtgagaaacacccaagccctcttccccagcccag

SEQ ID NO: 673910 - DNA, 602 bp, Homo sapiens
cacactgccacaacgcctggctaatttttatatttttagtagagacagggtttcaccatgttggccaggctgttcttgaactcctgacataaggtaatccacccgcctcagcctcccaaagtgctgggattacatggcgtgaggcactgagcctggcctatttgtggttttttatattgggtttggtctctggttttggttttggagacggagtctgtgctctgtacgcccaggctagagtgcaggaggcgcgatctcgggctcactgcaaccttccgcctcccagattcacaccattctccgtgcctcagtcctcccgagtagctgggattacagggtgcccaccacacaagcccagctaattttcggagatctccaacgtcacagacggggttctgcaccccatgggttaaagcccagcgacggtctccacatcttccccgggacccctcggtggatcccacactggcactcgggcctcaccaaaaacaattggcggcgtacagaactaccaacgagaaacagcgaccctcacgacagtgtccgcccagagagggacacgcgcaagggccggacaaacccggacccccggaaacccccgc

SEQ ID NO: 673911 - DNA, 529 bp, Homo sapiens
  misc_feature (25)..(25): n is a, c, g, or t
  misc_feature (30)..(30): n is a, c, g, or t
  misc_feature (77)..(77): n is a, c, g, or t
  misc_feature (83)..(83): n is a, c, g, or t
  misc_feature (120)..(120): n is a, c, g, or t
  misc_feature (123)..(123): n is a, c, g, or t
  misc_feature (333)..(334): n is a, c, g, or t
  misc_feature (343)..(343): n is a, c, g, or t
  misc_feature (345)..(345): n is a, c, g, or t
  misc_feature (366)..(366): n is a, c, g, or t
  misc_feature (374)..(374): n is a, c, g, or t
acggttcttacttggaaaaccttcngcagngctggatacaggtgtgaccacacgctgtgaatgagtcttgctgtgtngcctangctggtctcgaactcctggcctccagcctcggcttancanagtgctgggattgcagatgtgagccaggagactcacatctcctgcatccattaaacatagcttacttgttgattgggagatgtgcacaatattctgctaatttgtacattttaaaaagttacatagatgctgttgttccaggggcactggagacagttatgccaggtacaactatgtacagtgattctatattagtttcagtgtatcatnnagcaacttntntctattaacaaattgcttganatatagtnctatagagcatgtggtttagcaaaattagggaataaaccaaaaaagagaaaagcttcgtgtccaggaaatggaggatcaaatattcatagaaaagtgaaggaacaggaagacaattgtgtgcctgtcttaggcaacaaccagttcacattggtgc

SEQ ID NO: 673912 - DNA, 184 bp, Homo sapiens
actgccttcacgggttgacggtgactgactggacggtggcgactttggtgcggggaacacttgttcacggtaactacgcttttctacgtcacggttacggtctaggacggagtacggcggcacggtttctggctcgtaacacacggcctagactacggggacttgtgcggtagtgtgactgcta

SEQ ID NO: 673913 - DNA, 349 bp, Homo sapiens
ttggggctttgggttaaaaagtaaattaaaataaaccttgggttttattaaaaaagaaaaggtttttccctttgaaaaaagtttgccccaaaaccaaaaaagttttaaaacggggggtaaggggcttccccccattttggagcaaataacccaaaagggttggtaaaaaaaaaataaaaataacccggtttaagaaacccttgttaacccattgtcagggccccctgtaaaaaaccctttttttggtttgtttggaaaaaaggcaaaggggttttaaccaaatccccttgaaaaggtgggatgggggatttttgggaaaattttcccaaaaaagggttaccagacccca

SEQ ID NO: 673914 - DNA, 206 bp, Homo sapiens
aggatcacagatgacaacctttaaagggttgtattaaccttaaaatatattttttaaacattggttataaaatttctaatactttcttttttggtgactcaggggaaaatataattcttataaaaagttcaaatgatttacagaataccaaaaagtggatggagatgatgagtgattaaagggaaggatattgctacatagatatg

SEQ ID NO: 673915 - DNA, 1160 bp, Homo sapiens
gatataacaattacacaaatgcaatttaatgaatatttatatgattatagtcaaaatcaagaaaatagaattcatttagatgattggactgcttttgatgaatattattatgaattattaaaaaaatatatcaaggaaaaagtcactaatactaatgaaaaaataagaatttatttcttgcctcattatgataataaatattatgcttttagacttaaatatgaaagtgaaaaagaagctgaaagagaattaggtaaagaagaatgatttaaaaacctaatgtggatttaggaagataatcaaattttcattttgaatttgacatgaagactattatccatttttcgctaaaggtttaaataaatgctactaatttaagaagcatttaaaaacctggttttaataatgcttaacaaatattgaaaaagaattaaggaatagtaaagaccaacaattgaagaaagtgagaagcaattggtttattttaaattaaacaattcatttttataaaatccatttcagtcctttacaaggacccaattgcttaaggcatttaattgacaaaatttaaataaaagtggatattttaagtattccaaaaataaataattgttgatttttcaagatacttaaaaattacaattttgaaattgtttcaaataaaagttttcaaaagttagcaaaagaaaaatataatgaattttagctaaatttcaagatttaaaaattaataaaatttttgctaaggatcttcagcttttttattcaagtaatgactgtgaaactataaagattttagaattctatatttatctttataaagcactttattgactttatcaagttttatatcattagcatatagtaaagaagatgctttaaataaatgtatcaacattaaagactattgtcacgagtattgaaatgaacaatttgttccatgttttattttcaataatcccaaatttgagttatttagtgatatttatacttctataacaaaagtattaccttatctaaataaaactaaagaaataagtgattctaaaactagcgatttagttaattcatttaaggttgaatcttattatgttttaggtttaactattgcattattgtcttatttaaaattcttaacaatttgtcaagttaataaagtt

SEQ ID NO: 673916 - DNA, 204 bp, Homo sapiens
ggccatgcccctgagcgagacgtcagcgccggcaacgtgtacgccaacaacgggacaactccatggcccgccgccggggctatgaccaactgcaacggcaacatgcgtggctgcgacgactacctgccaacaccttccctgcccgccagttggctggataaaccctttgccgactatagccaggaactggcaagcctcaagggc

SEQ ID NO: 673917 - DNA, 929 bp, Homo sapiens
tgtcttgacaaaaaaaaaaaaaaaaaagagaaaaaaagaaaatgctgttggtatttggtgggtctaataaggagttcgggatagcctgtggtatttggcctcatgccaggcccctgaagctgccttgggagaagatgctgattggtccttgtccagagtactggcttttggcacagtgacaggctgctgggacagattgtcctcctgtggcatcttggtggatgtttagtaccaatgatgacacgggaactcacattcacttgacaccgctcttcatcttcgtggtaagtctcttgaagagcatttttttggtacttcttggctgattgacctacctcttcataagccaaggtgaaaccaagtttgacgaactgcctaggactttccacgtgttggctcacatacattgagtgatttctgtcacgactctggggtgtccaaaacacacgtgactttaccagtgtattgtcagaacctccttagtgatcgcattgtccgtgacagttaagctgatggcaaacagactattaactatgtgacttggagcaaacgcttgtagtgtcagtggatatgtcctggagaaaatttctttacccactctggattggggcaggcccctttgactcaccgtgattcatgaccaggcaacacatttaatctgcccttatctgcaggaattccgtactggtgtcatgctaggagaatggggtccacgaatataggggccatccaggcagtatatacccgtctgaattgttaccacttgtcgcgcaatgcggcttaagacgtaagctaacaccactgggtactctttaacatgtgtatctttataacttcccaagagaggcacccccttgggctttccggattacgctttggtggtggctagatctataagtgggcgctattaggctgtgcacttagtacca

SEQ ID NO: 673918 - DNA, 217 bp, Homo sapiens
tctagaggatccctctgatgtgggctagagtcagatctcactgacagttggcatacaaactgtgatctttccaccgctggcataacggactagagcattgcaccgcaaaactacccgtgctgacatacccagtgcaaagccaatgggcaacattcatcgcagaacagccatccagaaccttcgcccttgttccttccagcgtggctagactgtgaac

SEQ ID NO: 673919 - DNA, 171 bp, Homo sapiens
cgcacagtgttcaaatgaagatgaacagtgcagtcagtcagctcatccatctggatcacccagcaacagctggcggcagcagtatatatttgtttgtcaacacataggataattgtagaaaaacccaagaaattgcctcccaataaccagagaaaatcagaaccaacacac

SEQ ID NO: 673920 - DNA, 175 bp, Homo sapiens
cacgtggctgaagcgattctgcctcagctatgtacagtcgctggaacattccagtgatgagattgcagctcatgaaggtctgagtgagttcttcagcaaaagcgacccaagaggtggatagtcttgagaaactctcagcacacatgggcttgccaggaaccatatcaacaatggc

SEQ ID NO: 673921 - DNA, 565 bp, Homo sapiens
gtccccaactgtctctcactgatcctattatcaaaaactgctcccaatgatgaacctgtcaaaaagatcagctaagctcccttggcgatctgcaggaacactagttctgactgggattactccgttgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggcgacaattatctatctccaaataataggcttttatttcttgcagctaactttttcagtgattctagcagatgccatctagtacatccttgatcttgtttctttcgtgag

SEQ ID NO: 673922 - DNA, 958 bp, Homo sapiens
taaccgctgagtctgctctttaatggacaccgcccatttgttctgcccctgatctgaggcgggaacaggaggggtcttgggacaagtggtgccactgtgggccgtgggttgccgcacagtcgtgcctccctgtggggacagaaacccagcagggttcgagcccgtgcaggccatctcctttccaggaagggccacaatatagcagccgccgtgccctcctcaagccccgaggggagggccaccacgaggctgtgggtgtggccacccagtgtggccaggcccctttagctgtgggcccgcaggcagcactgtggagcccgcctgtggaaggctccgaggtctccgtgtggaggtgtggggagagggggtttgcaagaagtgtctctgcgtggagaggctcaagaggtgttcaacaccctctccactattgtgtgggtgctctctctccgcgggaacgtggccgtgttgtggctgtgggagtctcgagttctccccccctgtgggctctcccgcgtctcttgcgttgggggcgggggagaccttgtgacccctgtgagagtctctgtggggtgtgccgagaggacacacaagtctgtgtcccccgagaagacatcttcatgtgggcgctgtgttggcgccgccgggagccgtcgtgggagaagctctccctttgtggcccccatattccaacaccaagaggagaaaatcttctctctacacaagaaggtgtgagtgtcgcccgctggcgcgcgtgagactccacgaggcggtttccccgcggggggcgcgctttatattgaggggaactctttgtgcgcgatggcgtgtggagaggttttctcacccgagcggggggaccaccgttgtgaaccttcgaggcgccccccctttcccggggggcgcatttttagcggcgtgcgcggttttcaacgagcactttcgggtttcccttttcccg

SEQ ID NO: 673923 - DNA, 732 bp, Homo sapiens
aaatacctacagaggtggaggtctggcgcacctttacccagttttccccaatggtaacacctgcgaagactgtagtaccagataccagagtgtcaactgacattgatacagttaaggtatagagcatccattcagtcacaaggatccctcctaataccttctcatagctacttgggaggctgaggcaggagaatcgctggaacccgggaggcggaggttgcagtgagccaagatcactccaatgcactccagcctgggtgacagagcaagactctgtctcaaaaaaaaaaaaaaacaaaaaaaaaaaaaaaatatatgtgtggaagagcgcatcagcataggacatcgagaaagagaagaggaaaaacaagggctgggcaccagcagcggcgcctccacctctcccacagccaccttctgggaagcgtcagaggaggggcaaaacatcactagtgtgaaaccccggagaggatttgagcagcacacccccgtgggagctacttatagtgggaccacccctcgactccctctctaacccaacaacactatttgtatacaaccagtgatcctgtgttgcttgaaagcaatatattctgtcacaaagccttacgtctacaaccctgggtctaaagagggggcgaagagaggagacatgtgtggccacggagggcacccacaaccatgcactccgggaaaagcgctttgaagaggtggaaaggacatcggctgcag

SEQ ID NO: 673924 - DNA, 689 bp, Homo sapiens
tatatcactcaacaaggttgtcagaaaacttacacagtcaaatcgagaaaacgagtgagttgaacggataacgacggaaaacacgagcttcactcttcttatgttattattgttacaaagagacgggaggtgctcactaccggtcaacccagggcgtccgggtgtcgccgcggcgtgccgtcgtacaactcactggagaaccctctgggatcgccggcggtccagatggcgatgtgtccggggcgctgaaggacatcaccggatgtacgcatggggactaacaaggcggcggccagaacactacgcggggagcataagtaaggggattgacaatggtggaggaagcggggagattttgacgcagattcggtggtgacaaagggtggtgttgataagtgacagactgtgaacttttgtcacaacgaggaattttaggggaaagactacagtggtaaatccggagaatcacaaattgtccatttagcaccattgcagcgaagtaagaaagtgcttgaaggtacacaatttaagaattcgggccaacaggagggtgttaccagtgagagttgtggggaagatagggcgaaggttcgaaggaatttataacttagcccatggtttaagaaagggggatgtaggtataaatcccatcaggagcagagtgtgggaaagagggaagatgtagatat

SEQ ID NO: 673925 - DNA, 148 bp, Homo sapiens
acagcatgcactgtgagaccattctataaaatacaaaaatagcaggctgtgtgccactgtggacagtactaggagctgagatggaggatcacagtcagggatcagacatctgctaccacgtgaacctgtctcaaaaaacaaaacaaaa

SEQ ID NO: 673926 - DNA, 320 bp, Homo sapiens
cctgtttgatgcctgctgagggacagttagactgattccatatcttggctactgtttatagcactgcagtaaacatggcatgcaggtatccctttaatatactgattttcttagcactggataaatacccagcagtagaattgctcagtgggatgacagagctattttcagttgtgtgagcgacctccatactggcttacattagtacctgcactaatttacattccaaccaacattatataagagatcccctttctgtgcatccttataaagatttgttacttcttgacttcttgatgatagccattttaactggaaat

SEQ ID NO: 673927 - DNA, 1038 bp, Homo sapiens
gatgcagacttgcgggacgtgaatgcgctcgagtctgtgagtgctgccgttcgttcatcttcccgtcgttagcagggacctctcaatgctcaccagggactacgaagtctagctactgcgtggcatcgagtcatcagctaggtaacatgctgtctcaggcatctgggcctcccaacaggcagtatgtagaagctaacaagctatgccgtagcagatgctgcgaactatggtggtgcatggggttgttggaatacatgctgctacaagaggtaagggtgatcccgtggaagcaaactaatttcattactttgcatgggggaatggaagacgtgtagtggagtcctatgggaagtcgtgagaagtacaaaaagcttatgaaagtcaatggtgacttgaaagaggtgcctatgacaataatactggaatatttgcatggccctcttacttcgcacatattcctgtcacctggttatcacccttggcgaccagatatgtgaacggacactctctaacctaacactcaaaacacactcacgacggggggaccacgagtcaaaaatacatgtcccacacgggggcgtgcaaaaacttccgaagggttacccacttgcatgcacggcttgggaatcttaagaatcgattggccatttcctaagaacgaaaggtgttgactattacttcgcaaattgcttaactaattggcctttatactatgtaaaaaccttggggcaaaatttagtgcggaaactggtaatgcgactggggattacaaatcttgaatttgaaaattccgtattatccagggtccacatgttcccctgggaaggcgcttttcaaaagaaagggctgggggggacacggaacatggttgacaaacctcaatccttccattggaaaggaacagggtttgaataggccgaggaagaacaatcaggagttgaaaggtccttttggcgttcctaagaggggaagccgtgaattaaaaggttggaggttccagacttcacctggatttacgtccttgaatatacaatttgg

SEQ ID NO: 673928 - DNA, 111 bp, Homo sapiens
cacggccagatttgggtaatatgtacatagtatatgggtgagcttattttggtcgttcttaactcatggtgtagtctaaaggtgggggaaaaaataaaatacaataatcag

SEQ ID NO: 673929 - DNA, 494 bp, Homo sapiens
ggtacaaatagtgcacacaaattagtagcactgctatattttacagtgaccaagctgagaattaaattaagggttcattccctttaacaatagcacaaactaaaataaaatacttaggaatatacctaaacaaggaggtgaaagacctctgtaaggaaaattacaaaacactgctgaaaaaagtcatagatgacacaaacaagtggaaacacattccatgctaattgatgggtacaatcaatattgtgaaagagaccatactgccaaaagcaatctacaattcaatgcaatttccatcaaaattctaccatcattattcacagaacccgtaaaaacattcctaaaattcatatggagccaaaaacgagccaaaaacaagactaagcaaaaagaacaaatctggaggcatcactttacctgacttcaccctaaactataaggtcatagtcaccaaaacagcatggtagaggtataaaaataggcacacagatcaa

SEQ ID NO: 673930 - DNA, 466 bp, Homo sapiens
gacaatttaaaaaatgagcaatgaaactattagtgaaaaggaattaaatttatcttcactgcttatggtaaagggcacagtggaacacagattgaaaactacaaattttttgatacttaaaccaaaacacagtgcccagataattttcccaagccaggaatttgtctattttttgttggttccaggagaaaaatggcatacgtttagcattccatatgtttagcattccatatgttatttgttcaaacatcttagtcacatttctactcctatatttggccaatttatcttaatatagtgtttttatttaatagatcaccacagaagaaaactaggcccttttctctagaaaaacgacaagacctggagctactgttgtagactgctgagaggttctatacaattagcggaaccattttctttacgttaaaacctctaagtcatggctttgacctgtgtttcagat

SEQ ID NO: 673931 - DNA, 194 bp, Homo sapiens
atgggtagctaggcatagagggtatatgggttgcctgccccattactgctgctatagctagaacagtcctttcccctatccctacgctgggcagcttggaggtaccctaacccaaaactactagtactactcctcccgccagatggctagacagtagctagtaggtagtcgtaggagaactatttctagcctct

SEQ ID NO: 673932 - DNA, 178 bp, Homo sapiens
accaatctttggagagaccacagcacctgcgtgctttgatcgtgatgttcaaggcaagttgcaagtcaaggacaagtgtcccagaggccctgggctagctgagtgcacctcgtgtttgatcttcccctgagtgatggacactcccagctgaccatccatacaccaggaaaacatccct

SEQ ID NO: 673933 - DNA, 885 bp, Homo sapiens
  misc_feature (738)..(738): n is a, c, g, or t
agagattctggtacattgtctctttgttttcattggtttcaaagaacttcttgatttctctcttaatttcattatttacccaggagtcattcaggagcaggttgttcaatttccacgtagttttgtggttttgagtgactttcttactcttgagttccaatttgattgcgctgtgatctgagagactgtttgttattacttcagttctttagcatttgctgaggagtgctttacttctaattgtgtgatcaattttagagtaagtaccatgtggcactgagaagaatatatattctgttgtttgggggtggaaagatctctagatatttatcaggtcccacttgatccagagctgaggtcaagtcctgaataactttgttaattttctgtctcgatgatctaatattgacagtggggtgttaaagtctcccactattattgtgtggaaatctaagtctctttgtgggtctctaagaacttgttttatgaatctgagtgctcctatattaggtgcatatatatttaggatagttagctcttcttgttgaattgacccctttagcaataaacgaaagtttaactaagctatactaaccccagggttggtcaatttcgtgccaccaccgcggtcacacgattaaccaagtcatagaagcggggtaagaggtttagatcacccctccccataaggtaaaatcacggagtgtcaaaaccagtggcacaaaagatacgaagggntgtacttctgaccccaaggtgaacaatgggtagtcccctgttagcgaaccacagtatcacaatggccacaagggcagtaaacaggcgcgggcaacccaagaggtggacacaccccgccgatcgccgggggcggcacgggagtggcgt

SEQ ID NO: 673934 - DNA, 235 bp, Homo sapiens
ctaagaaccacaggcataactattattatgccattattgtggagagaacagtctggagagaactgtgagaaccagggacgtaactcatggctgtcactgatatctcaaacaggtacctaccaagaggaaagatcctgtcactacaggtttcttggaacgaagtaaagaaaacatgcagcaaaaagacagaaatacacttgctattcttccagatagtccatgctttgtaagcacc

SEQ ID NO: 673935 - DNA, 194 bp, Homo sapiens
aacgaatggtccttcgctctgtgagcgtcgtctcagcagctccaaacttcagcagatggtgtggggatcactgtggtgctctcctcaatctgactgagaccagtacttgtctagctcgtctcggttcttgcgagccaggtcgtcatattgggcccggatgtctgccgtgatcttggtgaggtccgtgagatttg

SEQ ID NO: 673936 - DNA, 336 bp, Homo sapiens
  misc_feature (242)..(242): n is a, c, g, or t
agcgctgaagcaatacaacagagctccagcctaacctcagttcctcccactactttcagcctcaccttcaagatggagtctgcacgcaaagcatgggagacttctccaaatgtaagggaaaaggggtctccagtacttccacagcacctccaattgcaactggagtcagcagtcgtgccagtggaccaggcactgctaattacaatacgttctcaagtgcatccatgccccagattcctgtngcttcagtcactcctacagcatcactatcaggagctggtacatacatacctcttcttgagcacaaaattaccgtgggggatcctctaggtcacc

SEQ ID NO: 673937 - DNA, 229 bp, Homo sapiens
  misc_feature (192)..(192): n is a, c, g, or t
cagagattctatgttgtttgatacagagtactgccagcatgcccgctaataagtgtatttttaatagagacaggttttcaccatgttggcaggatggtcttgatctcctgagctcatgagtctgtctgcctcgagccctcccaaagtcgctgggacttatagcgcgtgagccatcagtgccctagctggccnaggtcacttctttgacggtggtggccacgcctatgcg

SEQ ID NO: 673938 - DNA, 908 bp, Homo sapiens
agcggggtccacatgcagtgaacacgtgctacggcgtacaggtaccttctgtcgtccttgactgccatgcgtaggcacatgatgcatacaggaaccggaacggtggactgtgtatggctttgtaggagcctggatccggggcactattcgctcgcatggatggttgcaagaccgtatatgcagtgatgtcttcatatacctagagcccttctggagcattatctctatgtagatcacggaactggaacgtgacctctctagaaatccacctggagaagatctacgagcaaaatcccagggtcaccagacacatcacattgcgtacttagagggatggacgtttgaagaagttacacatcaatcaggatccagaatgactgacgatgcggatctggaagaccttactcgagacacacatgacagacagtaaccgatgttttaccagagtctattcgcatatgaactctcagcagtagtgatcattccagtataagccggcgcgccgaacataggaatacgggacttactgtgaaacgcgatcgcttctattgatggcgtaccgcgcgagaacggactcctagtatcgaccagccagggtcgcctctttctccatcacaaattgtaggaccttctggcgaattgatctgggagctggaaactcctgctctatcgctgatgcataagcagaacctggaggagagaggccatgagaaagttgtgtccaggtaccttgagcacatcttgactgggacctggatgtcctaataggatccatatttactacgtggaaacttgaacgaaaggacgggagggactttgttgaggaggctagcaagggatgagaggaactccctggggtcaacccacacaatgcaacgtagaccctatcgatcccggcaagattcccg

SEQ ID NO: 673939 - DNA, 165 bp, Homo sapiens
gagacgagtaaacgaaggaggtgacgccggggtctggcatggggaaccagatgggtggtggtgccattcactgaaatagggagcactccactgagcagatcttctgagagcaggtccaatcttcgggatgaaaattatccatgaagctggttatccagaagaggt

SEQ ID NO: 673940 - DNA, 716 bp, Homo sapiens
cgcaacgggttctagcgctgcaggcagcgcgaggacccgcggacccgccccggctcggcctggcagatagcagaggcagcaggccggccgggggggcatgtcgctgtaaccagtggcccagggagatgttacggagtggacagttgcaccttggagggcgtggccccgcatgggcgtgataccatgcttgcagttggtctgctcgggcatcagtggatcatactccctctcgtgggtgttactgcgtcctgggtggagagacctagtggacgacacctggcgctcgagactaggaatgtcgcacgagtttatcaacttgcacgattggtcctctggctgttctgggatcgatacatgactggacctcccgcagagttggaaggtcgtgcgctatacctgctgcgagtctgatgcgtcacttggtggagatagcgcccttacaattgccggcttatgggaagcactccacaccggtcacttcatactggatcgaactaccagtccttcctatttggggtgccggtggcgggaagattgcacctacccggacagggggcgcccgtggcctaagattgttgcctgctaaatggcccttattggaactggttcattagttactgtccacagacgttgggttattcaacaaccctcccgtaaggattgttgctacggtgtagcaaggtatccatatggggtggggccccgggggatggggc

SEQ ID NO: 673941 - DNA, 113 bp, Homo sapiens
tgactgttatatacgtgctcagacggcagctccccgctacagcgcaggccctgttgcgcccacctccgcgagcaggcgctcacgtcgtacgtctgacgcgcctaggtggcgtc

SEQ ID NO: 673942 - DNA, 174 bp, Homo sapiens
tcatgtcgcttcacggtgtcactcagcgccgttgatgtgtgtgccacgcccctggcatagaacacgtcttccgccgcatacgatagcgatgtgtgtgccacgccccgcgcatagaacacgtcttccgccgcatccaggatgcggttacgtgtttccagtgcctcttccttcgct

SEQ ID NO: 673943 - DNA, 509 bp, Homo sapiens
agcggggtggaagccgccgccacgctcgcagcatcgcaggcgccgcgtagccgtcgccaccgccgccagcccgtgcgccctcggctgcgtacccgctcgcgctcccatccccgctcgccggccaggggcagcgctcggccgccccggacagtgtcccgctgcggctcagcgagcgatggcagacccaagatcgatcgaatagatggcttgccggcgcggcgtacaatcctggtgcgcgatcgcacggcgtacggccagtcatctgggtgacttttaaatatgacggctccaccatcgtccacggcgagcagggagcggagtaccagacacttcatccagcagtgcacagatgacgtctacggtagtctatgccttcgtgtcgcttcaccatccggggatgccatgcagcaagatggtcctaaagttggccctcatcacgtggtatcggtgagaactgtcatgcgggctgcagctgcgccaagaaccgggacggaccagaccctggtgaa

SEQ ID NO: 673944 - DNA, 225 bp, Homo sapiens
ggctcgtcccgcttcgtgaactcactcgaaaagcgacccgtaccactcctccataccgagaactcagcagaagcgcccgcctcatgtttcatcggttctacactagggcgataaggaacgataaagtcgtgataaccaataccctcgtcagtactagtccaaaactctatgaacacttctgccgtttctggtataggccgatcacccgcaaaccctaaagtcccc

SEQ ID NO: 673945 - DNA, 952 bp, Homo sapiens
cgtcaaacccactccagccttactacgcagagaaccgttagtccaagaccagtttagcccgaaatagagagtataggcgatgagtaagttgaaagcctggccgtcagatagatatagtatccgcagagggaaaaatgacataattataatcaagcatagtatagtcgaaggactaagcccatatacctatctgcactaatgaattaactagaatgtaatcttggctataggtagaaccaaagcatagatgacccccggaaatcgagacagatgtcttaccgtataggatccgatgggtaaagataggaagcacacccggtcatatattagccaacaaatacgtgtggaagattttattccggtggatggctgactgagactcctacctgagccgtggtgatagcttggtttggtcctggagtagaaatgttagtgtcatctttagatttggccacatgaacgccatcctaaaattcccgcgaagagtagagaagaaaaagcatacaatgatttattgagagaaataacaaacaagaggcgagggcttcaaaatatatatgtgaccccactgagggggaccgaacattttggaaggcacgaaagctctggcccccatatgggcggggcggagagacagagaacgttttggtaaaaaccacgaggaccgggggtggctatgagcagggctttccagccaggcgggcaaaaagcttatggccaggggccagccaggaagggaaacaacgaaaacattggcctggggcagggacgacgtggaggccagaagacacctgacagggtaatgctaaccgcgtgacgaacaagattagagaactcaggccaagccaccggggtgacaaaggcctaaattgctacgccgaagacatgtttctccacacagtactcctgtgtatgcacaatatacacagggggtcgagaaaaaagtgtaggt

SEQ ID NO: 673946 - DNA, 138 bp, Homo sapiens
ggcgtgtgaagatagaggacttgtgcaggtggatgatggcagaaagatgtatttgtcccaggctgtcctagttggagaagttacaatagggggtgtgctttataagatttgcaggaaaggcattcatgggtaccgagc

SEQ ID NO: 673947 - DNA, 496 bp, Homo sapiens
ggggacagggtctcactttgtcacccaggctggaatgcaggggggcgattttacttagtttactggggccctgacctcctggactaaaacaatttttctgcctaaacccttcaagtagctgggactgggggggcatgccaccatgccggggtaacttttggggtttttggaaaaagggggttttgccatgttgcacatgctggttttgaactcctgggctaaaacgatttgcccaccttggccttccaaaatggtgggattaccgggggaaaccaccaccccgggccccattgggggatttttagcatccccttgctccctgggattaaacataagagatgataacctctggaagaaaaaaaattttactaggcttgggatatttttttcctttttcagctttatacaggggatgggatctttagttttcctttaacggagaaaaaaacattgaagggaaatagtttccctggaattacagaaatacccggttcct

SEQ ID NO: 673948 - DNA, 621 bp, Homo sapiens
accaggagatagcaggatatcgaaaacgacagtcccaaggatctccagacttccagtgactgccaattatggtccactgggttactaatatgtgcaattccattactagctgctttttttttttttaattgggaaggttggcttataactcggatcagggccccattttcatccttaaccctcgggtggtctgctttaaggtcgggtaacttttggagctcttctcccatttcagatattcttctttctagagctcttcgtcccctttttcccattcccaacagtgatctatcagcaaatctttctggtctcgggggggcctttcccacctgtaattaaagatctgttagtcccatattggtatcatgtagcggtgcctccagctttccatttccagctagattgggtccataaagcttttaaaatgtcagtggagtcatcctcttatagccggctgctgtagggtttccttcctcctaagtacctggtatgatccagagcgacccagcagggaatcatatcgatcaccagttggtgtagaccgggttccatatctagaagtggacccggcggagtccttccttatgggcccctcttcggtgttgatggtggcctggccat

SEQ ID NO: 673949 - DNA, 405 bp, Homo sapiens
gggtcaccatcattagcggtgatatgaaaatctgttaatctgggaatctggtctgatgggttggggatagggactggcctgaatttacaactcagggaatctctttctgagttaaatggggtctgtattagggggttattatgggagtatctgttaataatggggcctcaatgatcgagggctggctaacaggggtctctactctggatgtgttcctgggaatctctatctcagggtgactcagggctcctcgggtgtcaggagatgctagtggggactctgtctctttgtcaggtgttcagggcctctaagactgcatctccggcctcagcatccaggtgaaccagcagcagaacagcaacctggaaatggagttctctgatgcaatgtcctttggggtccgga

SEQ ID NO: 673950 - DNA, 783 bp, Homo sapiens
cagagggcatggaagctctgcaccagcatgtatcgcatatctcagcctacgcatctccgtcatcgtagtatacgcttatgcaatattcctgtgtaataaagtcggtccaaaaaggccttctttcaaaccttccccaaagccgtatagtatcgtggaacacctaaaagactcaggcaaactttgaggatctagtcaacatgtaagaaagtacagactcgtactgctgaagtctcagaaattctctaaagtcataacacattcagatagcgtgacagtaagacgtttatgtttctcctttttccctagcatttgggctaaagtgatgatacgacaaactttctatccatcaatgagcatcaagaagcaatcccgaaatgagcaaaaactgctttgttgcaataaggtgtaaaagttaagcagcatggacagtcgacatttcaccagtggcgaaacatttgctgcatgcaaaaatgaactgaagagcaatgggtctctgatctgtcaccaggctgaagtgcagtggtacaatcacaagctcactgcgagtctcaaacctcctaaggctcaaacaatcctcccacttcaggcctcccaacgcagctgggaccacaggttgacatcaccacacccaggtctgctggaatttgctggaggtccactccagaacctgtaagtctggatatcaccagcagaggttgcagaacaacaaagatcgctgcctgttccttcctctggaagctttgtcccagaggggcacccagcaaacggcagctggagctcttc

SEQ ID NO: 673951 - DNA, 384 bp, Homo sapiens
  misc_feature (6)..(6): n is a, c, g, or t
  misc_feature (96)..(96): n is a, c, g, or t
  misc_feature (115)..(115): n is a, c, g, or t
  misc_feature (171)..(171): n is a, c, g, or t
  misc_feature (199)..(199): n is a, c, g, or t
  misc_feature (228)..(228): n is a, c, g, or t
  misc_feature (323)..(323): n is a, c, g, or t
  misc_feature (335)..(335): n is a, c, g, or t
  misc_feature (345)..(345): n is a, c, g, or t
  misc_feature (361)..(361): n is a, c, g, or t
tgactncagcccggcgccgctgctgtgcccactctgtcgccagcccacagtgctggcctcagggcagcctgtcactgacttgcccacggacactgncatgctcaccctgctccgnctggagccccaccatgtcatcctggaaggccatcaagctgtgccttaaggaccagnccaagagccgctacttctgcgcagcctngagtctacacgctggaccttggcccccancctgggggccagactgggccggccccagacacgggctctgcaccgggtctacgccatccttatcccagcaccactctttgagggagtgtttccgnaacccttagttncgcattttgnctacctgatggccgtnatcttaagtgtactctgtgctca

SEQ ID NO: 673952 - DNA, 117 bp, Homo sapiens
cgtatgctttatttcttgttggccaacagcttctttttaatgttctgtgaaaaattattttaagtgtcttaaataatggggcttttatggttattaaaaattgtaaatggtttccca

SEQ ID NO: 673953 - DNA, 897 bp, Homo sapiens
cgcgatggctcacgcctgtaatcccagcactttaggaggccgaggcaggcagatcatgaggtcaggagattgacaccatcctggctaacatggtgaaaccctatctctactaaaaacacaaaaaattagctggccgtggtggcacgcgcctgtagtcccggctacttgggagactgaggcaggagaatcacttgaacccaggaggcggaggctgcagtgaacagagacagtgccactgcaacaatcagcctgagtgacagagagactttgtctcaaaaaaaacaagaaaattttaattttaatgtagccggtctgaattatcttgtcctgcagtggtggctttggatgcttattaatcagagtgtgtcacagactattctacattcttctccgtgtaagctgtccagcttttcctttcatattgggaaccccttacacagggctgaaagtccagctggtacaccccgggtgtgacacccttggctgccatctgtccctcaccggtcagcacacttcttctaacttgggtagatgctgggctgtacggtggcctaatttgcccttcatttcccaacctttgagattgccctttgttctcaaggaggccacgggcaggaggatggctttgagccaggagttgagacccagccctgggcaacacaatgagactggctctttaaaacaaccaccacaaggggagacacgggggcaggtccaaaggccgtaaccccaaacttggggcgtcggcggggacaccgggagtgaaatcaaaggacctggctctgacatccacaccaaacacgcacggtgggggcgcactcactggggagagacctaccgagcgggcacacccctccgggcgagtccaaaaaaagcctctgcgtgtcgacccgtaga

SEQ ID NO: 673954 - DNA, 1148 bp, Homo sapiens
  misc_feature (299)..(300): n is a, c, g, or t
  misc_feature (325)..(326): n is a, c, g, or t
  misc_feature (331)..(331): n is a, c, g, or t
  misc_feature (333)..(333): n is a, c, g, or t
  misc_feature (345)..(345): n is a, c, g, or t
  misc_feature (362)..(363): n is a, c, g, or t
  misc_feature (373)..(373): n is a, c, g, or t
ttttattatatagtgttataaatgtggtggttgattattaagatcttaaagtaaaagtctgatttatttaattggaatgcgaaagacatgttaaacttagatttctcgtaagattatctttgagttaggtcagagagcttttacaactaccagtgttattaatctgagatttcatgtgtcgggagaactgtgaatccctctgaaatgtgcagagacttgtatgttaaatgcattttcaggaaggaatggttacatggctttctttaaagggatctgtttccagtaatagtattcttttnngtccacaaatcatagatgtccttanntccantngtcttctcagtngaatcttagagaaattnncttttgcaanttcgctttcctgttgaccacagtatccagtgccctttctttataatcttttgagctgagtaacaaaaacttttaagaacataacaggattctgtttagggaaactttgtgaactagatttgatttgatgtgagtcagggctaataaaaacgctatagacagaatttcgctttccaagtaagtaacaacatcctctggttcttacttaacggacaaacaactagctatgtcattaggtaaagtaactcgtgacaatacaacctggtacaacaacttgtaaaatagaagcatatttcaacctgtcaaggtgtcttctctctctaagacttcagcgaattcgtatttgacaccaaaagtctccaagttaaagtaagcccatacattatgcatggcattaacactgagacactcggcatctatttgcattcgaattcttcagtccctctttactgggcggttgatgcggacgggtttcaaaatccaaggagctatcaaccctgatgagctgcccacccgtggcctatcctctatatatcaacttcttaccaggatcattcgttacggggagaaattttcccaaaggttccggacaagaaatcttaaccaattgactcgcgattttccttacggtcatcttagacaataactgggacatacatgtgcgagccacacctttttctccttaagtccaatacaccgtaacataaaggcgtgtcactacgggctcatgtcgtctccacgagaattatacgagtggctaccacattggcccttaa

SEQ ID NO: 673955 - DNA, 273 bp, Homo sapiens
ctaaacaaggacaaaagttgaagcatggatctttttgggcagcagctgtgatttttgccccttttagctccctcgccgagcaccactccctcaaattttggtggcagagcaaggcagcattgtgagcagagcaagtcctaaaaagaacatgggttcaaatttggtttttgtcactgaccaacagactttttacctttttgagccttagttttttcaactcctgcttcatttcacattttaaaaagtagaaaaaagacaaactccatgttttta

SEQ ID NO: 673956 - DNA, 174 bp, Homo sapiens
  misc_feature (26)..(26): n is a, c, g, or t
aaggcaataagttgcgataagtcatncggttgaccaaggttatacagggaagagactgaagtgtacccttgaataggtttactgtagtcagagtacgaaactctaatttgggacttggacttacggattggggattgggataactatggagtgaagagcaatgatgggttgggc

SEQ ID NO: 673957 - DNA, 366 bp, Homo sapiens
acccgcggtgtggccctggaccagtgtgaacatgtcttacgaccagttaatccatctgcacagtgcgccacagcggcggcggttaaaccggggcttgcggcgaaaacaccactccttgttagagcgcttgcgcaagcccaaaaagaaggccccgcccatgaagaacccgaaagtggtaaacacgcacttgcgggacatgttcttcctacccaaaatgtgtggccagcatggtgggtgtctccaccggcaagcccttcaaccaggtggagatcaagcccaaaatgatcggccactacttgggcgagttctccttcactcactcctctctcaagtaatggctcagttaataaaggcgcacatgtctcc

SEQ ID NO: 673958 - DNA, 168 bp, Homo sapiens
agaaaagggtgtgtctgatatactcgtatgaaagttctgacaggtttatctccctaggaaggtgcagcacataccccaacacactggctctgccattgagccaatccaatatgatgcttgttttgtgagcaccctcacctaaatcgttaccctacctgggtacggagc

SEQ ID NO: 673959 - DNA, 395 bp, Homo sapiens
cgtcgacttttggtggtttaggtttcgttctgtcccttctgtgccatctttacccgatccattggttattgaacacatatgttccctgcaccacatctgatctccatggcaaccagaggtggttgctaagtgctggtttcattcaggctgtttggatgccaaatgctaagtaccccaccccgaccagctaaaaggagaaggggaggaggatgggagaaggattcttgggagagccaagatgtttaaattgctctcagctcctaaggataacagcatgctcaatgccctgccccgcccccttcactatcagttagcatatcaaagcacaccctgagctagcccacagacgatgctcctgggcaagtttggccatcttatttgggtttagtcgacgc

SEQ ID NO: 673960 - DNA, 178 bp, Homo sapiens
gggaaaaaaatacttcaaacccctttttcttgctttatttttcagggttttattgctttaagaactgtttaaccctgaaatccctttaggttatttattctggataaaaaagcaattccccttaaaactggactttggcccacttttttattttgcaattaaaaatttttttcccata

SEQ ID NO: 673961 - DNA, 120 bp, Homo sapiens
gtccgggctctaatggatgccttcaacttcaacaatatgggtgacgctgctgtcccagctgcccctgttgctcttcaccctacctcaactccttcctgtaccagtgcagcgctgggtcaa

SEQ ID NO: 673962 - DNA, 519 bp, Homo sapiens
  misc_feature (6)..(6): n is a, c, g, or t
  misc_feature (18)..(18): n is a, c, g, or t
  misc_feature (21)..(21): n is a, c, g, or t
  misc_feature (42)..(42): n is a, c, g, or t
  misc_feature (54)..(54): n is a, c, g, or t
  misc_feature (69)..(69): n is a, c, g, or t
  misc_feature (97)..(97): n is a, c, g, or t
  misc_feature (164)..(164): n is a, c, g, or t
  misc_feature (197)..(197): n is a, c, g, or t
  misc_feature (220)..(220): n is a, c, g, or t
  misc_feature (237)..(237): n is a, c, g, or t
  misc_feature (337)..(337): n is a, c, g, or t
  misc_feature (344)..(344): n is a, c, g, or t
gttggnccctttcaaagntcnggcttttccaacccctttttncccccctaaccntgtccccctgggaangcttgactttccctatagggactacatncaatgagcttctttccccttttgaggttatgaaatttatttccctactcccgtctcatgggtttgtncctttagctgactctgtcccctttgactgaagntcactgcttctcttaaatgtggnccctctcggcccgggtncggtggctacatgccctgtaatccccagtactttgggaggctgaggccggcagatcacctgaggtcgggagtttgagcccagcttgaccaaatggagaanccatgtntctactaaaaatacaaaattagctgggcatggtggtgcatgcctgtagttccagctatcaggagctgaggcaggagaattgcttgaacccgggaggcggagttatggtgagcagagatcacgccattgcatccagcctgggtgacaagagcgaaaccctgtctccaaaaaaaaac

SEQ ID NO: 673963 - DNA, 211 bp, Homo sapiens
tacatacagcggaggtgcgaacagtaatattgcagaacggcaaattttgctgtctgatccttcttctgaaagcttcatctcagaggggcacctggctgtatgaggtgtcagtgggcccctactgggaggtatctcccatttaggctactcaagggtcagggacccacttgaggaggcagtctatctgttctcagatctcaaactccatgct

SEQ ID NO: 673964 - DNA, 681 bp, Homo sapiens
  misc_feature (72)..(72): n is a, c, g, or t
  misc_feature (444)..(444): n is a, c, g, or t
  misc_feature (476)..(476): n is a, c, g, or t
  misc_feature (548)..(548): n is a, c, g, or t
  misc_feature (550)..(550): n is a, c, g, or t
  misc_feature (557)..(557): n is a, c, g, or t
  misc_feature (571)..(571): n is a, c, g, or t
  misc_feature (633)..(633): n is a, c, g, or t
agaggacccttttgtatacagcttcattttagatgagcattcttatttttgttgtttgccccatttcctttngtgttttatagtctatagcattttaaaactgctgatgttgttgcattatttacaggctaaaaacttagtagcatagagctgtctgccacagccttctgacaaagtttacagttattaaagttgcagtatccttttaaatgctagtaatcagcactctttcttttttttttttttaaatagagacggggtctcgcagtggtggcccaggcgggtctcgaactccgggcatcaagcgatcctccggccttagcctcccagagtacggggattacgggctctttctttttaaacataaaagtttacactgggtattaactctgtactcggccctagatggtttaagcttctggttctggtaatcatgagttcggntgggagatattctccatagatgatcttctacnggaaatgcctaaagaagtcccaggcgggcttcggtttatccagggattttttaaaaaggtcaactcagaaangngatacgnagcttcttcaggtntgtaacagcatattaaacgggagacagggatgaatcagttacaagggtaatatgggtttaanatcaggtgtaagatagcggcttaaggggtatccatatggcaggctttg

SEQ ID NO: 673965 - DNA, 951 bp, Homo sapiens
  misc_feature (19)..(19): n is a, c, g, or t
  misc_feature (24)..(24): n is a, c, g, or t
  misc_feature (86)..(86): n is a, c, g, or t
  misc_feature (704)..(704): n is a, c, g, or t
  misc_feature (727)..(727): n is a, c, g, or t
  misc_feature (824)..(824): n is a, c, g, or t
  misc_feature (867)..(867): n is a, c, g, or t
  misc_feature (914)..(915): n is a, c, g, or t
  misc_feature (951)..(951): n is a, c, g, or t
tctgagacagagtcctgcnctgtngcccgggctggagtacagtggcatgatctgggctcactgcagcctttgcctcctgtgatcangtgatttctggctagtttttgtatttttagtagagacggggtttcaccatgttgccaggctggtctcgaacccctgacctcaagtgatccacccgcttcggcctcccaatgtgctaggattacagatgtgagccactgctcccagccattctattaacttttgactagcatatgattatttgtgagctagatcaaccttaagtagctatcaaatggatggtactactagtaaagagaaatcctccataagaaaaagagattaaattagagaagaccattatataacaatgtaaattctactggataccatggaaattgaaccactgaagagagtaaatttaaccaacgtgaataactgtgttgctgcggaaaaatgcctctaaagaatgttccatacaatcctttcaggattttctaagtcgcttttaattggaaacaatatttaacttttttgtgtgaaaagcacattggcgaggttatagagaaatcggaaccccttttacattgcaggcgggaatgtaaggtggtgtaaccactatagaaaacagcctagtggtttctcaaaaaattaggcataggattaccgtgtgatccagcaattccacttggattccacanaagaatccaaagcaaggactcanacaaatatttgtacacccatgtttatagcagcactacatataatagccaaaacgtggaagcaacccaagtgtccatcgatgggtgaatggataatanaatggtgtatatacagcagtggataatattcagcctttggaantctgggtggcacagtgctcatgcctgaatccagcacttataggccanngtggtgatcactgaggccagagtcgagacgctggcn

SEQ ID NO: 673966 - DNA, 309 bp, Homo sapiens
  misc_feature (256)..(256): n is a, c, g, or t
catcttagaggatcccccatttgatgcccctttatgccacttgaagcccctggatgccagcacctgaagtactcacgggcagatgcaggggccgcctgcgtaaaggaagctcctattctagaacagatcatccagctaatttgggcgcttgtgtgctctaaggtcaagcttccctatatacagcctcatttcactgcctttcgaagtcctcagagtagagggattttagttcttcaggttcacccagtattaacgngaaagtcgtgtccctcctgtctgccattgtgtacatatgcagaattcgctgcg

SEQ ID NO: 673967 - DNA, 300 bp, Homo sapiens
tgtgggtagcaagcaacctagggtcagtttgcaggtggtaaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccc

SEQ ID NO: 673968 - DNA, 1031 bp, Homo sapiens
  misc_feature (429)..(429): n is a, c, g, or t
  misc_feature (432)..(435): n is a, c, g, or t
  misc_feature (443)..(443): n is a, c, g, or t
  misc_feature (446)..(446): n is a, c, g, or t
  misc_feature (448)..(449): n is a, c, g, or t
  misc_feature (451)..(451): n is a, c, g, or t
  misc_feature (453)..(453): n is a, c, g, or t
gtctgaacttctatgtccttacaacaaggtaatctagaaaattcttccaagagagaatgactgtttccccttgagaaacaattttatttccaaacccctttctagattgttttcatgattcaggtgtgtagttgaagcagaatgtctcctctacatactacatgcttgattttgagaatactttcttaatatcttttggcttcggttttctaattataaaatagttgaaaatgctttatgattttataagtatataaaaagcattaggttcaaaacagaggctataagtgtgtttagccaactattagacacaatgaaacttcccgtgattaattagctacaactacactaagcagttcatcaaaatgtagggattagaaatgatgctgaaagggcaagaataggccggggtggcctctacctgggtcnaannnnctgtctgnctntnncncngctcctgaacacccgcaccaagatgtcctgccagcagaaccagcagcagtgccagccccctcccaatgtcagctccggaggctgctgtggctccagctctgggggaagctgtggctccagctctgggggttgctgcagttctgggggaggtggctgctgcctgagccaccacaggcgccgtaggtcccactgccacagaccccagagctctggctgctgcagccagccctcggggggctccagctgctgtggcggggggagtggccagcactctggaggctgctgctgaagtggaccctgagcctagaagagcagaatccaggaccgcaaactgccaaggacatcccccttctcctactaggcctgcctgagaggctcacaggtccaagggaaagctctgaacttgccaagagcatatcttttccctggagtccagaaactcagatcctctcctggatctccattcactggccttggacctcacctttgtggctaccctcccacgctctgtctaagcccctagcttactcaatgtcatttgcagcgtgcatctgctgattaaaggactaaaacaagaa

SEQ ID NO: 673969 - DNA, 408 bp, Homo sapiens
attccatcagaggtaggtcgaacagctagagctggagctgcaccggaacggctattacttccgtcacacagtatgatgtggaactctatccagcgcatagaacacttaattgggaagaaactaccaggtctatccaaacacaggatgatgaggtcatgatgctgacagaacgcgtcgctgaagcccacaggttggcccgaatggacgtgcagggacgcatggagaaaagaagaaacgctcgcgagaggatgctggagataatgatgacacagacgggtgctattggtgtcaggaacaaggtggctggaggaaaaatgaagaagtggacaggccgttaatcactttactgaaggctcgagttctcccaccaaactactaacatcatcatcctctgagctcccagggtct

SEQ ID NO: 673970 - DNA, 1121 bp, Homo sapiens
  misc_feature (429)..(429): n is a, c, g, or t
  misc_feature (432)..(435): n is a, c, g, or t
  misc_feature (443)..(443): n is a, c, g, or t
  misc_feature (446)..(446): n is a, c, g, or t
  misc_feature (448)..(449): n is a, c, g, or t
  misc_feature (451)..(451): n is a, c, g, or t
  misc_feature (453)..(453): n is a, c, g, or t
gtctgaacttctatgtccttacaacaaggtaatctagaaaattcttccaagagagaatgactgtttccccttgagaaacaattttatttccaaacccctttctagattgttttcatgattcaggtgtgtagttgaagcagaatgtctcctctacatactacatgcttgattttgagaatactttcttaatatcttttggcttcggttttctaattataaaatagttgaaaatgctttatgattttataagtatataaaaagcattaggttcaaaacagaggctataagtgtgtttagccaactattagacacaatgaaacttcccgtgattaattagctacaactacactaagcagttcatcaaaatgtagggattagaaatgatgctgaaagggcaagaataggccggggtggcctctacctgggtcnaannnnctgtctgnctntnncncngctcctgaacacccgcaccaagatgtcctgccagcagaaccagcagcagtgccagccccctcccaagtgcatccccaagtgccctcccaagtgcctcacccctagatgccccccaaagtgtccccctaagtgtcctccagtctcttcctgctgcagtgtcagctccggaggctgctgtggctccagctctgggggaagctgtggctccagctctgggggttgctgcagttctgggggaggtggctgctgcctgagccaccacaggcgccgtaggtcccactgccacagaccccagagctctggctgctgcagccagccctcggggggctccagctgctgtggcggggggagtggccagcactctggaggctgctgctgaagtggaccctgagcctagaagagcagaatccaggaccgcaaactgccaaggacatcccccttctcctactaggcctgcctgagaggctcacaggtccaagggaaagctctgaacttgccaagagcatatcttttccctggagtccagaaactcagatcctctcctggatctccattcactggccttggacctcacctttgtggctaccctcccacgctctgtctaagcccctagcttactcaatgtcatttgcagcgtgcatctgctgattaaaggactaaaacaagaa

SEQ ID NO: 673971 - DNA, 845 bp, Homo sapiens
  misc_feature (396)..(396): n is a, c, g, or t
  misc_feature (398)..(398): n is a, c, g, or t
  misc_feature (403)..(403): n is a, c, g, or t
  misc_feature (418)..(418): n is a, c, g, or t
  misc_feature (658)..(658): n is a, c, g, or t
  misc_feature (796)..(796): n is a, c, g, or t
caggcatagtcccttggtccgagtggcttatgatcgaaagtttctacacctgggctccgaaaacaatacaaagaagttctaccaccccatgtccacaagggggaatttgcctcagtactccatgggtggccgaatctaaagtgagtgaggggctttggtgaaaaagacagtctttccccatcactttatattgcacaacaagaaaagccccttcctttcttcctttattttataaaacgaacggccactgtgtctgcctgggcttgaggcagggcgcgatacaactcaatcaacctcgccttccgggttcagcatttctcctgcctcagcctcccaaccagctgagattacaggcacccaccccctgcgcctggataatttttgtatttttagtananggggntttttgccatgttgnccaggctggtctcgaactcctgacctcaggtgatccacccacctcggcctcccaaagtgctgggattacaggtgtgagccatcacgcccagccggaaagcctctttttaaggtgaccacctatagcgcttcccgaaaataacaggtcttgtttttgcagtaggctgcaagcgtctcttagcaacaggagtggcgtcctgtgggctctggggatggctgagggtcgcgtggcagccatgcnttctgtgtgcacctttaggttccacggggctattctgctctcactgtttgtctgaaaacgcacccttggcatccttgtttggagagtttctgcttctcgttggtcatgctgaaactaggggcaaggttgtatccgttnggcgcagcggctacatgtagggtcatgagtctttcaccgtggacaaatt

SEQ ID NO: 673972 - DNA, 281 bp, Homo sapiens
agtgactctaaggatcgccccagctactcagtgaggctgcggtgggatgatcagttgagccacggagtctgaggctgcagtgattgaccactgccttctacctgggtgacagagaccctgtctctttaaaataaaaacaaaagaagaagaagaacccaagatgttatccctctatcttgggattaacatgggggtcttcataactcccggtactttaatccttcgagaaaggaggatgtcctttgcttgttacctcgtggttgggctcctgagtagctggg

SEQ ID NO: 673973 - DNA, 604 bp, Homo sapiens
  misc_feature (502)..(502): n is a, c, g, or t
ggcatgaggggagatttgggtgcttttctttccgtggcgcctcttcattttgtaaactgctgcttaatggaacaagagcccagcattgtcccggcctatcccccaggtgcagtcacacagtaggtacagtcctggacttcattctcagcaggaggggcaacaagaactcctcaggaggtaaccacgatgtcgctccctggctaggtgctgggaagcccaattaggatagttgtgagtgctctctggggtctgaaagtgttctgtttctcccttgggattagaagagtgcttgcaaggcgtctttttgggtgatggccattgctgagctgtgctgtgctgtgccggtgactgacaggttcctctcctctaacccagccaggccctcatggacgagagtgcactcaggtgtactgcacccccttccatcctcactgcagccctgagctgggtggggcagcatgtgggagtgagccaggaagatggggcacaggggcttcccggngactgcagggcaggcggcagcagggagggcatcgggaggaggtgagctcctgtggacttccatcagctcctcctcgaacccgcatctgcaccgtgcgtgcct

SEQ ID NO: 673974 - DNA, 679 bp, Homo sapiens
agagacgctttcctctgaaagtgcgactgtcactcttgtgctgatgctgctcagtctgactgggtataccaggaccagttcagattacgcagtgcagcgactactgagcatgggaagaggggatgaaagcacatacatcatgcgcaaactggctctggatttatgatgtgtgacgcctggatatgattagaggattgatgctgagagtaccttttaagggtaatgatgtgtaaagatattacctgtgggaacggttatgggtgtatggataattgataagagacgttatttattatgaatatgagattttctgatgcggggatattgggtcgttggacagcgtagtgtggtgtgtactgcacttactctttggctaagggactatttcagaatgagagacagacacgtagttgaatggtttattcggattgctctaatatggtgatgaagatgtggttgggtctcggaaattctcatggtgagcaagtgaatacttcgctggactaaggtgcttcaagaatttctaggtgatgatgggacaacgatgccattgctgatggaaaacaagaaggctgttgcttaagtcgggcaaagggcttggcagagagggatgtgaggcagaggcattgggtccaggaagtaagtcttaataaagtgtgggggattaccctggtactaa

SEQ ID NO: 673975 - DNA, 697 bp, Homo sapiens
  misc_feature (217)..(217): n is a, c, g, or t
  misc_feature (248)..(248): n is a, c, g, or t
  misc_feature (274)..(274): n is a, c, g, or t
  misc_feature (375)..(375): n is a, c, g, or t
  misc_feature (377)..(377): n is a, c, g, or t
  misc_feature (395)..(395): n is a, c, g, or t
gctctacttagagtttaattctctttgctccagttaaaaggctccttgtatctgtgttcattgagttaaaattctaactctagctgccatttattaagtgcctgttatatgcaaggaattttacatgcattttctctgttcttcacaaggcattttttccattctgtagatgaggaaacaagctcaaggaggttaagtaacttgccccaaatcctanaatcactaagtgatagagcctttggagtctntctgcctccaaaagctttgcatcttntcacagtggttggtctctgttcctcttggggttaggaactgttgtcattatgccagccccttcctgcagtggctctctcctgttctaatgtcgtgttcccntntcttcatgacagcagaancaagtcaccaaacctgttggaggtaatggaaaaaatattggcataggaaccaaacgacctggcttctagccccaagctgggcatgtggccttaagcaagcccttggctcctgaaatttagagccgtacttcttccctgcctaggatgggcatttatcacgaatgtgtgagaatctgcatatgctccacccacataatgggtactgacgaaattatgtttgggacgtaagcacataactgtttttttttctgatgcatatagatgctattgtgattaataaattggaaaatgtgaaaaaaaaa

SEQ ID NO: 673976 - DNA, 1149 bp, Homo sapiens
  misc_feature (256)..(256): n is a, c, g, or t
tggcagaggcgatggtgggaatgcgcagctcgaaccagcgatgccgattctggtttccatgggggctgcggtccacttcgtgtggtagcccagcggctgcatgtgcggacggccggggatggctcctagagcatatactatacgcaatgctgtgcggcttgcggctggctgggcttgtctcgagtgcagcccgttggtggcatggcagcgtgtgatcaggttgcctggcatagacgctgcgagcctagcacgagangtcgcatcgcatgcggctaggacgttgatatgatctaggaccgagtcaccatacaggtgatagacagacacttcattactctcgtgtgggatacagactgggtcgtccaaatgtgaaatatacacaggggcatgaactcacaccgagaggacgtacactcatagagatctcaagtaaagaagaggtgcagcatggcatttctttcacaaggaaataccccacttgtcgagagtttgaaccgtcaatcgctacgtgagatagcgagcattctcaaagatacgcgctgtgccctcgcaaaagaacgctgcgctcgatcgcgagccaagtgtcaccacaagcggccgaatgacagcatcaaggggcgggaaacagggacgcgacgcatattggggcagaaagcgttggccaagagccaagggtctggacggctggcccccccggtggaaggtggcgctagggcgacacatggtccgcacggagtgctgttcaagacacttcatgcaagagcaagggggcgcaaaggccctgggtccgacaggaagatgctgctcgaaagctggtccgtatcttatcgtaaacctctggagccatcaagaacaagaccccatgaggatcaggagccggttgggtttgagccacggggaactgaaggtcttatgccctgggaagcgaaaactcaatgaaggaacagtgcacgtgcaacgcgggtcaaagctaacggtcctggagagaaacctaaggcaggtactccaagagcatgcccgggcagtggaccaggatggaagacctggccgagaagctctccgtaaacacttcgccacccttttgtgagagtcgacaaaagcctggatctcaagggaccgacgaacggtggaattaaagcgggaacaacg

SEQ ID NO: 673977 - DNA, 941 bp, Homo sapiens
ctccagcaggcggagcgtaattgcagcggtgagcggcggcctgtggccgcggctgggtacggcccggttacccgccagagccccgacgcctgtgccggatccacccaccgatggatagaccattgtgagggcggagccgcgctgctctcacgatgcctgctggcgtgacccgattgccctcccattccttggagatgggtgagcgtggtgaggttgctgggacaggaatcctctaggaggcgcaggcccggagagttgagaccgacctcctagccaactccggaggatccgtcggttcaggtatgatatgttagcgcgtttgccctatcccaaaagcttgcttgctgagtacctatcctgtctcccgcattaagccggtggtcccacccaccttgtgttccgcgggcgcttgcattcctcccgagaccactccgtggtgccccgtcccctgagctcccgtcggacgaggtgggcgttctcctattcactaacgctgatttccctcacttgtcctctcatatcactgtgggtggaatatcgtgtgtctccgggtggcctgcttgtatgtggggcattcacccttgggacgcacttccttggggtaggcttttaaccctgggagactcccatgacttcggcggtaatgggtagtactcgggcacggcatgtgttggcacggataggtgacacgggggggcttggaagggcccggttggcggaattccacccccactcgaatgctatcgctgggcgtgcaccgtttccgttccagacgttcgtcccggtaacccaggttcggtctcgccctttccacattccttcaggcggccacgcggtcgtgctaacatgaagcggcccgcaccctgtttttgacacgggtttaacgggcttcccggggccttgcccccctatatacaggccacactgttggtgtttccgta

SEQ ID NO: 673978 - DNA, 196 bp, Homo sapiens
  misc_feature (131)..(131): n is a, c, g, or t
gcttaacggggtgaagctgggctttctcccccctgtgactggagtgcatgttgacaccagcactttttctgcacatgtatcttcaattcaacaagggcgtttttttaatgctgagtaacaaggcaccaagngggttcttcggtatatttttttcagcaacttggcgcagtgtctttttttacacttttttacaaca

SEQ ID NO: 673979 - DNA, 916 bp, Homo sapiens
  misc_feature (916)..(916): n is a, c, g, or t
gcctggggctccgagatggtcagaggatgggagaaggggcagtgaaacaaggcttcttgtatcttcagcatgcagcagacgtttggaaagaaatggcgccgcttcggcgcctcactgtatggagggtcggactgcgccttggcccggctggagctgcaggagggcccggagtaagcctcgtctgtgtgaggctgcccggaaggtcatccgcctcagtgactgcctgcgggtggccgaggcctggcggagaggccagcagcccccgggacaccagtgccttcttcctggagaccatggagcgcctgtacctcctggcgtgccctgcagcggcagcgcggcgactgggtgcaggccatctgcctccgtggccttccccggtgcagaggaacggacgctctcggggccagagggaccacgcatgagcctggccctgtcatggaaggaataactcgacttgtacagcgagcgcaagttcacgagtacgggcccgctacaaggaaattttgctgtgcaccatgagacctacagaagccgagttgagaggtgccacctgcgggtggtcctataccctccgggctggggagagtgccctgtgagctgtgcgggtgggcccgagccagggacccagctgtacgactggccctagcaggtatctgcggccgctttgggcgggacacggtataccttgttcctttgtaggcaggccgtcgctgcgtctctggagaggggcaactttgagttcgagaacccggcaaggcaatgagatcttcttgggcccctgggaagaggccatgctctgcccagaaagaatgttgaaccctgtaaacccaaaccgaggccatgcaaaataccctgctacgtgcccggattgatagccctactctcgagccgatgatcactgcggcggctaaccacn

SEQ ID NO: 673980 - DNA, 414 bp, Homo sapiens
atatatatatatatatatatatatatatatagatagatatagagagagagagagagagagagatagagagatatatatagatcctgtatatattataatttaatttttattttttcttacttaatatactgtcttatttctttgtactcttattcttttatcctctgtctctgcttctctcctctctcgcctatctctggatctccttccctcctttcttgtccttctcattctttcgtccgtccttcctccatttctatgcccttcacctcatccttcgctccgatgtccacatctactcatctttccccttgtcaccctctcctctgccttttcttcctgctctcttccctctcgttctctcctttccttcgtttgtcacttgcctccctctttttccctctgcccctttcc

SEQ ID NO: 673981 - DNA, 388 bp, Homo sapiens
  misc_feature (25)..(25): n is a, c, g, or t
  misc_feature (57)..(57): n is a, c, g, or t
  misc_feature (381)..(381): n is a, c, g, or t
  misc_feature (384)..(384): n is a, c, g, or t
ctccccccccaatttgccctagcanggtagaaatccagccagggatagccttatttncccctatgggaattcctgttttggaagaggcaggtccttatagcagggcagacctaattaatgtgcctgaacctcattcccctccctgccttaagtgaataaaaacttttatttgactatggattataaagattgcctttaaggagccttgtttattttggggaaggagaatggatattttgtaggagaaaaagactttatatagtaaatgaaaagtctatgggctgggtgtagtggctcatacctttaatcccaacactttgggatgccaaggtaggagtattgcttgagctcaggagatcgagaccagggagactgcatcanaanaatt

SEQ ID NO: 673982 - DNA, 545 bp, Homo sapiens
ataaatatagaccaatgtgacttaattaaaataaagaacttctgcacagcaaaagaaactattggcagagtaaaccgacaatctatagaatgggaaaatatattagcaaattatgcatctgacaaaagactaatatccagaatctataaagaacttcaacagatcaacaacgaaaaaaatcccacaaataatcccattaaaaatgggcaaagtatatgaacagacacttatcaaaagaagacatacaagtggccaataaaacataaaaattggttcaacaacaattggctcaaactaaatttactttcttaatttgtttaataaagtgtttttaaacacattaaagaacgaaaacagaattttttgtaagcgttttcaattggtatcttttgacattgtttatatttcttatatataattcttcttaaacttaaaattattgatatgatagaattattatcttggttaaattcacgatatggaataataactattcaccacatgaccaagctaaaactaaagtgtcatattgttataatcaatga

SEQ ID NO: 673983 - DNA, 245 bp, Homo sapiens
atacagcaatagcagcaggatggccgcccgagctccgccgttcctccggttcaggccctttctgtcactcagggaggtcaggctggtcacgttcacaacaccagccaagaaccagggtttccacgacctctgaccccacgggcccaggctgaccaggtgcagcaagcggcgggcaatgtacaaaaactctgcgatggtctcctgcagccccaggggggtgggggtcgcactcagctcctcgtgat

SEQ ID NO: 673984 - DNA, 958 bp, Homo sapiens
aatcagagaaaagggtctttaactccatgcatttagcgacccaaagctaatgattctaatgtctaaactagttctctggttctttcagtggggaagcagatttggtgtaccacccatggttattgactcacccatcaacaatcgctatgtattgcgtacattactgcgcagtactcatccagtgaattattgttagcggttaccataagaatatcttggaccgaacctgataggtacataagaatacccaatacctaggatcgaaagatcgcgccgctccattcgatgctatacagagcgagtagcgagcaattgcaaccgctcagattatttgacacagtcagatctgcataactccgagaagttcaaccctctccacgcgcaattatgtgagtatcactaaactaagaaccgtaaccgcagcacccttagaccaggtaaccatagctatcagtacaatgtacatgttagccgttacactatgacatcacttacaagtcaataatccgcttcttcagtgcctcgattgggattgacctcgcaccatcatgagtagggtgtccacattgtgacctagctcgagtacctgccgttgagaatcgaattatccgcgtcactagaagaggtgctaactctacctcgcgtcctgggcgccataatgacttaggggggtaggcatttaaggtgaaaccgaacaattagcatatctacttaacacagcactcaatgaacctgtttgggccacagcatgacgtgaccgtaaagaccttgaaatggcccaaacgggcattcgggctcgcggtgcacctcacaagtttgatcgtgaacaagggccgcctttcacggtggtgactccgtggaatgactggcgagcagcccaatgtgggactgggttttaccaacccaacactgaagaaatccgggcgtggcacagctaacccacttgctcgtgaattcg

SEQ ID NO: 673985 - DNA, 926 bp, Homo sapiens
  misc_feature (680)..(680): n is a, c, g, or t
gagtcggacgtgcgacacagcccatcccctcgacgctcgcgtcgcatttgggcgctccctaccgctccaagcccagtcctcagccatggcatgcccccctggatcaggccatgtgcctcctcgtgccatcttccacaagtactccggctgggggagggttgacaagcacaccctgagcacgaaggagctgaagggagctgatccagaaggagcttcaccattggctcgaagctgcaggatgttgcaaattgcaagcgtgatggaagacttggaccgggaacacggacccaggagttgaccttcccaaggacgtatgtcacccctttcctgggggacttgggctttgattctaccaatgagatgcctcaaggggcatggacaaatacaattacgggcactaattggtcgaccacccctctgggggagtcctcttctgagtccaaactccacgttgtgtgcgctacttgtcgcaaccacatttttgtgtggtaccacattcctacgagactccagcagacgcacactaacacacacgctcaacatattttggtgcgaccgcgtcgtgggcaccctcagagaaagtctttgagacccactatgtatgtgcgcctgcccgagccacccctgtcggcgactgaggcacacggagcacacaggcgttgcacaaagaagagccccgnggcccgacacacgcgagcgacgagtgactcctacagcaaataaaaccggccgggcggacaacgcacgctgtgtgacaaacaactacaagtgtagtgtagaggaccaacgagggctacacacagcggggacccagcgaccctggataatacatatagccccgcggtgggtggacacaacgtgtagcaggaacatacatacagtcgaacagatgcacgcgtcgtgcaatgcgaccagcatgcaaagca

SEQ ID NO: 673986 - DNA, 644 bp, Homo sapiens
gggggtcagagacacctccaggatacagatcagtcgccccttcagtcgcagcccatgtccaggactccttacatctcgttcacgcaagtagctcaattcaggttcatacctagcacatcggaacgaagtgggcaatgcatgatttatacacatgtcgtgatgggcgtgagttatccgcgcaggagtcgtctacgagaaaagcgataaaatcatacccctagcgagtggggtccaaaggggattgggagcgccctctagaaacctcatagcacagaaagcgcctagctggggagccagacgagcagagcggtcgctagtctatggggtcttgtgcaatcggtgggttatgaccacgaaatgtttcaaactttcaccaaagaaacaaaagcgtaccgtggggcacccaaatcccccaatgtgtttccatccacgcattttctatctcctagtgggaaaacacacgttttgcggacgggcgttggccctggtttggggcccgtagagtgcatggggtactttggcacggggggaatgtcttccgccggttagaacagggaaaacaagcttttgtggggctacctatacgcgcgggagagagccgtcatcatcgccgaaatccccccccaaattgcgattccttcccg

SEQ ID NO: 673987 - DNA, 846 bp, Homo sapiens
ggagtaccgtggataactgtagcgttcgacaacgaggccctctatgatatctgcttccgcactctgaagctgaccacaccaacctacggggatctgaaccaccttgtctcagccaccatgagtgatgtcaccacactgacatccgatttccccatggccagaccgtcaatgctgaccatccgcaaagattggcagatcaacatggtccccgttcccacagtatccatttctttatgcctggctttgcccatctcaccagaccgtggaacgccacgcagtatcgagctctcacagatgacaggaactcacaccagacaagatcattcgcatggacaagaacatgaatggctggctggggaagcccacggacaaaggagacgcgatatacttctaccaacgcggtgcgtagtgtgtggctctctagcaggtagtgcgtcgagtagtgatcacaatgacagagggagagtacgaatgacgcacaagaatgacttaacacgttgctagaaagaacgaaacaggcagacctacctttgattgggaactgggaatcaccacaaaacaaatgttcaaggaacaaggaccagttcttgatgaaaccaattccacaaccctccgatgggacctcaaaggaatggacaagttcaacccattataaagatgtgagacacaataagacaacagaccaatccccagggtagcttcagtttcaaaagacgacaattatccgagaagccacgttcacattgcccatatgttaccaggccgggaaggacatgtccattcaactgggtcacaacacggcgaaggtgattggcggcacgactggagattacaccgagcgactga

SEQ ID NO: 673988 - DNA, 759 bp, Homo sapiens
  misc_feature (333)..(333): n is a, c, g, or t
  misc_feature (528)..(528): n is a, c, g, or t
gaggctgacgcttgaaacgctgatgaactgcatcagggtcaactaaaaactctcggcgcatctggaattctcctctatcgttgccttgtgtggtagtagttcccgttagttgtatcccatttgttaagcggtgcgtttgaataagagcgagttctgaagagtatggtggagtactgttagtcctcggaatttaatagacttcataaagttcgatttcatcaatcattaatttctccgatcagtagcgaattatgatgttagaaaatgaggttccatgaaaatgtcattagagattaataatcgcatacgaatcaattgacatgcgtaataatnatccacatagccaatcgcaaggcaggtgactgaggccccgtcataagagcgaatctggtcgagaatagattatagataggctgcaaataattatatatcaatgttcattgatcggaacgagtcgatctggttagcgatataatagtcatctacaattctgattaatcattctagtagggagatttgagaggactnctttgacagcgtattttcaagtatgtgtttggatattcccagaacctataatatgcagagttggtcttgagcgactcattaaggcggaggacgtgtgctctgctagatttcaaacctgattttaaagctacagtaatttaaaaacagtagtaatggtgtaagtattcataaatatatcaagtaaaagaatacagattcaaacaatatgcccacatatgtacagtatcgatt

SEQ ID NO: 673989 - DNA, 755 bp, Homo sapiens
  misc_feature (287)..(287): n is a, c, g, or t
aagcaagcgactgattgccctgcccaactcagtcttgaatgactgcgactcattgacttcaataagatctctaacgccttctagtatagtcaattgagacttgaaattgctaaagactatttatataagcaagttacagcaatctgagtaatgttgggttcagtactcacttactcgcacacgtcgtctaaaagaaggcgtcggacagagccctcggcgttggcgttgtgtggtctgtctggctatctctacgcaatttcgctcattgcaccttatcgtaggacatncaacccttcggaatgcgggagaaggagtaggattaaatcccatgccttctgattacccaagatgcaggtcgctggtgcacacctagtcgcatattatagcatcattcgccacgaaggttaaaagccagcgggtccctagtcttagtgcccagcctgcttgtgtgggctctggcctggactggtggctggcccagggggcacgcagtgcttagagcattctgcgaggcattctcttgtttacacaagctgcagtcagacaatgccatttcgtccccaccacggaacctttccatctaagatttcttccaggtaatgccagcaatcaggcagcacccagctgtgggggcagtgcggtgggggagacccacattgatgacttttttaattttctccccccggaaaaaaaccaaagaaaggttgtggaaaggacctgcccattgaaaaggataggcaagatggttgtaaaca

SEQ ID NO: 673990 - DNA, 255 bp, Homo sapiens
  misc_feature (18)..(18): n is a, c, g, or t
  misc_feature (26)..(26): n is a, c, g, or t
gggaagcctcaaattagngggagatngatggggaacggctgtcctgtggagcagtcagaacacacacctacatttatcagttaatttcgtcgtcttatatggacatggttcatggcagccctggagcaattacaacagtaataccaaagatcaccaatcacagatcaccataacagatataataataataaaaagcttgaaatgtgagaattaccagaatatgacacagagaccccaagtgagcccccactgttg

SEQ ID NO: 673991 - DNA, 212 bp, Homo sapiens
gctccagaggcacaaggaggaggcagcaggggtctgcattttcagcagtttcccagtttttctggttctggttttttcccaagcggggatttgggtcttcttatctgggataagcacaggcagagaggggctggggtagtgggcgggtttctggatgcagctgcacgcgggctggacttagcactgcagctcctcctcctgggggcctcggg

SEQ ID NO: 673992 - DNA, 322 bp, Homo sapiens
gttatattcacagagatagtatgtgacccattttatcagtgttaatattactttacactctttattttgtgtaggtgctctgctgatagcacatttgccagtcttacaagctgggaccctgtctccctcttgacttgtctcgtgtgtgagaaccctgtggagcggtagcctcagattcctcttaccgtaatgaatgtcccagggcagaaaaagaggatacacagatgcttccaaatccttcttccaaagcaatagctgatggaagaggagctccagcagcagcaggtaaaagaaaaaaaataaaggctcctataagtagata

SEQ ID NO: 673993 - DNA, 254 bp, Homo sapiens
gttctagaggatcccagaaactgacactcttaaacactgatggtggtaaagtaaaatggtgcagcagttatagaactaggtttggtagccaccaggtatacagaaatgaaaacatatgtctacacagaaacatacaagaaataatatagcagcattgctcatcatagctcacaagtgaaagcaacccactgtctatcaactgatagatgaatgcccaaaatgtgtttctttccgtaccccgatacagcgaccaa

SEQ ID NO: 673994 - DNA, 1438 bp, Homo sapiens
ctggtggatcgccccgtgtccgcgtggtgccacatcgggggagcgttggcgcgtctattgtgttgtgattgtggcgatattgggcggggttttggatcctacatgggtgcctgttttgtcgcacccgtgtgtgtgtcgcgctgggtgtgtcagccctgcctcctcgtggtgtagggtcccgggctgtgggggggagacgcttgtttggtcagctggcagcttgggggcgtttcgtttttgcccgcaaccgcagccgctgtttataggtgtcctctccttgggtcttgttgtgtgcctcgggggccaccgcttagggtgaaatatcccccctctagggacggtgcgttggaccccccgtttgttgttgccaggttgcctgcgcccatttgtctgctgagtgtcacctagggggcgctgttccacttgcgccggacgtggtgtcctcggggggccaccccgtgaggttgttgctttacacccaacgtgctaccgcggggttcccctggttcgaaaagtctggcgtttggcacttatggcgccacccccaagagtatgttgtttcagtttgggagggccaccccctctgtggttgggccccaacagggcactttatctaaccgctgagcttcgcccccccctattgtgtggggtcttgaagaaagagataatgtgtttttgagcctcggagggtatgtgagaattttctctgccccttgtaaacccccttccgcgtgccgttgtctacgagaccctgggtggtggccacctgagccacatgcactgtcgcgcgctccccaggccatcgccccccatagacagcgcgagagcggggtaagggctctctgtgctcacgccacaaccacagagtggggccacatgtcacacacaggtccccttgtggtgggccccccacctgccccacacacatcgtgtataggctctcccccctgtgagagcggggtgctcccacagttttgagagagacacgggggggctcgggcggtgttatcccctcggcgcccacacttctcccacgctgtcgcccctcgctggctgtgtatacctctccctctggcacctctcagtgtgttctgcacagaggtgtgttggtctccctctgcgctcgctctctgagtgatacagtgtggctctcttcgtgtccacatagcctctttggtggcggagttcactgttgtgtttgtggaggcattttataggggaacccacattgcacactggggcacctgccccatggccctgcggtatagcgagcactttcccacgccaagggactggaaggagagtttccgctcgcctctcacgccccgaactcgaaatgtcacgaaaccagcccgcggtgcttcaccctcttggggataacttgtcttaattttttaataaatagttcccggttggttttccagagaaaaaaaaaaaa

SEQ ID NO: 673995 - DNA, 718 bp, Homo sapiens
cttgtgactagtacacatctggtaattaccttcatcgtggtatagtatcgaaccattggtagaacattcctaatatgaatcccactacgatcctgtaatacatcgaattcgaatactctgttctcgacttatctgggaagaagagtcgtaacgtgtctctacaccctataaactgctagttattcccccacctctacgcatcatgtacggtagaggggagagaaagtgctagctcacgcgaccttgcacgtatgattcagtacgaaaggcacgaacaaccatcacgcccccatcggatgacctcacgcctcgtgagtacacatctacactctagtgtgcttgtacagaatgtagctatcgtaagaccagcaaaggctgattccaggagtgagttggcgcgaagtcaactaacgtaagacgaatataaatagtgctagtatcacagttgctcagctttgatgcatcatcttagcgatagtgtaatttctattttttatttttttcattagaagttacccaaattacagcatggtcaagacctcgtgagaccaaaattttgtcccatctctagcccctcacaactgcttacagaatggatcatgtcccccttatgttgaggtgaccacttaattgctttcctgcctccttgaaagaaagaaagaaagaagactgtgttatgccactgatttagccatgtgaaactcatctcatcaccctt

SEQ ID NO: 673996 - DNA, 743 bp, Homo sapiens
  misc_feature (540)..(540): n is a, c, g, or t
gcaaggactaacccgctataacttctgcataatgaattaactagaaataactttgcaaggagagccaaagctaagagcccgcgaaaccagacgagctacctaagaacacgctgaacagagcacacccgtgctatgtggcaaaatagtgggaagattgtcataggtagaggcgagaaaggctaccgagtcctggtgatagctggttgtccaagatagaatcttagttcagctttgaatttgccgcacagaaccctctaaatccccttgtaaacttgtaactgttgagtccaaagaggaacaggtcttctggagcactaggagaaacaatgcttgtagcagcagcagtaacaatacacttgtagagcatccacactaggtagggcctcaaatagcgaggccgaccgaagttcacagcaaaagcgattacaaggctcagactagcgcgagtacctgaatcataagtccctgaaacatatatactgtaatctcctcaacaacgcgcagattgggaccggaatgcgtattcagcccctgattacnataggaaactaaatggtatagctgattacacgtaagcatgtaaagacatgtgctccgtgccgccactaaagcctggcgtctagattgaaagacagctgatactgagcaattaacgatgccaagtatctacaaatcaatccaatcaagtgcattagttaccctcgagctgtcaacccaacacgaggcagtgctcataaggaccg

SEQ ID NO: 673997 - DNA, 710 bp, Homo sapiens
cttttttaagttcaaaatataacaccagttagaattggcccctaatctcgaaaattaagtgggtggaaaccggcaaaccttgaaaatgtaggttgtgtttccagggtttaacgtgtagaccagattaatggtgtgcatggtttatttaaggggttgagatttggtttaggacctttgttggcagtccctttgtgcataacgacagtatttttcttgccgcccaaaagtgtcgtggtagccttatcttttctgcaaagttcccggttgttatgaacctaatattgatcccagtcttgtttgcctcttaattctttaaaggcgccaggggttgtgtgtcccaaaaaaaaatgcaaagaaaggcttgttgccccttgaaagatttcaaggcatcgccttaaagtccaaagtcaaagcacctgaggggggtggctcagtgtgcatataacgtgctcattttttacggaggtggatccggtaacaaaatatgtgaacacgggctcctgagcctcctgttaacccatggaaaaaccgtttttcatgtatttggggagtttctttttgttctacagtgtctttttaaaggaccttggcatgtaggagaaaaaaaggtgtggagacttttatttgtatgaccaacattgaccacgtacctccggtgtatggggcagtcaaccgaaagaaaaaagtttctttgcctttcaaaagaatgt

SEQ ID NO: 673998 - DNA, 235 bp, Homo sapiens
gatggatagatggataggtgcatggagtggtatcactgatggatggatggatgtatgcgtggatggatgaatggataggtgcatagatgtgatgcatgtaatggatggatggatggatggatggatggctggataggtgcatggatcgatggatggatgggtggatgggtgcatggatggatgcatggatgggtgcatggatggatggataagtagctgggtagatgggaggtag

SEQ ID NO: 673999 - DNA, 317 bp, Homo sapiens
tggaatgtgtggtgtatggaactttagacatatatccatgtcttcttgggtctttgggcacattttcttactaagtttaaaattgctagcaaaaggtgtactaactggttttgcattgtgcatattaaatcttttcaacaccttttgtatgtactcattctgagacaatgtttgtttgcaatttttcctgtctctagttattctcataccaaggatttgttttgcagctcccaagtccttcattgcaaatgaatttgccaattttcttttgagcacatttatttcctgcatgttagaccctacaacataacaccaca

SEQ ID NO: 674000 - DNA, 855 bp, Homo sapiens
  misc_feature (1)..(1): n is a, c, g, or t
ngtcctacccactaacgatgagggggaatctctgcgtgggagaatccctaaagtccgctcgttgtcgccccgccgggcttgtgttcactatgtgggtgtgtagaggcgcagcgcccaggttgttggtctactacgcgtgtgtagtccagtctaataagcattggggggagtccgccctcctctgcaaaggaaaagtgcgttcgaggagccacactccattgtttccgccgacaccatagtgagatgaaagggacggtgtgtctgctctacccacgacaggttgtttgtttggtttattcaatagaaggaggtgagcgcttacacagaggtgttacagatatagagtaacccggtgggtaggacaagacaaggagagatcaattagacttcctctctctctctctcttctgcgtgggaagatgttatatcagtatccacgaacaaaatgtgatggattttcaaagaggcgcatctttctcgtgcgatccaataaagagaagaatattatctactctggagagcctcgctcgagtacagagtatatctagggaagaaacaatatctgggtgggatagagggagagtaacataggcctacttaaacagagagttttgggatttctacccgaagaaggataaacgcgtgagagggagttgtaattaaaacacacgcggtagtattcgtcttgatacaatacagttttcacaaaatcaccgtgagcccacgaaaactacgtatcaggtcggcccagagggagaaaggatatcttgtttattaaacacacatgtattttttataaaaaatacggtcctatgatgagtaaggagggaaaatgtcggcgccgcgttaatatta

SEQ ID NO: 674001 - DNA, 203 bp, Homo sapiens
  misc_feature (27)..(27): n is a, c, g, or t
  misc_feature (32)..(32): n is a, c, g, or t
  misc_feature (42)..(42): n is a, c, g, or t
  misc_feature (59)..(59): n is a, c, g, or t
  misc_feature (71)..(71): n is a, c, g, or t
  misc_feature (156)..(156): n is a, c, g, or t
ctgcgaacattgccacatcagaggctnattgnggcaaccgancggggtattttctacanaatgcagcaggnggtgccagataaagagttactggagcaccaaccgcagtgaggggtgcaacctgtccgcagctgcgcgcatttgtccgtggatggncatgaatggccttcaggccatcgcagaggcattagaacagggaggga

SEQ ID NO: 674002 - DNA, 535 bp, Homo sapiens
  misc_feature (34)..(34): n is a, c, g, or t
  misc_feature (68)..(68): n is a, c, g, or t
  misc_feature (88)..(88): n is a, c, g, or t
  misc_feature (90)..(90): n is a, c, g, or t
  misc_feature (92)..(92): n is a, c, g, or t
  misc_feature (109)..(110): n is a, c, g, or t
  misc_feature (123)..(123): n is a, c, g, or t
  misc_feature (126)..(129): n is a, c, g, or t
  misc_feature (135)..(135): n is a, c, g, or t
  misc_feature (138)..(138): n is a, c, g, or t
  misc_feature (142)..(142): n is a, c, g, or t
  misc_feature (157)..(157): n is a, c, g, or t
  misc_feature (160)..(162): n is a, c, g, or t
  misc_feature (167)..(168): n is a, c, g, or t
  misc_feature (178)..(178): n is a, c, g, or t
  misc_feature (185)..(185): n is a, c, g, or t
  misc_feature (191)..(192): n is a, c, g, or t
  misc_feature (207)..(207): n is a, c, g, or t
  misc_feature (257)..(257): n is a, c, g, or t
  misc_feature (281)..(281): n is a, c, g, or t
  misc_feature (370)..(370): n is a, c, g, or t
  misc_feature (410)..(410): n is a, c, g, or t
  misc_feature (415)..(415): n is a, c, g, or t
  misc_feature (422)..(422): n is a, c, g, or t
  misc_feature (424)..(424): n is a, c, g, or t
  misc_feature (433)..(433): n is a, c, g, or t
  misc_feature (470)..(470): n is a, c, g, or t
  misc_feature (522)..(522): n is a, c, g, or t
cagctgacagtcgtgctcagagagtttctggatnctcggcttatctccacagaggagaacacacaagnagcagagaccatgggaaccntntnagcccctccctgcacanngcgcatcaaatgnaannnnttactnctnacancatcacttttataanttnnnaaaannaaaaaaaagnaataatntttttnncaactaaacaaaaantaacgggaaccccctttcctgcggaggttttggcgaattttgggctaaancttgagggaactaggatgagcctnattcctcatttgcatcctaagagtaaagggattgtatgaggggcggcggctactgttttgtttgggggtgcccatgcttttgttgtttnccctttttcatttgtaattgcttgaaatcagttgaatctngctanaatcctncncacattctntagtataatgtatatgatgtttccctctgctgctctngtttcttcgttagctttcgtgtataaggataagggataagctcctagaagtncatagaatgagaa

SEQ ID NO: 674003 - DNA, 821 bp, Homo sapiens
  misc_feature (684)..(684): n is a, c, g, or t
gcacacgggggagagatcattagtgagtgagtataacgggtgtggccgggcctttcatcagggcactaaccaatcgtgtacccgtcacattctgagtcacacaggagatcccccgttagttagtgcaggcccatggtggtgatcaagaattccacagaggatctatgctggaagaaacattgagaacgcaatgcctgaatcatcggtaaatgtgatactatatagtgcgagctgtgtattgcacatgcatcttgtgacagtagagagcctcttagaataaacatcagcgaggcgtgacaatgccatttcacttgccagaataccagtgaacctctattcaagttgtacccaggaaggatgtggcaaaacactttggattctacccaagcatggtctgaacatgcgatcactgccaacggtcccagagtacgggtctactgttagtgctcaagatagagggcagtggttgccctgtttgctggtcgaaacaaacgaatgaggatcgggactctctactgaagacctctgtgatgaagacaaacgccattgacggaggacaatgactactgttgacacgtgataagctcgcgtagaagagccattgtgtacatccggcgaaacagggattcacctctaagtcgaccattattgatataatcttctattgcactctcaccaaaaggngatgtgattgtccgctagtccaaagaagaaaggcttgttgggaaggcaccttattacaaacttgttgttttaatctccaaatatgcctatattccctcttccttcccattgagggaatagccggaccttttaagtgt

SEQ ID NO: 674004 - DNA, 460 bp, Homo sapiens
aagagttcttgcatgggacaaaaagagatgatggccaagcaagtatccctacagaaatttcaggaaacagccctgtgtctcctaatactcaggataagtcagtaggtcaatctcctcttagatctcccttgaaacgacaagcctctgtctgttccacccgtcttggaagtactaagagtcttactgctgctttctatggggacaagcagcctgtaacagttggagtccagtttagtagtgatgtctctcgaagtgatgagaatgtactagactcaccaaagcagaggagaagttttggttcattcccatatacaccatcagcagactctaattcatttcatcagtatcgatcaatggattccagcatgtcaatggctgatagtgaagcctacttttctgctgctgaggaatttgagcccattagcagtgatgaaggccctggaacttatccgggtagaaa

SEQ ID NO: 674005 - DNA, 473 bp, Homo sapiens
aagagttcttgcatgggacaaaaagagatgatggccaagcaagtatccctacagaaatttcaggaaacagccctgtgtctcctaatactcaggataagtcagtaggtcaatctcctcttagatctcccttgaaacgacaagcctctgtctgttccacccgtcttggaagtactaagagtcttactgctgctttctatggggacaagcagcctgtaacagttggagtccagtttagtagtgatgtctctcgaagtgatgagaatgtactagactcaccaaagcagaggagaagttttggttcattcccatatacaccatcagcagactctaattcatttcatcagtatcgatcaatggattccagcatgtcaatggctgatagtgaagcctacttttctgctgctgaggaatttgagcccattagcagtgatgaaggcccggataagttccagggccttcgtcgacgcggccgc

SEQ ID NO: 674006 - DNA, 177 bp, Homo sapiens
tacgatcgagctcggtacctattccaatcagagagcgggataaagacagatgtagaaatttcaaactccggcacatcagaaaatattacctcattaagtttttatcttctgatggaatcacgttcaggaatctgtctttccgtaattccggaacaagctacagcagaatactaagca

SEQ ID NO: 674007 - DNA, 241 bp, Homo sapiens
tcatctcctgtcgcttcctcagtgacagaaccctgacacactaacagagatctcatcccccctctgacatgctctcatagcatcaccaaatacctctcactcctgcccccattcgtagcaattatcttatagctggctgcggtatcttacactacacagctaggtccattaggacaagaactgtgtctcccctctgatatgtccaaggcatggccctgtgcctaaaaagttgtaagcaatc

SEQ ID NO: 674008 - DNA, 333 bp, Homo sapiens
ggaacgtcactggggacaggggaccactgggccaaccttgcttctccccactgctgtggaggctcagtgaaaggcagattttgagtctcttctacttgttgaggggtggggcttgcccagaggtgggtaacctgggtactcttttaagggagcaggcacttgaaagcaattttccattgtttaagcaagaaggttcaaacaaggaaaggtccgttgcccctttcctttggcacttgttttcttgcaggaacaggttgcttgtgtagggcttggactttcccccttccttgagccccggagaaacttgtgtttggtgtcctggtaggtggaggc

SEQ ID NO: 674009 - DNA, 516 bp, Homo sapiens
tgattgctatatcgtcgagcacgcctcgggctgatctagtggccggtagagtaactggggtccttggggcgcccagctggttccacagccaccactctggccttgggtggtggcattacagggatgagggaggtccactgtgggtggccacagggctatggccaagcgtccctggccgtcttcctctggcctcagctttgtacctataggctgccgtgccgtgggctgaggtctcgccgccgcttgatccctgaggtgtttccatgctgcgggtggtgcttccaggcagagtgggtgggggcccaccgggcaccgcctttcttccttgtcctgctcactctgagagccttgggggtctccaccagtgcagacaagggctacattctccagggccgggtcttgtccctcttctccgtggtccacgcttgtgcagctacttggtattgggcctgccttctgcctcccttatgtgatctgtgtttccagtgatacattgttggtttctgtggagtgctc

SEQ ID NO: 674010 - DNA, 484 bp, Homo sapiens
  misc_feature (45)..(45): n is a, c, g, or t
  misc_feature (48)..(48): n is a, c, g, or t
  misc_feature (55)..(55): n is a, c, g, or t
  misc_feature (106)..(106): n is a, c, g, or t
  misc_feature (116)..(116): n is a, c, g, or t
  misc_feature (163)..(163): n is a, c, g, or t
  misc_feature (166)..(166): n is a, c, g, or t
  misc_feature (188)..(188): n is a, c, g, or t
  misc_feature (269)..(269): n is a, c, g, or t
  misc_feature (334)..(334): n is a, c, g, or t
ttcacatgggtttttttcagcccttttgaatagatttaccccttnccntctgggnccgtaacattttttaggggagaagctttggtggataggctaaattggtgtntcttttgtcntctgatgaagttcagtttttctaatgcgccttttcaaagtcttactntgnctttaacttctggtaatttgantagcacatgtcttagtgtaattttctttggattggtcttgattttttgagcttcatgaacatggaagtccatatctctctnaagatttggatagttttaaggcattatttatctaaagaagccttttgcttctttctttttgtctnctttttctgggacttctatcatgcatattttggtttggggggaataaaagtgcagaggtgtgtgtgtgtgtttggttttcataagacatatcaaacattttatagttttaacagtcttttttaaactgataacatcctcgtccgaattcc

SEQ ID NO: 674011 - DNA, 446 bp, Homo sapiens
  misc_feature (232)..(232): n is a, c, g, or t
  misc_feature (367)..(367): n is a, c, g, or t
  misc_feature (387)..(387): n is a, c, g, or t
gagaccagtctggccaacatggtgagaccccaccccccatctctactaaaaaaatacaaaaaattggccaagcatggtggtacatacctgtaatcccagctactcaggaggatgaggcaggagaattgcttgaacttgggaggcagaggttgcagtggggcaagatcgtgccactacactccagcctgggcaacagagcgagactcagtctcaaaaaaaaaaagggaggganggggaagaaaacagaacagagaggaagcaatgcaacaaactgagaagcagagcagcaagagacaagtttacaaaaggagatcataaatgacacttgtggctgggcgtggtagttcatgcctgtaatcccaacacntgggagggcaaaggcaggangatctttaggcccatgagtttgtgaacagcctggggcaacacagggagatccccaaaaa

SEQ ID NO: 674012 - DNA, 269 bp, Homo sapiens
ccgggtcgcctagttttagaagtttcaatagcacatagtgttgtataaaaatgcacgcaaagttgctagagagcatacaatttcagaaatgtcggggttatggttatattcagttttctaaggatgcactccaatcaagggaaaaatgcagacattatgcaagatgtcattatcttgggtaaaagtatgctcattatttggtctcttcacagtattaactctgatatccacttggtgcagagtctgctattgaaacttctaaaactagg

SEQ ID NO: 674013 - DNA, 707 bp, Homo sapiens
tgtcgaccacgcgtcgcctgtggcctgtggttgtcccgccatggacactgtcgcgggggctgccccgagagcctgtctgaggcggtgagccgggaggccgtgtgctaggtgtgtgtgcggcgagacgaatcggatgcgagctcctcaagaatactcatgctcaccggtttctcccacatcgaactgattgatctggatactattgatgtaagcaacctcattttacagttatagtttcaaacgaaacatgttggaagatcaaaggcacaggttgccaaggaaagtgtactgcagtgttaacccagaaagctaatatcgtatgcctaccatgacagcatcatgaaccctgacgtatactgtggaatattattccgacagataatatacatgtgttatgaatgctttagataacagagcatgacccgaaaacatgttaatagaatgtgcctggcagatgattgtaccatcttatatgaaaagatggaaacaagcatgggtatcttggacaaggtaacataatatcaacaaagggatgtgaccggagatgtaatgagatgtcaatcctaacgccggcaccaagagacaccattttccctggcttgtacaaattcgatcacacacacttcagaaagcctattacaatatgccgttcggtattgggcaacagatacttggttcaacacaagttgtatcggggaacagacaga

SEQ ID NO: 674014 - DNA, 216 bp, Homo sapiens
cgacgccaaggtatcatttgtataaacttttaattagatctgtggctggtgcgggcctccaaagcgctggattacaggtatgagcactgccccagtctgctggctcttttcaatggtctgggctaaggaaattatttggaaacctgtgcggttgagtgatatatactgggcacttccacatggtccatgtaaagggagatggttgggcgtacgggg

SEQ ID NO: 674015 - DNA, 125 bp, Homo sapiens
gcggccgcctactactactactgctcgaattcaagcttctaacgatgtacggggacatgagtcttctgactctgttcttttcactatgcaatacgcaaacaataaaatgttatacaaataaaaaa

SEQ ID NO: 674016 - DNA, 190 bp, Homo sapiens
agtccaagaagaggcccggcatgagccattcgatgatcggcgtaacatccaaattttccaccgtgcagcttgtcagcacctcgaccagtgatgtctaggccgttgtcggtttgctggacctcaacgcccaacttagccagttcgtgctcgagagcggcaaggcggtctgtttcgtggccgcgaatatgcg

SEQ ID NO: 674017 - DNA, 354 bp, Homo sapiens
aaggacatcctccataagaagtctgtcccattctctaaccaggtgctgaaattggtgtctgatttgtaggaatctccctgttgccactctgatggactagctggtgcaccccatggtgatcagctctgatgacccagctatgttaggtggcaaaggcttgttcttagatttctatgtaggtcttcatgggcacttggggggataaaggttgatctgtggaccctctatacagttggcctgtgaacttctatcatcgtacggtaccctgtcggagagtgataaaactactttcgtggcaatctggagggaagagatgggatcagttcattgcagatgtggttaccaagttgtgat

SEQ ID NO: 674018 - DNA, 332 bp, Homo sapiens
  misc_feature (138)..(138): n is a, c, g, or t
gccctttaaaaacttggggggaaaatttgtaaaaaaaaaaaacaggtttggtggggtttaacccccccaaatgggggggaaagtacttcgggcccccccccttttggtaacacatatgcaggggggggggcccccccntggtacctttttggtccccttgggtttttcccccccaatttaaaaaaaaacttttgaaaaaaaaaaaggggtttttttttaaaaaaaggtttccccccaaaaaaagggtttttgaaacccctttttttccccccccattttggtcccctttaaaaacccctttttccaaaaaagccctttggtttagattttta

SEQ ID NO: 674019 - DNA, 332 bp, Homo sapiens
  misc_feature (159)..(159): n is a, c, g, or t
cttagaggatccctcgaatcgacggtttctcattctgttgctatggtgagtgcagtgtggcacaatcatacatcactgcagcctcaaactcctgggctcaagcgggtccaaattcctggcctcaagtgaccctcccacctcagtctcccaaagtattgngattacaggcatgaaccaaagtaactttttttttttgggagacacgtttccattctaatgtgccaggtgggagtgcgggggtgccatctgggttcataacattttccacttccagaggtccaggtgatattccaacttagagcttctgtgagcggtgggaatacgcgggttgc

SEQ ID NO: 674020 - DNA, 106 bp, Homo sapiens
tcctgctttgatcccaacattttgggaggcgagttggtatggatacgaggtcaagatatcgagaccatcctggccaacatggtgaaaccccgtctaggagcgtaat

SEQ ID NO: 674021 - DNA, 397 bp, Homo sapiens
cccacccaggctggagtgcagtgacacgatctccacctcccaggttccggtgattctcctgcctcagccgcccgagtagccgggattaccggctcctgccaccacgcccagctaatttttgtatttttagtagagatggggttcaccatgttggccaggttgatctcgaactcctgacctcaagtgatctgcccgccttggcctctcaaagtgctggattagaggtgtgagccactgcgcccagccacactgtgttggttactgtaactgtgtagtaggttttgaaattagacagtgtgagtcctccaactttgttgttgtttttttttttccccaagattatttgggctattctagtttccttacatttccacatgaattttaagacggcaagcgg

SEQ ID NO: 674022 - DNA, 182 bp, Homo sapiens
  misc_feature (55)..(55): n is a, c, g, or t
  misc_feature (75)..(75): n is a, c, g, or t
  misc_feature (116)..(116): n is a, c, g, or t
ctgaagagctgtaacatgaaggcctggaagtcctacagcgccgtggatgtgctgnagaccctcgaacattgtggncctggaccctcaggagcccccgagatgactgcagggggctnaaatgcaatgaccccctctgtcctcctgaggagaggctgtagctgtgcctgtcgccccctaccttc

SEQ ID NO: 674023 - DNA, 152 bp, Homo sapiens
tgaccactttcgtcgtctctcacggagccaaacacagccaggacatcccgtaaccagctttgacacgtcaatgtgtgccttttagtttgatacgctgcagttcatcttccaatcaccagctcgtcatctgggtgtatagtgacgttcctcat

SEQ ID NO: 674024 - DNA, 426 bp, Homo sapiens
gaaatgggggaagtatgtaggagtagaagattagatccgcgtagtcggagtacatcgtaggtacagtaccattgtgtggcaatatgatttgatggtaagggagggatcgattgaactcgtctgttatgtaaaggatgcgtaagggatgggagggcgatgaggactaggatgatggcgggcaggatagttccagcacggtttctcatttcctgcagcgtctgagcatgttagtcattcagttcagtatagtagtgcagtgttaggaaaagggcattacaggacttaggacagccagataaggaccaatgcattcatgcaggggcgtgcatccatgcaacaggtgctacgctcttctcatgcatcaggggccgtagcgtcttatagaactacttgcgctgcattgtggccatacctagtgcgcctata

SEQ ID NO: 674025 - DNA, 268 bp, Homo sapiens
gcggacggcccccgaggcagacggcgaggacggacaggacctcgacagcaagcacctttacggcctattttaacgcacgggatccagagctccccgcacttcgtcatgttcttcgcgccctggtgtggacactgccagcggctgccagccgaccttggattgacctggggagacatatacaccagcatggaaggatgccacagtctatgtggctaaagtggactgcacgcccactccgacgtgtgctccgcccagggggtgcgaggat

SEQ ID NO: 674026 - DNA, 526 bp, Homo sapiens
atctcagcacttgggaagccaaggcaggcggatcacctgaggtcaggagttcaagaccagcctgaccaacatgatgaaaccccgtctctactaaaaaaatacaaaaattagctgggcgtggtggtgcatgcctgtaacctcagctactcaggaggctgaggcaggaaaatcgcttgaacctggggggcggaagttgcagtgagccaagatcgcgccactgcactccagactgggcgaggagcctcagtctcatccttaaatagaaataaaataaatgtctgacccatgctattgcatggatgaacttgaggacattgatgctaagatgcaatgcttcggctatggaaggaggttatgactgctagctgtacgaggtgtctagaatgggcaaattcatggagacgaaatagaaaggtggtggtcaggagctgggcaacagagaggaacagggaattgtggaaatggggagagagtttcagggcgggatgatggaaacttctagaaatagatagtgattgttacacag

SEQ ID NO: 674027 - DNA, 116 bp, Homo sapiens
ctcaagcgcttgatacattcaatctttaacatcagaactatatgcacacacagtgtgcacacatcactatatatagtacacataaagtgtgtgtagttaaataaaccatgcatggt

SEQ ID NO: 674028 - DNA, 286 bp, Homo sapiens
  misc_feature (176)..(176): n is a, c, g, or t
  misc_feature (232)..(232): n is a, c, g, or t
tttttcttcacaattctaacctttgaaaatattataactggatatttcttcaaaacagatgtcctggatgatggtccataagaataatgaagaagtagttaaaaatgtatggacagtttttccggcaaaatttgtagcttatgtcttggctaaatagtcaaggggtaatatgggcntgcccccccccccaccttcctaaagagcacttttgtattgtaatttattttttatnacgctttaaacactatgtaaataaacctttagtaataaagaattatcagttata

SEQ ID NO: 674029 - DNA, 634 bp, Homo sapiens
ggtaattgtgaattacttaggatgagaggccatgagataattcattgcgtggtgtttggaaaataacaatgcatcctatggaatagagtgtgcccatttatatctatatgatagtggttgcaaggtgatgatgacatctgatattgcagctagcagtgaagtcgatgatacctatgtcgcactggtaggcacccagatcatgtgctaaatgagcgatgttgtattacatgaatatgttccgaggttatagcggtacttagtaaggctacatagtttacctggggaatatatttgctatcgtcttatgagactcttagctatggaccgtaattgctagctaattgggccgagacttttctggtgatactgacgtattcgggctggagtcacgcttgttggtgctcgcctttaggtgtcctgccttggagtcccataagacccaggggcctcatttccaacgcgggcattaggtgcaaataggtgggggaatcatttcaaacgagagtggttacttcatggactgaaggattcttctaaagaggctgtagattagagaggcacattattaggtaggatacaattatgtgaaaatcgtagaggctatagtatacaacaacgagacagaaggagtagg

SEQ ID NO: 674030 - DNA, 128 bp, Homo sapiens
  misc_feature (61)..(61): n is a, c, g, or t
  misc_feature (99)..(99): n is a, c, g, or t
  misc_feature (103)..(103): n is a, c, g, or t
agaaacggcgggagaagaaggcggcagaaggttgcaaaggccagggacccggggaagtggnccccaaggtggccctgtaggggtgcaccccccaccctntggnccagtcaaataaaagccttcaggcc

SEQ ID NO: 674031 - DNA, 152 bp, Homo sapiens
aagtgtttgagtggcgaccccccaacatccctatcgacgcaatacatcctctctcctcctctgattaggccaaggagctcagtgtcttgtgaagaattggtatgaagagtgtgatgagttggattgcatccctttgaaagacacattcaaag

SEQ ID NO: 674032 - DNA, 1213 bp, Homo sapiens
ggccgtgcgcggtggctcacgcctgtaatcccagctctcagggaggctaagaggcgggaggatagcttgagcccaggagttcgagacctgcctgggcaaatatagcgagaccccgttctccagaaaagaggaaaaaaacagaaaaaccaaaaggacaaaaaaaaaaaaagggaaattccccatcagggaaactctcaaccctccggggtccacgcgcgagatccccagggctagaaggccccccaaggcagagcagggggaacaagagggtacggtggccacaaagggcccgggccaaggtttagggcaattaaaggcaagaaaggggagagattccgaccccatgtgtgtgggcacagaggcggggaccgtggaaaacctcggtggaacctccgagaggtgaactccaaccacaacacttgcgggagactcccaaaaggaggccaagaggcacacaaaggcgccttgagaccccacaccgcgcggtctcaggggcgccaggggggcccaaaaagccagtgtgtacaggaagcgggacaaaacccacaacacttactgcacaagttgcaaaagacagggaggacagctccacacgaacacggtggtgcagcacaggggccacaaacggccaacagggggtgagctaccaacaaacgggggaaaaccccaaagcaaaaccccggggacagaagagcactagaggggcccatcatccgagccgggggaagcaaaagagaacatagccggaaaacaggtaccaaaaaagaagtccacacagaagcaacaacacaatctacgagtggcggacccatctcgaggaagacggcagaagagaagggaaaaaaagcgcacagaaaaactcctgtgtgaaaagggacaaagcgctgtgcaaagtagcaggcacccgagaagatgtgacccacaaggaggacacaccagaggacggggcggcaacacaaaaggtgagagaaaattcgcacgccacaacaacaacagcgcggcggagcaacgtgtcccccacagttgaataaaccacaccaaggccagagaaagcagaggaagcacagagagagaggacagcaacaaaaaaatagttgggccacgggaggacacagtgctacaccaaaggcgcacatcgggcagcacaaacaactcggggggggaaagaagacccagaggagggaaagagagcaccgaaaatacaggcgcagat

SEQ ID NO: 674033 - DNA, 113 bp, Homo sapiens
cggatccccagtgagagcagaggcccacatgtgaatactccgactccatctatagaatattaaattagtccagacatggtgtcggacttctgtcatctcagctactcgggaga

SEQ ID NO: 674034 - DNA, 129 bp, Homo sapiens
gcggaccgcctggcttctcctggtagggcacctccctagcccctagccgtcccaggagagatggtgctctcctgtgcccggcactctggcccttccctgggccgcgtgccccatgagccatgtgcactt

SEQ ID NO: 674035 - DNA, 552 bp, Homo sapiens
  misc_feature (552)..(552): n is a, c, g, or t
gggggctctgcgctcgtccggccggccccggcctcgccgcccgcgcagtacccagcccggcccgctcgatccgctctctacgtgccggctcctgcgcccttcccctgaggtgctggatgacttggggcctggtttctgcctctgcaaaaacgggtggacaccgagctgaccgcggactcggtggatgtggtgcgccgtgcaatggttgcatggcacctgctggcgtgcgggacctaccagctgcggcggccggaggaccggctgtccggcccccagaacaaggtgtcacatcccggtggcttggacatgccctcttgggcttgaggagatgccagtggatccatagcaaaatgttccgcctggtggaatcgtgagtagaatgagccatcgtgctggagccattgtccagccttgccctggaggagcagtgtctggcttgtccctagatgtgttccactgggaataactggaagggctggggacctagccttgaagatctatcagcagtgactccacaagggcaagctccacgctcctgattggttgactgcn

SEQ ID NO: 674036 - DNA, 809 bp, Homo sapiens
  misc_feature (32)..(32): n is a, c, g, or t
  misc_feature (86)..(86): n is a, c, g, or t
  misc_feature (196)..(197): n is a, c, g, or t
  misc_feature (202)..(202): n is a, c, g, or t
  misc_feature (229)..(229): n is a, c, g, or t
  misc_feature (247)..(247): n is a, c, g, or t
  misc_feature (262)..(262): n is a, c, g, or t
  misc_feature (274)..(274): n is a, c, g, or t
  misc_feature (280)..(280): n is a, c, g, or t
  misc_feature (365)..(365): n is a, c, g, or t
  misc_feature (586)..(586): n is a, c, g, or t
  misc_feature (591)..(591): n is a, c, g, or t
  misc_feature (594)..(594): n is a, c, g, or t
  misc_feature (606)..(607): n is a, c, g, or t
  misc_feature (641)..(641): n is a, c, g, or t
  misc_feature (685)..(685): n is a, c, g, or t
  misc_feature (736)..(736): n is a, c, g, or t
  misc_feature (795)..(795): n is a, c, g, or t
gggggggtggtgggaggtcccggccagcacanagggtcaggggcccttgttcccggccccacccagcagccaccaagtggacaganatgacattctctggttccagtcaggaagctccttctagaagagaagtgagaggtgagggaaagcaaattccagaaaaaaaagaaaaaggaagaaaagggttactaccagnntcggnggccctgccccgacgccacccaagaantggaagatcatattatanaagcttcaaaaagtnacacagggtggnaacaanatgacccaggaaagggaagggaaggaagggtggggggggctgaagatggaacctggctgagtggaatgggggggcggtggccttntgagaccagcacagaccagcagagggaatgtgagcagggtctgggagggaacgggaagacacctggctggtctgaagtggctcatgaggctgagtgtagcagtgggtgccagactgagggagctggactgcggtggaggaggtggccagagagtcccttcgaggggagaagctgagagtgaaacaggaacaggggatgctccgtgctcccagaagagcccnaaaanaanaaaaaaaaaaanntgggcagcactgtgggctccgggctggcatgggnagctgggcggcacctctcccgaggccgggggccctaatgtcccncaatgctagttcctggtaattgtttatgatcagacctggagggagaacaangcgccccctcccctccccaagccccagcacagccccgatgggaggggtagggtagaganatgagggtgggagg

SEQ ID NO: 674037 - DNA, 336 bp, Homo sapiens
  misc_feature (296)..(296): n is a, c, g, or t
  misc_feature (323)..(323): n is a, c, g, or t
gcggcctcccaaggtgctgggattgcaggtgtgagccaccgcccctggccagaaaaaaaagcttttaaataaagtaattgtcagcttaggcaacatagcaagaccctgtctctacaaaaaaaagatttaagttagccaggcatggtggcactgacctataatcctagctactctggaggctaaggcgagagtatcacttgagcccaggagctcaaggctgatcatgccaccatactccagcctgggtgatagagtaagaccctacttttttttttttttttttaaaaaggtaaccntcaagggcaatgaaaaggaaatggtcntatttcccattcc

SEQ ID NO: 674038 - DNA, 325 bp, Homo sapiens
tggatatggagtctcactctgttgcccaggctggagtgctgtggtacgatttcagctcaatgcaagctctgcctcctgggtttaagcaattctcctgcgtcagcctccccagtaggtgggactacgggtgtgcaacacaacatccggctaatttttgtatttttcgtagagacagggtttcacatgttggccaggctggtcttaaactcctgacctcagttgatccacctgcctgggcctcccaaagtgctgggattacaggcataagccactgtgcccagctgcattgttgctgttttttattgttagttaagagaggtcgacg

SEQ ID NO: 674039 - DNA, 153 bp, Homo sapiens
tgttttattttttaaatgctatgcttcaaaatcaatttgtgttttatgccctttcccccagtattgtaaagcaagtcttgtgttaaaagcccagtgtgccagtgtcataatgtagtagtgtcttcctggttttttaataaatccttttgtata

SEQ ID NO: 674040 - DNA, 167 bp, Homo sapiens
tacgactgtataagtatcttccgcttctctcaatatgacactttcaagatgctggtgcaatataatctagaaatgtggatttaagataaagaataattcaaaaaacaggccacattaaagtgggtagcactcctctatcccatacccctgtttacataatctgtaac

SEQ ID NO: 674041 - DNA, 162 bp, Homo sapiens
cgatcgggcagatctgtctccaaggtcgtgttgagtctactgagggctctgtgttcctgagggagcagatctcgtagggccacaaggtaagagttccgattagagtttagaatcccctgttccttgcctagtccacgagaactccctctcaaaacgacagtt

SEQ ID NO: 674042 - DNA, 129 bp, Homo sapiens
cccggcaatcgcacggagagtggagaccccgctcatggagaccgacaccaggtacttgaggtccccgtgggagaggacagacagcttgagtgcgcggaaacagatgtctgaaagtgcctcgttgacgat

SEQ ID NO: 674043 - DNA, 419 bp, Homo sapiens
cccccccccttatttttttttcaaaaccccccccggggttttttttttttgggggggcccccccccccccgtttccctttttggggttcccccccccccgaggggagggggattttttccccccccgggcccggggttttggggccccccccttttttggggggggaaatttttgggggggggggaaaaaaaaaacccccccctcccccccgttcccggtggtttttttattttttttttcccggcccccgggggggccgggggggttaaaaaggccccccccccccttttttttctccacccctcttttttttggggggggccccgggggggggttttttttttggggggggggggggggggtcccggggggccgggttttttttttttttggccccttaccttttttttttttttta

SEQ ID NO: 674044 - DNA, 661 bp, Homo sapiens
  misc_feature (93)..(93): n is a, c, g, or t
  misc_feature (114)..(114): n is a, c, g, or t
gggtgactagagtaagcaggtcaaatcatcattaatttttcaaaaggtaaaacatgggtatacacgcatccagtgaaagcttcttagccatanaatcagccgcaaagttgtggnatacattcattacgtctcagagcaaccataaacagccccctcccaggtgcgtccagtcagtagcagcatagggtttatgagaggtctgtaaagcagaaggtacccctaggataacgcttgtgccacatgcctcatgacaacatagcagggaagccatcatggtgtcaagccgtcctatgacttcgaacgaagaatccacacctccatcggtcatttcctttagcacttcctggatgggtttcttgtagtcttgagggttaatgcattcagtggcacccaactgtttggcctttgcaaatttgtcctagttgatgtccaccgcaatgattctggctgctccagctgctttacagcccataacagcagataggccgacccctcccaggccaaacacagcacaggtagagcctggggtgaccttggcaacgttaactgcagacccataaccagtcgagaatccacagccaatgaggcagacttctccaggggcaaggctgcatcaatcttgcccactgcattctcatccaccaccgtgtattggtagaag

SEQ ID NO: 674045 - DNA, 965 bp, Homo sapiens
  misc_feature (1)..(1): n is a, c, g, or t
nctatcctagcaggtagagggagtatgggtgggagtgcgcgtgcaaacgcctccttcaatacccgtgctgcgtatctcgtagtctggtgctttcgtgcgtcacccagtgctcggtgagccatttccccgggaattcttattttccgaagctcacataatggccgactttccatacgcgcgttgtccttgtacgcgagtgttccggcgggacaatttctggctttcggccccagtgttaagaacgggggcattctttgggttattgtcgcgcgccccgcttccccaggcctcttcccctggaacattactgcgtggggactcccagataggtgtcgccgcgcgctgtatcttaaaagagtggtttccccagcccatcgccaatttctgtccaaccccaagtttttggtcaactttatgaaccccccgtgttgtgtgttgaaagatccagaaaccccctgcggcgaacccccttttggaagcccccacttgatacgcccccccctatattttgaaacgcgccctcaaagtaagaaacccccaaaatcggtggcaagacatccccacgacatccccacccccttggttctcactcgccatataaataactattacagagccaattcttgtccgtgtcgtcccccgtcaaacctgaaaccaagtctaagcccctttaattgtaatctcactcatttcgaaaactctcgtcataaaaacagtgtgacacctctcaaaagccctcattacttctttacatacaactttattcagacaccatacttggtcgccaaacctttcaagagctttatgacaactgcccccgaaccagtcccccggtgatctgacaacctctcccctatacctcctcctccaccctacgccaggtcttcttgttccctccccccccccggggaaaaaaaaaattttttttctgcggcccacaaaacaaaaaaaacagaacataaaaa

SEQ ID NO: 674046 - DNA, 1081 bp, Homo sapiens
ctcccaccaccacgcccggctaattttttatatttttagtggagactgggtttcactgtgttagccaggatggtctcgatctctttacctcgtggtccacccgcctcagcctcccagagtgctgggattacaggcgtgagccaccgtgcctggccgacgcatataacttattaaagaaccaacctcttggctactcacttaatccctacaattgtcccatattaattacatattctagttaattcttcctttctatctcataatacgctatgacgtctctccctcttcgaatcctctcttctatacttatcacgctaaccctatcacgaattaacgccctatcacagttacattcgcatcctctacccaaccgtcttaatctatacacccattcaccattcacttcccaccaggcctcatacccacttctttccttctccctcaacgcccactttacctatatcaccctcccgcccccaccccttctatacccaccactctccctaccttctacttggtaccgctcacttctctacaatcaaaaatttccaggctcatcattacaccttcccgcccccctactccccacctcccctttcacccttcctccctgcgcaccgaaccgcgcacaccttacccccggccatccaccgcgctcgcgcccccccaagggcgcccatagccacgctcgcccccagcctgcagcctcccccgcaacctccttccacccacaacccaaccgctgccaacacaacccaatccctgcccccctctcccctagcgccgcttcccccaacaccccacccaccatctccattcccctacaacacctcttcacgccccccataccaattcacaagaactcaacccccttagaccccaactacccacccacccaccctctccccaaaaacacccacccccaaataccccccttgcgccccatcaccaccccccccccccccgccaccaccccccaacccccaccaccacaaaccccgccaccccgcacacaacccgccaccaccacccaacacccattcccgagccccccacaaccgcccagggccccaccccacca

SEQ ID NO: 674047 - DNA, 964 bp, Homo sapiens
  misc_feature (45)..(45): n is a, c, g, or t
  misc_feature (106)..(107): n is a, c, g, or t
  misc_feature (109)..(109): n is a, c, g, or t
  misc_feature (121)..(121): n is a, c, g, or t
  misc_feature (273)..(273): n is a, c, g, or t
  misc_feature (276)..(276): n is a, c, g, or t
  misc_feature (318)..(318): n is a, c, g, or t
  misc_feature (426)..(426): n is a, c, g, or t
  misc_feature (442)..(442): n is a, c, g, or t
  misc_feature (445)..(445): n is a, c, g, or t
  misc_feature (479)..(479): n is a, c, g, or t
  misc_feature (488)..(489): n is a, c, g, or t
  misc_feature (491)..(492): n is a, c, g, or t
  misc_feature (498)..(498): n is a, c, g, or t
  misc_feature (500)..(500): n is a, c, g, or t
  misc_feature (507)..(507): n is a, c, g, or t
  misc_feature (509)..(510): n is a, c, g, or t
  misc_feature (515)..(515): n is a, c, g, or t
  misc_feature (525)..(525): n is a, c, g, or t
  misc_feature (527)..(527): n is a, c, g, or t
  misc_feature (532)..(532): n is a, c, g, or t
  misc_feature (536)..(536): n is a, c, g, or t
  misc_feature (541)..(541): n is a, c, g, or t
  misc_feature (548)..(549): n is a, c, g, or t
  misc_feature (562)..(562): n is a, c, g, or t
  misc_feature (572)..(575): n is a, c, g, or t
  misc_feature (578)..(579): n is a, c, g, or t
  misc_feature (583)..(585): n is a, c, g, or t
  misc_feature (587)..(587): n is a, c, g, or t
  misc_feature (592)..(592): n is a, c, g, or t
  misc_feature (594)..(595): n is a, c, g, or t
  misc_feature (599)..(600): n is a, c, g, or t
  misc_feature (609)..(609): n is a, c, g, or t
  misc_feature (611)..(611): n is a, c, g, or t
  misc_feature (614)..(614): n is a, c, g, or t
  misc_feature (620)..(620): n is a, c, g, or t
  misc_feature (624)..(624): n is a, c, g, or t
  misc_feature (629)..(631): n is a, c, g, or t
  misc_feature (739)..(739): n is a, c, g, or t
  misc_feature (947)..(947): n is a, c, g, or t
atttggggacagggaggcacatggagaaaaaaaaaaaaaaaaaanaccaggcaattgcacaaagcctttccctggaaaacccaggctctggggatggtgggggtcnngncacatggctgcnccccctccagccctggagctccggctttgatggtcgaggcacagatggggattcatcccattccccacatacgagagcagtctgggagcgggagatcggctgggtgtgtgtatatatgtatgtatgtgcatatagatagatctatttatatnttntaggctatattagaaaatcctctctatgtataaatataaaanactggtatccaaacatgacaccaacagctaactaaagtgcttgacaggagccgggcccgggtaagctcgatggtaaaccgctcatcctgggcgctggggaagcaaaanaatgggggaccccttnagnagggggtgctgcaggaggaaagtgtgtgctggcnaagctgggnnannaagagnanttgggcnanntgggncttctgggtntnaggantgtntggtnaatgaannataaaaaatgtgnataatatttnnnntannttcnnnantgcgntnncgtnnatgaggagnanagngctggngagntaggnnnagggaagagctgttccacaggggactgatcatttgaaaaaaatccctccccctcaaccatcactcctccaggtcaggccctgcccgcactcctcctgggcttcctgcntgggtgggggtgggacgagggaggggagagaggctttgtggaatctgagggcagccacctttcacctgtaggccccaagcaaagcattagcacctccaccaatccccaaggcccatagaaatgcccacaggcaagtggtcaacagagctctagggagcagagggggcccagaaggcagggaagaaggcccccaaaaacacagtgctanaagaaggggttggtggt

SEQ ID NO: 674048 - DNA, 1870 bp, Homo sapiens
  misc_feature (316)..(316): n is a, c, g, or t
  misc_feature (464)..(464): n is a, c, g, or t
  misc_feature (970)..(970): n is a, c, g, or t
  misc_feature (985)..(985): n is a, c, g, or t
cggtgggttgatttttctacccaatctattctactccggccttgtaggtgcctcctaagtaacgttgctctcgaagaaggacggtgttgtcgctgctgaattctcccccgtcgtttgtgtcaaccgatcccgtctggcgggtacgtagttacacctggtgggtcactacaccacaccagtctgacgaccaccgcgtgttggctctaatacacacgggtattatagagaccgccttgttgtttgtccacccgaaccagctgtggtccacaaaatagacctagcacccgggggggtgccgactacccagcgtgccgtntcttaccacccgccccccccaattatgcggggcgcttttctgtcttggcggcaggagaattggtgaaacccttctgttggtagaagaagatgtgcgcccccccagctatgtaggtgatcgctaactagaaaaatgagtttgctcacgnagggagcaccacacacccgctgtattaataagggatgcaccaccctcgcctcgtccggtgcaaaagaagagatataagtgggggctttttctaatcggcgggtgaatatgattagaatggtagttccctcgggatatgatgtcctccctccacacaaggcttgctttgtatatcctccgggatgtaaccaggcgaatcgggtctaggtgactaataatattagattgagtgctgctgccgatttgtgctcccacccttcgggcttcctctctctgtgtatgtgggtgagtgggttatactatttgtgtgatctctgtctaatattgtgtggaataccctccgcgccgctctttggggtcctcttccctgtggagggtgcgcccctctaacgggttccccacttagggagtcgcccccctcttcgtgtgcttgtcacacccctgtggccccacgccatcgggggggtgacccacccttttctgttgtgtgtggggagtatcgcatanttttgttattatggngccgccccactgttattatctttccccccacttttgtgggggagaccacaccacactcgtctcttcttggtgggcgcacccttcgggccccacttattttgtgtattctcgtcgggagagacaccctccttcttggtatatattatagggagacgcggccctttggtgtcccccctctttggggtgattatcttctcaccggagagttatttctcgccgcctcttttccgcctcgtagtatagtagaatcttcatctcttctctacggagaccctctttcacttgtagagcctccgcacaactattttgtccactcgtcacactcctggtgagaatatagttgtttcccacaacgcagaagactttggggagacacacagctgctgagagcgagaagataatatcgcccctttttcgtgcccacacagtggtgtggcaatactccctcttttttttgggagaaccccacccacactaaagagcacagcgtcgcccactttctctgtgagagtcttgtggtctttctccgaggggcccccaggagagcgtgtgtcccttttctccctgtagggtccacagagattgtgcacaggctgtgagactatacagagaggtctacataacacacacatggccggagataacctgtgagatccctgtgcacagcgagaggaggaacccacgaacgctggtgttcgagagagtactcttttcctcgggagagggggcctctccacgcaatgtgggccaaagcctctcacattcacggggccagtatttttcaccagtggacacttcttcttgccacttcacacctatgcttgcctcgcacccttgccctcttaagggaaatgggggtccatttaaggaaactggaccttgtga

SEQ ID NO: 674049 - DNA, 962 bp, Homo sapiens
  misc_feature (570)..(570): n is a, c, g, or t
ggtggggcgtgcggtccctgctggacattcctccaggcgacctttgtctgcgagctatgtaaggcgcgagctgattctcagactcacgaaaggccgcagcgattcgtagaggcaccagttcttagcctcaatatgtgactctgcgtaacaagtacgggcaccgtgtgccgatggtttatactgttatctgaccggcgcgtggtctatcggagaacgttcagctcagtgttcagtcaatgcagtcatctgacgaagctccaatcctggtagcccgtgcgactgtgtccatgagaccaccaggatgctgcgggtgtccccctggatcggccttcttcacgcacccgcctgattcgagggccgcgtgagcaagctcggggtttgaacgtactggagaggcgcttcgtgtggagcagtcacggggccacgtctcttctggcgtgcgcgacatgcgtgtctcgcgccgcaagttgccgcgcaacgtacgaaggtcacttcatactcgattcgtgcgctggcagggagaaagacgagcgttacatttgacgaagttgcgacacccttgagtctatnaagcctagtatatccttgtaacgcccaaggcatgtctcctctggtacctaaaagttgcgctcatgagtcctaggccaggtgctcctcgtaattaagtggaagctcgtgacttaaggagtccgactaagcccaggttcactgcctggcacttcatactgagctccggggccaagcaacgaacgacacacgcggtgcctgtgcattccccagaaggggcgggacagaccgcttggttggtacaaacgcagccgcttgacgagggaagcaccccaaggaaaacggaccaattggctgggacaaggccgaacgaggacacaggaagcaaggattgaggggcagggaacagagcaccaagaagttggggaggctccacggaagtccaccaaggaagc

SEQ ID NO: 674050 - DNA, 682 bp, Homo sapiens
gatcaaaggaggcaaaagaatttaggaggcaaatgacaagcgataggcgtatagcagagctgagaatagagaactgctccttcatcgtaaatttagaagaccaagtagataatggaaccaaagtgtgacttttttctagtagttatttttcctgttctctttctgtgtacctctacagagaccaaaactcattctcttaaagagattttatgggggctactggcagataagaaataggacacaatattgaaaggagctacagaaggaagggagtcccatctcaaaaaaaaaatgaatggtatgccatggcaattaggagtatccaatgaaaggagacagttgagagtcaggacagaaaagcttccataatgtgaagctagattacataatagtatttctagaaaaagagatattgtaagatggtatgccactttggtttaagaagctgtgctgtgatcacggtagttaatttgggttgaatctgtggcatatatccttcagtgtcgtacacatttcagaagttattgcctttatttaccgatgtaggcgttggtcagcatttctcagtgtacacgaaaagtaccagtgcccatccactcataagcttggtcaccaaaaacttctctgggcagttactttggaaagcttcactcgtgctgtctgtataaagggcaggcctgtg

SEQ ID NO: 674051 - DNA, 416 bp, Homo sapiens
  misc_feature (41)..(41): n is a, c, g, or t
  misc_feature (122)..(122): n is a, c, g, or t
  misc_feature (134)..(134): n is a, c, g, or t
  misc_feature (139)..(139): n is a, c, g, or t
  misc_feature (154)..(154): n is a, c, g, or t
  misc_feature (163)..(163): n is a, c, g, or t
  misc_feature (214)..(217): n is a, c, g, or t
  misc_feature (273)..(273): n is a, c, g, or t
  misc_feature (304)..(304): n is a, c, g, or t
  misc_feature (311)..(311): n is a, c, g, or t
  misc_feature (316)..(316): n is a, c, g, or t
  misc_feature (319)..(319): n is a, c, g, or t
  misc_feature (322)..(322): n is a, c, g, or t
  misc_feature (331)..(331): n is a, c, g, or t
  misc_feature (343)..(343): n is a, c, g, or t
  misc_feature (409)..(409): n is a, c, g, or t
gcttcattgtggcagttccaatggccatcatatcaatttcnaaaatttaaaatttaacttttaaatcctacatcttttctgaaaatatctatcttcaaagtgctccaatactaacactatangccctttctttngctcnaacatctaacacaangggcacacngtcccattaattccacatgcactttacaaagcaacttcacacacaaatttnnnnaatccagaaactacataatgatcactttatattttgctacaaaattaatgaaggcngcatgcgggggaaacattagtagacacgganttctagntaacngtnggntctcaaganctgatggcctgntgtggaaaattaatatgcttatttagcagaagtagctaaagtacatgcatcaggggctggggtcanttagaat

SEQ ID NO: 674052 - DNA, 547 bp, Homo sapiens
  misc_feature (8)..(8): n is a, c, g, or t
  misc_feature (21)..(21): n is a, c, g, or t
  misc_feature (43)..(43): n is a, c, g, or t
  misc_feature (52)..(52): n is a, c, g, or t
  misc_feature (124)..(124): n is a, c, g, or t
aatcctgnggcattggggggnaacccctgttctcaaaaaaaanaaaaaaaanaaaggggggattatagggcaaatacattagatttgccaaattttccttcccccttgcccaccacttgagcangaacatttgctacccagatcccagggagttctcatatcctttcacccagcccatgggagcccttgtcttctctcttccagaaagccattatttctattagcatcccaatcttcatcaccaaacaccgtcaagaactgagaagagtctgaaattttactctactttggaagctaacaagttagcctcccacagttttatagatacaggttgagtatcccttatctgaagtgctggggatcggaagtatttcgggtttaagattttttttttgattttggaatatttttattatatatactttccaattgagcatccaaaatctgaaaacttgaaatctgatacccagatctgagcatttccttcacacatgtcagtgcttaaaaagcctcaccagcttgggcaacataggaaaatcttgttact

SEQ ID NO: 674053 - DNA, 1114 bp, Homo sapiens
cggcttagagggaggggctatgtttcgcctatacctactgtaggcttctccacggtagtggaccctaaaggctactgctgctactacggggctagacagtgactgtctcagctctaggatgtgcgtacttccactagaagctcttctgagggaggtaagttagaaaaacagtggaatggaaaaacagtgctgtagtcatcctgtaatatgctccttgtcaacaatgtatacattcctgctaggtgccatattcattgctttaagctcaagtcgcatcttcactagtgcaagtcattctgcccaatgcaagcaaaacaagtcatgcatcatcttccaactactgtgcacatgtgtgctccagaactggtgcaagctcagtcttctgtgtgcttgtgtcattctgtgttatcacaagcaaagatcatcaaagtcagcacaatttgaaatatgcttcctggcaaggcaattctctgatttcatgaagtggtccattccttggcttgcttatatagtcctggataagttgatgggtcttctatgtcccgtccctatcttcaagcagaccatggctgtaatcttctcaaataatagcaattataacaacagatcttctatccaggatagtgctgaagaggggtcttaactgggatccagtggggcttcccctcctggacttcataatagtctaatggtggccttgacatggcggggacttaaaaattattacaaggaacaatttggccagggacgtggatatcacatcacggcagggccatattcagagccttccccagtccacggccgatcctaatcagcacagggaagggtacacagacaaaagaacgatggatcacagcaacaggcaccgtgcacacagtgccggaagacaaacggggaaaccacaacagaccgagagagaacacagaaaccaactcgcgactggtacgcgggccaagagcccgatatacgaacacaggagacaacaccagcaaggcgcacacaccacctaagcaaaaacactgaccacgagagcaccacatgctcaacgccaaccacaaacgaccaccacgacgagaacacgcaacggcacgcaggtcaacacaacagcgatgac

SEQ ID NO: 674054 - DNA, 936 bp, Homo sapiens
tgggttataaccccggccaaaattttttaatttcttaaaaaaattttggacttgtcccccggggcccctttccccccgggctctcggtggggcccccatttttggttttctctcttttacaaggggggggagggaggaatccccttcccggcggggaaaaagaaacctcgagggtggggctgcccctggccaaaataccacaatgtgtcggcaaagaccgaagtagcaacaccagcgtgtggcccaggagcatccttcacggtggaccccgtgtcacaaggacctcggagggggggctcctcctcggggggggaccaccaccaatatctctcctgaggtttagcccccccagtccccacataccgcgggtgccccccgtcggtcgcaccctgtgtatgaagaacccgagatcactctcggcggccgagtctccacaacataccactgcgaagaggggtgacatcttccccgctgtgagaggagagggcgtcacgcggggcaacacgaaaggggcgcggaccaaccaaggagtccccagataggagggggaccctcttgggggggcccacgaaagaattttttccattgtttgcaccactggtgtgctgggccccccccaggggtgtacacagaatcgctccccacgaaagcagcctctgggttgtcttacgatccaacacggagaaattcctcccccggagtgggaaacgggtagacaaccaccccatggaccccgacggagggagtggaaacatcacaggggggcctgcaccgagaattaagaagagccgggggagaaactccttaatcacactcggagaagagacaaacgtgtgtcccagaaaaggagggggggaccccccacacgggggcggcgggcgagcgagaccccgggaatactcgcccactgggggcccgcaattttgtaacagtgcg

SEQ ID NO: 674055 - DNA, 124 bp, Homo sapiens
ttttttttagccttatgatgaatttgtttgaagggcattttctttatgaacaaaggcttggatgcatatcctttctttctgtgaatgggatagtccctgattaaaagttgcacagtgaaaccag

SEQ ID NO: 674056 - DNA, 193 bp, Homo sapiens
aatggcgcgactacgaggagctgggccagccgatcgcgcgtgcggtcatcgccagcgaggatgccggcttcgtcgagcacagcggcgtcgagtgggacgcgatcgagaaggcctgggaacgcaaccagcgcgccgaggcggtggccgagcgccgcaacgagcagctcgagcggcgccagcagcaggcgctggc

SEQ ID NO: 674057 - DNA, 411 bp, Homo sapiens
ggcgggtctaccccccctagatttctttgctcgaggttccaccaatgtaatttttaatagttttgtgtttgtttagtccgtagacacatggaaaaccatgtgtgtcaccctttggcacattctagcctccggtatacccggcgcgggacacttcaccctacccacgtcccggaatcttccatgtgttaccgcccgaatgttaggaaggtcacaccggggagctatggctttcaccattttgtgaataacaccttctaccatactttcacacataacctaggtccacaagaaatatttggcgggattccggtcctctggcggtcatccaccccccaaaacggcgatatttgtgccccggcgggtctaccccctatatttcttcgctctagtcgacgcggccgcgaatttagt

SEQ ID NO: 674058 - DNA, 120 bp, Homo sapiens
  misc_feature (27)..(27): n is a, c, g, or t
  misc_feature (37)..(37): n is a, c, g, or t
acatatacaatcagccggtacccaggntcttttcccncgtcaaagctgcgcagagcactttttattcctgttaattttgaaaaatttcttttggttgaaacagctgcgtttcacttccga

SEQ ID NO: 674059 - DNA, 720 bp, Homo sapiens
  misc_feature (46)..(47): n is a, c, g, or t
actcttattctaaatatatatttttttctcttgagtttgtgtctgnnccgctgttggccacagtaatatttgattcccctgcagtgtctagcatattgccttatctgtatttgttaaatggggaagagtgagggaacattatgagagcagagaaaagacaaaaaacttgtcttccaggtgtcatgatacagctaatacttactgagtaaagggtcctgaagctgatacagtttgttcagtctcttataagaactaatattaagttatggatacataattgctggggcttctcctctaacattgaaagagttctattctagtgagaaatgctgaaggttaagcttcattagctatgtataactcttcctcagattcagaaaatactatgtccaggcactgttctaagtctattcttgtttaaacttaactctaagagaatttgacaaaaaaaaaagaacacaaagagaataagtaacttgaccactgtcacaaagtttagccttatgaagtgtggtaattgtaaatgaggtaggattaatccatgaagggtcttgaatgccctaaacaatttgtatgacagtcagtgggaagttgtccatgtaagttttggagctagagactcaatacgatcaatgtaagaaaagtaggcaaatatgcttagtaagtaaataagcttgtgtaaattatgaaaaaaaaaaagtcgacgcggccgcgaattta

SEQ ID NO: 674060 - DNA, 287 bp, Homo sapiens
tactcgatcgcctgcaagaccctgatgagcacagtgcctggtggccgatttgcgtgatgcgtgcctgtatcaccgaggacgtgctgcagagcttcctgcaagcactgcccagcctcgaaaccaacaagcctgccacgccactgctggccgccctctccctggccatggaggacctgcaagctggcgacgcgctgtataccgaagctcgtgcagaagcagtgcgtcgcgcgcccgatcacccctggatcacccgcctggcagccgtgcacgacgctgagcacggcctg

SEQ ID NO: 674061 - DNA, 603 bp, Homo sapiens
aaaaaataaaattgtcttccccttataaggaagcacattcttgggttattttttccaattttttaaattctgcgatggcattgctgagtaataaaattaatttttttacccgtataaacaaaagatatctggaaaaattatttttctatacgccaattctaaattattaaattttccggccaaatataaataaattttggtttaactgcattaaaaaattatttgtactgccatcacacactttgttgtaaataaccaagttttgccacaccaatatgaaaaaaatgtgtttaaggaaaggaggggttttttagtgtggccaggaacacaaattcttttttttgccttaacaaagttttccctaccgtcaagtcttttaaagacaagctatagttgttttttttctggcaagggaagaaaataactttaataagtgccctgatttaaaaacaaaattgtttttgtttttaaaatttccacagtgggttgcaataacaggcgagcaccgggtttttgataccttggaataaggccggtttaaacaaaggcccacattttttcccccgcggtttgggtattttccctgtgggaactcctttttcc

SEQ ID NO: 674062 - DNA, 109 bp, Homo sapiens
tgcggtgccttcccaatgcacagaaaacttcctacttgacgctcatcgacaggtacaagagatggaaggcgagcagagccatgacgactcgagctccgaggattccgac

SEQ ID NO: 674063 - DNA, 197 bp, Homo sapiens
aaacctgggggaattttttccaaaaccattttttgggtccaggccgatttgtttttttccccccccaaaaaagttttttgggccatttggggcccccaatttttttttccccccaaaaaaaaaaattttttcttttccgggttcccctccccaagtttttttttttttttttccataaacccctcctttttagggga

SEQ ID NO: 674064 - DNA, 155 bp, Homo sapiens
gagtctttaggtttttctaagggtaagttcatgtcatctgtgaacaagggtatgatttctttctttcccattttaggactctttatttttttcccctgcctaattgctcttccagggcttccaatattatgttaaataaaagtggtgaaaagtga

SEQ ID NO: 674065 - DNA, 1426 bp, Homo sapiens
  misc_feature (1123)..(1123): n is a, c, g, or t
gttctagatcgcgagggccgccctttatttatttttttttgggtccagcaaagaaacatacgggtttatgggatcctgtattttccttaacttacaaagaacagccgtgacacagaacttcaaacgtttcaccttttaacaagtgacaggctccccgtgtagaaagaggcgtgcaccgtgtgacctccttacgagtgtgccgggtgtgcgagggttacccagtccgcaggtgtggacacgtgcggaccacagcgttctttcagcggttatacgtgtgccagaacgcgacggggaagtggcctttcgaggtgtgtgttctcttctcgggtgaagtgtgtagaaacaacaagaaggagcgcgaattgttgtgccgcggaagcgccacagcggtgtaacggagcgcgcgtatctcctttctgtgcgcgggagaccccccctttgtcttcacatatcgaggcgaaacgtttcttgtgtgtctcaaggtgaacttctcaatagcgcgcggagaagtccttccaaacgccggcagaggtgtaccacatttctcagggccgagggtttctccccatataaagggcgggggccaattgtagattctccctatgaaggggccaacacgaaagattcttcgagggtgttcaacgcgcgggtgtttttctacacaatgtgtacatttaagaccgcgagtggccatttatgggggggcatttatattatttggggacaaccaaatgttaaaaatattcggctgtggcgaggaagtattacacgtcaatatagcgggtagtatatataaaggccaccacttataaatattttgggttcacacgtaagttgggcccccaaggaaaacgggcgggctattaaccagccaaaaaaacccttatacccctgttggtaaacaaccgaggtataacactttcaatctcttgttgaaaaacaccagaccaaaaaaagggcccgaaggggggtccgttgaacggccaatttttaccaccccgtcgtgcggccggtattatataggaggcgcacaactatgggggggctacatcccccatatgaagagcaacgttagacaccaccgacccaacagaacggaagtgtggtggcctcaacagagacngcgcgattactctggtggggtatgacaaccaaccaacaaccttccacatactcgctctatatatacaaccgtcgtgggaacaccacaatatatatgtttattttctaccccacccccttaataggcggcgcttgcgccaactgtggcataaatcttaccacccgacaagtagccacccgtatgtgcacatatacaacttgtggttgtcggcccggccgtctggtgtgcattacacaccccatattcacgcgccttagcatgtgtggtctaaactacacacacgaggagccctcccggtggcga

SEQ ID NO: 674066 - DNA, 735 bp, Homo sapiens
gccaagaacctgatgtacctgaagcagatcctgtatttgctggacgaaattcgtggctgtgctagggggggaacattagtgcaaaatcccaatacacagagtctgtcgcagacagggatggagctgagaacgactatcaacgactttctcttccagagccagatcgatcgacatcaacctgtccaaagtgcagcgatactgtgagacgagcatgatcagtagaaagctcttttggcttcatcgtgaacggtacggagcagtgttctcatccctgggagcagacccaaacgtggggtgggtttcagcaattccctgcagagcctgcagcccaggacgactgagagcgtcttgcagtgctctgcagacgagagtcaggccaggcgatcccgcaaccagcttccccactgatgcacatcgaaggcttcctggcagatctcactacggccaaccacggacgggagggtcatcctgagccggcaagggcagtctcagtcagagcaccctgaagatttttgctccgtgaactccagctgtgacactttgccccacgtggtgaaggagatgccgggcagtggtcattgccggggggaaccatgcagccggtgtcctgacttccgggcagagctgctgggctgtgccggggtggaagctgagcgcgtggtggaagttttcctgtgtgtctttacggacacctggatttcaagttcggccctccctggtttacaggtactgaac

SEQ ID NO: 674067 - DNA, 589 bp, Homo sapiens
  misc_feature (9)..(9): n is a, c, g, or t
  misc_feature (17)..(17): n is a, c, g, or t
  misc_feature (36)..(36): n is a, c, g, or t
  misc_feature (50)..(50): n is a, c, g, or t
  misc_feature (80)..(80): n is a, c, g, or t
  misc_feature (102)..(102): n is a, c, g, or t
  misc_feature (106)..(106): n is a, c, g, or t
  misc_feature (116)..(116): n is a, c, g, or t
  misc_feature (126)..(126): n is a, c, g, or t
  misc_feature (218)..(218): n is a, c, g, or t
  misc_feature (244)..(244): n is a, c, g, or t
  misc_feature (271)..(271): n is a, c, g, or t
  misc_feature (299)..(299): n is a, c, g, or t
  misc_feature (307)..(307): n is a, c, g, or t
  misc_feature (321)..(321): n is a, c, g, or t
  misc_feature (324)..(324): n is a, c, g, or t
  misc_feature (395)..(395): n is a, c, g, or t
  misc_feature (401)..(401): n is a, c, g, or t
attgggccntaaaggangaattaataaattttgtgngagacttttttatnaaacaaaggggggttcaaaataggggtttnaggtaatcttttcccccagttnaaangaaacaaaanatgccatttngtatttttagaatagaccaatttttggaattccagatttttcataaatttcatgtaggactcaccacttcaaattaaaccaaatttttttancccttctttttccaatcccttcaacntaaactgttttcatttcctgtattgcntatttcaagtaccatccaagagccatcntgagttcntcctccagcctttnttntcttgtctagttagtcagcaagtcttgcagattctgcctcctcacctgaagttttcaaacagtaccccttnacattnttgaaaattattaaagatccagagaacttctgttatatgggttatagctgttaatatttgtcatattcgaaattgaaataagattttaaggtattttaaaataacagtacaaaaccattgtattttgacatgaataacacttttatgaaaataactatattccaaaacaataaaattaccaaaaagtt

SEQ ID NO: 674068 - DNA, 335 bp, Homo sapiens
cctgggagcctccctgagacctgaaggatggatgaggagaacgagtcaagacacagattgggtttttctttggaaggaagaaaattccattcccaagtgacctccctcttccctactctctccacagtgtgggacaaagtccctgcagacatccgaatcctcgccatcaaatccaccacgctgcgggttgaccagtccatcctgacaggtctgctggcctgggtgggaagatgcatgggggtgggacgtggggaggaagaggcaacaagggggaggtgagtggaaagacagagaaccctcactgtctgagcaacataaagagaccctgtctctac

SEQ ID NO: 674069 - DNA, 137 bp, Homo sapiens
ttctccgcggacagctccccttcaatggcgggtacaccttcagtggggtcagctttctggagcaggtgcatcacatggtcctctgtcatgttgccactacttggtggcattctgcatggccccacagatgagagcgt

SEQ ID NO: 674070 - DNA, 630 bp, Homo sapiens
gagggatgcccatgtcgtatgggccgttgtcttgcggaggtcactgccgagcggtggtagactggatccagtcaggacgatgggtcgtgtgcacgaatccatcaaccgttcactgatcgttgggctgaagatcagcactaagagcgtgggccgagacgagcgggaggatatcacccagcacctacaaatacccagaggggtcctcagaggagagggaggccttcacaagggcgaaccaccgtgaacaatactgggccgcagaaggaggacgacagggatggccatgcggatccgtgtgggccagagcatgaacatgggcagctgactcacggaccgtctttgaccacatcaacaagcaacagcgctgagcgagtacgtcctgccgcctcctgctctgtgcccgcaccgatcagctacaatgggatcttggggcccgagtgtggcacccaagtacctgctcaaacctcaactggagccttacgtctgagcaagagcgtacctcttgggcatcggtctatgagcaaagtacccgtgactgcctatacaggagaccccaacactcatcacaggtgcggggccctcactacgctggcagccaggctatcaaccagcatacctgctgggtgcgag

SEQ ID NO: 674071 - DNA, 569 bp, Homo sapiens
tgaggaccccctgatatgctggacatggatcctactggtaaactaggtaaactttttttttctaacaaaaggttcgtgattggggttctcaggttatcggtggagggtttagcataaacttggatgttttctttttggtaaactcggttttaaataatctgatttagctgtttttccagggttaggatgttggcatcatttatagttgctgaataaaatggggtggtaaatgtgttacaataactaatcagaaaactattttaataccattctccctaagtagacaaggtgtagacctaaagaggtttggggccaaacctaatttaagcggataaggtgacagaataattaacagtacagtgtggcttccttctagtagaatcggtttttaatttctaaattagaagaaataaagagaaaacaacaacattgctaatttggaggtacgtgcctgcctcagggaaatgcgaatggggaaaaaaacatttggtacaccctatttcatagtatgtgtcagtagccctaaagatactgtacccttagaccgagtaatcccagaaatatcgagg

SEQ ID NO: 674072 - DNA, 464 bp, Homo sapiens
tacccccaccttatgccggggctgctttgtgttagttaacaagtgttaatactgacttatggcttcctgtgcactctgcactgcagttggtattataggggtagagagggtgtaagtgggagggaaacagaggaccatggcaggatctctatcgtagtggagtgtgtatgctaatttcaagtgtctattatggaaagtctggcatgaggacataaccgcttgagctaactccaatccgtcaagtgtctatcatgagtcaaacactatgccaggcacttttatgtacgtcatctcatttaattatgatagtaattggcttacatgttatagttacgattttgcccctgttttacggatgagaaaatggagagtcagagaggttaggtaattggttcaaggattggttcaaagatggcttcatgacagaggtggtctttaagccctgatgagtcatgaagttagac

SEQ ID NO: 674073 - DNA, 589 bp, Homo sapiens
  misc_feature (496)..(496): n is a, c, g, or t
  misc_feature (551)..(551): n is a, c, g, or t
  misc_feature (567)..(567): n is a, c, g, or t
ccagaagcgggctttgtctgtccacctgcacagtgacctgcagggcctggtgcagggctctgacagtgaagccatgatgaacaaccccgggtatgagagcagtccccgggagaggagtgcgagagggcattggtacccgtacaatgagaggttgatctgtatttactgtggaaagtccttcaaccagaaaggaagccttgataggcacatgcgactccatatgggaatcaccccctttgtgtgcaagttctgtgggaagaagtacacacggaaggaccaactggagtaccacatccggggccatacagatgataaaccattccgctgtgagatctgcgggaagtgctttccattccaaggtaccctcaaccagcacttgcggaaaaccacccaggcgttgctgaagtcaggagtcgcattgagtcccccgagagaacagatgtgtacgtggaacagaaactaggaaaatgacgcattcggcctcagagatggggcntagatttcccggatgggaaatttcacacagtgttttgatggttcccgatttaagntgggtaaaggaagttncacccaaacaaaggcactttat

SEQ ID NO: 674074 - DNA, 525 bp, Homo sapiens
  misc_feature (5)..(5): n is a, c, g, or t
  misc_feature (157)..(157): n is a, c, g, or t
  misc_feature (213)..(213): n is a, c, g, or t
aaagntcgggcccgtcaccgcacccctgagtgttatgtgtgcactgactgtggcaccaacctgaaacagaagggccatttctttgtggaggatcaaatctactgtgagaagcatgcccgggagcgagtcaccccccctgagggttataaagtggtcnctgtgttccccaagtgagccagcagatttgaccactgttttccagcaggcctttgntgcagctttttctctcagtgttttggccctctcctctcttgaaagttttctgcttactttggttttccctctgcttgtaaaacattgagtcccccccctgccttggttaattgactccccccagctgtgcgatgcccgcttttacaattaaaggaaaactgttgtgttcagtgtccccttgtcaacaaccctgtgtcccttcgcccccccgtttttttttggggcatttggacatcagccaaatttgaacccaatcaaaaataacgtgtttgcccctgattttgtttttacccaataaatgtataggcccca

SEQ ID NO: 674075 - DNA, 180 bp, Homo sapiens
  misc_feature (75)..(76): n is a, c, g, or t
acccctaataaaattaattaaccgctcattcatcgaccttcccaccccatccaacaatcttccgcaatgatgaanncttcggctcacttccttgggcctcctgcctgaatcctccaaataacacaagggcctatttctaggccatggcattcactcaccaagaggcttaaacccgccttt

SEQ ID NO: 674076 - DNA, 1074 bp, Homo sapiens
gttgtgcccgtccgaactgagtctgtgatgaggactagcgcgtaaaagcccggagtggcaaagagaaatcatcatatcaacgattgtcgtgtattgcgtccagtatgacttgctaggtagagtcgagcactactggcgggtcttactctattaaatggaggtggctcgagcaaaagagtagaccgatttgatccacagtagtgagaatggaagcgtagttcggagacttgcggaacccgtgagcaccttgacatctcatgcctgcgtgcctctgcgatcgactgcacaagtctcgcactggtgacacgcttcgatatttacctattgactatctccttatggagagctttgacgtaccagctgagtactagtgtgaccttcgattgcatgcgcccaggcacactggaggactaacatcaccgaagcaatgatgacagcggacgatcgtcgagagcgtgacttgtcgctagtcactcgcatcagttggttcgatcggtcgatatcggaggacctaacgcaagcttggtgcatctcccccaaaaatcggcgccacgatcgcagagcgacgctgattgcctcgttcgtgattacacactaggtcgtccttgtcgagagacaaactacattcgtcgagttgttgaagtagaaagcttgggatttccgacgtcgtaagcgcacccctaaggtgggcattcatcatcattgtcatggaaccttgtccacttcgaaggtacagttacctttgcatcaagggaaaatgggttacgatgcgccggacactggaggtcgtttgcggcgacgctctgggttagctagtggtgaccacctgctgggagcctatctcctaacgtgcccgggaccgcggaggtgccttgctggcccgtgcagtgtgccattgcctgtgccactccgcccggtgtccgggctttgtctttgcgatcctatgctcacggtgtgtcgtctgcgtgctttttggctgcccctcgggatgtcgactgagggcggcgtccggacaggtcttccccggctgcagtgtggattagagaggcttgtggcccttgcccgttctgtcag

SEQ ID NO: 674077 - DNA, 304 bp, Homo sapiens
gacctatatattttaagtgtttgttgtatggaaaatctatttttaaattgttattttacattctggccgggcgctgtggctcacgcctgtaatcccagcactttgggaggctgaggctggcggatcacgaggtcaggagatcgagaccatcctggctaacatggtgaaaccccgtctctactaaaaatactaaaaattagccgggtgtggtggcacgcgcctgtagtcccagctactcgggaggctgaggcaggagaatggtgtgaacctgtgagacagagtttgcagtgagccgagatcgtgt

SEQ ID NO: 674078 - DNA, 618 bp, Homo sapiens
gccttgttcgcccgtaaccgccatcttccagtaattcgccagaatgacgaacacaacgggaacgaggagaggcacccgatatatgtctctaggccttgtacgcaaaacatggacgtgttcctttgatcacatatatgcgaatctactataggaacggtgatatggtccacatcaaggcgaatgggtactgtcaaaaaggaatgccccagcaagtgttaccatggctagaactggaacagtctacaatgttacccagcatgctgtgggcattgttgttaacaatcaagttacgggcaagattcttgccaagagaattaagtgtgcgtattgagcacattacgcactctaagagccgagatagcttcctgaaacgtgtgacggcaccatgatcagcaacaaagaaaagaatgccaaacgagaaaggtacctgggcttcatactaaagcgccaggcctgctccgacctcaggagactgcgcacctttgtgagaacccactgggaaggagcctgagctgtggaaccctattctctatgaattcatggccttctttggttgttcacgcaacctgattactgcctctgggcttagaaatctaaatggcaactttttgtgggtgc

SEQ ID NO: 674079 - DNA, 901 bp, Homo sapiens
ggtctgcgggagcctcggtgcaccatgagcgatggtggtctatcgtgaaggagggttggctgcacaaacgaggggagtacatcaagagctggcggccacgctactgcctcctcgaagaatgatggcaccttcattggctacacagggagctggccgcggaggatgtggaccaacgtgaggctcccctcaacaacttctctgtgcgacgcgatgtgccagctgagttgaatgactggagcggtcccgggcactcagtcaccttcatcatccagtcgtggcgctgtcgatggtggcaccagctggtcatacgatagcgcaaccttcccatgtggatgactcactgtatggagcaggtgatggagtggtagcaaccgtcatccgagactgtggctgacgggctcataagaagcaggaggagtgaggacgatggactatccggtcggagctcacccatggtgacaactcgaggggcatgaaggagtagtggaggtgtccctgggccaagcccataggcaccgcgtgaccatgatacgagtttgagtacctgagatgctggtgggcaagggcactttcggtgaaggtgatcctggtgaaggagaaggccactagggcggtactacgccatgaagatcctccggaacgaagtcgatcgtgggcaaaggaacgagggtggtccacacagtcagcgagtaacagagttactggcagaggtccaggcgaccctttcctgcacaggcccttgaagtacctctgccaagacgcaagaaccgggcttctgcttttgtccattggagtacgcccaacgggggcagcttgatcctccaactggcccggaacggggtgttctcccgggggacggccccgttctcatggggctaaatgggtgtagcctggctaactt

SEQ ID NO: 674080 - DNA, 120 bp, Homo sapiens
  misc_feature (14)..(14): n is a, c, g, or t
cagcttagtgaaanagtgggcatcctttggcagatattgaatttgctaagggtagaggaacatttccctgtgatatttctgtccttgatattcatcaagatttacactggaatcctaaag

SEQ ID NO: 674081 - DNA, 268 bp, Homo sapiens
atgaggaaagtcagtggggatcattgtaagtgacgggctcgtcaggagctggtaacgcccactagatgaccgccgtactacacagagcttgaacaacaaacaggctgtaacgacagacaagctgtacaacgcaggacagatcgctcacctctcccctaccatgcttacagcaaggctgaatggctgacactccacctgctctgcagctgtaacttccccggctacgacactcgctgacttagcgggacctcctcctagcagctcgacc

SEQ ID NO: 674082 - DNA, 973 bp, Homo sapiens
  misc_feature (973)..(973): n is a, c, g, or t
gcgttcttcccaggtgctacctgcagagggttccttattgggcgctggaatcctgatcgccgttcgtaagcttaggaggagaatttttcacaactgtcctggagcccttggatgtccgtgcaatatgaaggaggaggatgtgcttaagttccttgcaggaggaacgccatgttagtgtggcacgaatcttggactgtccagagtgcaatcagtacgatgctataaagaggaacggtgatggacttctatatcataaatctcaagaggacttgggagaggctctctgtgggcatttcgtgggattggttggcatggagaagcctgtgatgtcaagtgttatatcctcgcaaggaatacgtggcacagagcgccttaggagttcgcatatctgctggtttggcaattgggaggccaacctccagatttgtaggggacagattcagttccttgagaacttgtgcattgaagcgaagatccaggatagacttccgggcacccacgggaattccttgtggtccagtagatacccaaggggttgaccttaccaggtcgtctcacttggaggggctctcgttggttaagacctaccctgaccatgtgcgcttgtgtaagcacggatttgtcctctggtcgctattgttggagagtatgttatcgcgatgcaacatatagggaggcacaactcaggtggggcagatgtgtggcatgctggttcggggacgtctgcgcatggggtgtccacattttccggtgacacccaggtgttgggcagcctgtgttgacttaagagagaggcctggataatggaaacgagggcgggccgtggtgtaaaggcgtgaccaaggagggcgtactgcgcgagggagtgtccgcccttgtactgggtacacccagtgtgtgtggctggggaaagacgccggggctggaaaacacatatgggggccccggaggggtgtccctcggatgacaggcn

SEQ ID NO: 674083 - DNA, 711 bp, Homo sapiens
  misc_feature (360)..(360): n is a, c, g, or t
tgtggtggctcacacctgtaatcccagcactttgggaggccgaggcgggtggatcacctgaggtcaggagtttgaaaccagcctggcaacagggtgaaaccctgtctctactaaaaatacaaaaaaattagctgggcgtggttgtgtgtccctgtaatcccagctactcgtggggctgaggcaggagaatcacctgaacccgggaggcagaggttgcagtgatcctccgacctcagcttcctgagtacctgggactacaggtgtgtaccaccacacatgataatttttatgtttttgtagagatggtattttgccatgttgttcatactggtcttgaaatcctggactcaagcgatccgnccacctcagcctcccaagtggctgggactgcaggcgcccaccactacgcccggctaatttttttttaggtattgggtatttaagaaaagacggggttccaccgggtgggccaggatgttttccatctcctcatttttgtaatcccaggcactgtggaggcaaggggagtggatcacctgagggcaggggtcaagaccagctatccggaatgtggaggcccgttgtctaaaaattaaaaagtggcgggatgtggtgctggtgagtccactacttgggggtagggaggaatcgttgaccgggggcgagttgcaaagcaggtcggcaatgtcagcggtgagggaaggtcttctt

SEQ ID NO: 674084 - DNA, 100 bp, Homo sapiens
cccggagcttaccctcagcctaacctcacattgggcaccctctaatcccttctctctgcagtaactccctcaccctgcttaggctctaacatcgaactcc

SEQ ID NO: 674085 - DNA, 294 bp, Homo sapiens
caaagtcacatcttacgtgccggcaggtgagggagaatgagaaccaagcaaaagagatctccccttgtaaaaccatcagatctcgtgagacttattcaccaccatgagaactgtgtgggggaaaatgcccccatgattaaatgctctctcgccaggtccctcccacaacacgtgggaattacgggagctacagttcaagaggagacttcgaagtgaaagccaaattcatgggagttcaaatggagacttttatgttacattatcaggacctgctgcagctacagtatgaaggag

SEQ ID NO: 674086 - DNA, 1010 bp, Homo sapiens
  misc_feature (19)..(19): n is a, c, g, or t
  misc_feature (62)..(62): n is a, c, g, or t
  misc_feature (68)..(68): n is a, c, g, or t
  misc_feature (82)..(82): n is a, c, g, or t
  misc_feature (100)..(100): n is a, c, g, or t
  misc_feature (107)..(107): n is a, c, g, or t
gcatcaccttaacatggantacaaagatgatgatgatgttgttgtgtcttttgccaaatggntgagcngcttctgggccacngctggagagaggaggatnagagagnactccgggaacgccaccgactgcaagccaccagtcacaggaaaacctccctgccctgcccacttcctgtgcttcccagaattccatcatctgactgccatcctagaaggcattctcatgaggaccaggaattccgatgccgatcgtctgaccgtcttcctagaaggcattctcatgaggaccaagaatttcgatgccgtagccacgtacgggattacagaaaatactcagaggatgggtcattcaaggagccactggaatcaaaaggaagatcccattccaaaattgagaaattttcagagtcctttgaacggcaactgtgctttagaaccaagcgttctgcctctttgggacctgaaagcagaaaggagagaaatgaaagagaatgcctgaggatggagataaaatcccgaaagaaagtagaggaagaaaggagctctaggaaagaagaacatggagaagcacacatggctcccctgtttgaaaaagggcctgaataatactctgcttctgcctcatgacatcagatgctactgttttggtttttttctttgagccccaattcaccatttcaggatgtggatgggggcggggttgggggtaaaaacagctataaaaagcaactgcagatgctgactgactgcagtgggcagggtatgtagctgctccaagatgacttgcatcataccccaattactgctggcatcttagttgagagtataatctgcttggttgcctttttatgggaataaagagaataaaaggtattttaatagaataaagaaaaatttgaaaatataatggaaggtatttaaagagccacccacatagcttcaccaacccttctcacacatcaactcataaatcatcttaaataaaagtcattggtatgactcttgagttt

SEQ ID NO: 674087 - DNA, 292 bp, Homo sapiens
atatcattcggctgccatctacatgatactagtcactctgtcatgactatgtgtgtcctcttgaaaactttacattatccacagatacaccatgtttattctatacaggattctcataattgtgtaaactaagtatacatagcctggtagatctggaacagaaacaataataattcatgtggtagggtgccaaatcagtggataacggagttccatgaaaacttgatgtcactttcgtcataacgttttccgcgttgcagcatattgtttttggagagattctcccatcttg

SEQ ID NO: 674088 - DNA, 726 bp, Homo sapiens
gctgcgccccgcgccatgtcaaagaaaaaaggactgagtgcagaagaaaagagaactcgcatgatggaaatattttctggaaacaaaagatgtatttcaattaaaagactgggagaagatggctcccaaagagaagggcattacgtgtatgtcagtaaaagaagtccttcaaagctatagtggatgatggtatggtgtgactggtgagaggatcggaacttctaattaattatgggggcttttccaagtaaaagctcttcatgcagggaaacataagtgggaggttctggaatctcagtggtctgagggaagtcaaaagcttgcaatgccttacagacaaagctaatggagaaagctaaaatggccgattgtgaacgggaagagcgaaccaggctagcaaaagagctttcttcatttcgagaccaaggggaaccagctaaaggccagaagtagaaaatatacaaaagaattgtgatccgcaagttggtgggaacgaaataccgcaaagcaaaataacagtagccaaagaaggctggtaaacagtatggactgataacaattattcggcaataaaaatctgtgggcaaaaagacacatgggggttgtgaagaaaattacacatgtgattagaaccttgtgcgaatcccagaagacttggattaatagaataaaattatccaatgggggtgaagggtgtacacgtgggtgaatatgtaattttcaact

SEQ ID NO: 674089 - DNA, 858 bp, Homo sapiens
gaccccattctataccaagacctattctgatttttcggtcaccctgaagtttatattcttatcctaccaggcttcgcgaataatctcccatattgtaacttactacatccggaaaaaaagaaccatttggaatactatacggtatgtgtctgagctatgtatatcaattggcttcctagcggtttatcgttgtgagcacctaccttatagtttaccgataggcaagtagaccgatatactcacgagcagtattatcactctccgctaccttaatcatcgcgtattttccaccggcgtctaagttatttagcgtgaatcgtccactgttccacgtgaaacgccacatattgacacattgattctgtcttgtcagtgctttctgaagtccctaggaactccatctttcttttcacccgctcagtgtgggctctgcatctggccatttgttatttagcaaactcattcaggtagcaacatcgtacctacacgtacacgtactaccgttgtatgcctcaacttcgcagctaatagtcctatcatgtagcgagctagtcatttcgccactacatatgggatggctttcatctccactgacttgtaccctctaattactcgagggctacactccgtagacacaaacctacgccaaaatccatttcactatcatattcatcggcgtaaatctaactttcttcccacaaaaactttctcggcctatccggaatgccccgacgttactcggactaccccgatgcataacaccagatgaaacatcctatcatctgtaggctcattcatttctctaacagcagtaataattacttactttccatgatttgagaaggcttcggttcgaag

SEQ ID NO: 674090 - DNA, 362 bp, Homo sapiens
tgactgagactcgtatatcaaagttacgccccggcactgtagtaaaatgtccattcatctgatccacatgcgtgttggcagcgcgcaaggcgttagtagtaggagcaatgagtggaggtatgggctattccatgtatcgggaattctgggcaaaagataagccttagaagaagagatgctgtcttggatctgtgtaggagggagcttgacatagtaggtatagagtgtcattagtgaattaaagttacctaggtattagtaggaaagtaaactaattagtatgggtagaagatggtaacatggcattttgaatattggattccttacgttgcaggcttgataggcttggtgaccgaataata

SEQ ID NO: 674091 - DNA, 384 bp, Homo sapiens
  misc_feature (33)..(33): n is a, c, g, or t
  misc_feature (359)..(359): n is a, c, g, or t
aaaaagagcctagcaagctacgaaaagacatgnaagaaaccttaaatcccacattacctaagtgaaacaaatccaatctgaaaaggctgcatactttatggttcagaggcaaaattatggagacaaaagaaaatagcccaggagtttagaggagtaggcgaaacacagaggattattgggacagtgaaacggctctttatccttctgtaataatgcatacatgtcattattcatttgtctcaacccacagaatgcacatcaagactgaaccctaattaaaccatggactttggccgatagtgtcaatgtagtctcatcaattgtaacaaatgtaccactctgaagggggatgttgatgntgggggaggctgtgtatatgtgagg

SEQ ID NO: 674092 - DNA, 104 bp, Homo sapiens
cacactcgtgtgtgaacatccagcactgtccacagcattccgctgaccatcaacaaggaagatgatgagtctccggggcgtctactgggttgctgacatgtcat

SEQ ID NO: 674093 - DNA, 260 bp, Homo sapiens
  misc_feature (5)..(5): n is a, c, g, or t
  misc_feature (9)..(9): n is a, c, g, or t
  misc_feature (108)..(108): n is a, c, g, or t
  misc_feature (116)..(116): n is a, c, g, or t
  misc_feature (197)..(197): n is a, c, g, or t
  misc_feature (248)..(248): n is a, c, g, or t
ttggnctgnacaccaccatttcccccagattccagattctgctgagggaggttgttttcttgagagtagatccagagtgtcaaggatctgttagatcctggaattccntttttgcnatcccatccctccctggtagctaggtcccgatatactcctgtcttgtgagattgtcgagatgagatgggggaccactcttnctctgttccttcctctctcctttcctccatagcaaggacgaactttcctgntttcaatgccca

SEQ ID NO: 674094 - DNA, 1063 bp, Homo sapiens
  misc_feature (742)..(742): n is a, c, g, or t
ttttgctgtctagtcatcctcgtcggtcttctgcttcttggtattgaacatcgcatcctcgatcatcgtcagctcgcccgcatgacgcgtggctcgatcgcaccgcatctatatctccatcctccacctcagcatcacttgtttacactcgtgtctcatggtgcccactcaggcgatacatctacaagcggcgcgcccctcctgaccaacaggaattttaacatgatgaagcagatgaccatagcaaccaaggagcgcagaaaaaagagaatcagcacgacccctgggctagccagaacacttgcctttagacaaaaatagcaagccaggagcaaagaaaaaaagaaccgtgcaccgaagaaagacgcaagaaacggtgagaagacgcgaaacagcacctatgaaagcaagacaaaccgctggacgcagcgccagaagtaagacggcacaaacgcgcccatcatgagtaaccaggaagcatgagccacaatacaacaaaaccgagccgcctacggagaagccaacagcgacaacgaagaaaggtcgcggagcggaagcacagtagagcgactgacagaagaaaggaactcatggcttaccccgtcggacaacatagaaaaacgacaggccgggacccccgaccaagtgagtaaagtctaaaatgaggactcacagaaacaactgtctacccaagcagtagcaggacgcaccagaacgaactaataacaaagaggagggagcnggccccaaacgaagtatctgcacgcagacactatcgagtacgacctaacaaagacagccacagtctcatctgcaaaaacatcgcagcaaaaaaaccgggctgagaaaagctaggggattatccccccgtagacaaacacaagggagcaagggggagaacacaactatacgcgcgaggaacaaccccagggggaggggagcccccatcaaagacccgaactactcaacacgccaggcgaaacgccggcccataccaaaaacaagggacacactagcactcaagagacacaccacaagacacgacacaagcgacacactacac

SEQ ID NO: 674095 - DNA, 115 bp, Homo sapiens
ctttcaaatgaaagtctcatgcagtgcttctgtgcctgactgatcatgacagcagcatttcaacccccaggggacttgcatcagccagcatgcactcatacgtcccactctatat

SEQ ID NO: 674096 - DNA, 562 bp, Homo sapiens
gtataatctggtaagatgcaactacttatccacagaaaaggaggttgaggtaagaagatccctggagcctaagagttctagtctagacctgggcaacctagtgagatgaacatccacagaaaaacccacttttacagcttatgtagagaataaaatttttagaagggccatagcattttcttttttaattactaagattctttgattcggacctacagtagaacactgggattactagtggctatacgttgttcattttcttcccaattgtagggctttgtcagcagaacatgcaattaagctcaaagtggaaaggtgggccatgtaatagccagactgttcatcaacaagacaagaaatttatcttgtcaaaagtgtgtctttgcacgtaagataaccataaaacagactgagcactgatattgactagatgctttacaataagcagaaggggcagagagtttcaatatttagattagttcacaatgttagcttaatagtagtgtgccattgatggagcattcctggaacatgtcttctctgcttgtttaaacagctgacc

SEQ ID NO: 674097 - DNA, 349 bp, Homo sapiens
  misc_feature (337)..(337): n is a, c, g, or t
  misc_feature (342)..(342): n is a, c, g, or t
ctggatctactggttgaaaaccctggtcttttctaggtgcatgggttccagcagtacttgagataaaataggtgatctcaaatagtggttctttgctaactcatgccaagctggccctcctgccaaggcaagcaaggtaggccatggcaatagtatcagttagggaccgtgtgatggctcacgtctgtaatcccacactctgggaggccgggatgggtggatcgcttgagcccaggaagttcgggaccagcccgggctacatggccgaacccggtcctctacaaaaagtacaaaaatagccaggcgtgcttgcttgtagtcccagctacttgggaanttgangttggga

SEQ ID NO: 674098 - DNA, 251 bp, Homo sapiens
aaccaaataaaaagtcagacctatgattctatctagaaacacagcgatcaccaggtccggtaggtaagtcgcctgtacctataaatcttcccactgatttagatacatagacgggtgtgctctttatagctgtgcttagagtagctcgtctggtttcgggggtcttagctttggctctctctgcaaagttatttctagttaattcattatgcagaaggtataggggttagtccttgctatattatgcttgg

SEQ ID NO: 674099 - DNA, 1856 bp, Homo sapiens
gggttttcctcttaaaaaaaaaaaaaaaaaaaaaaaaaaaaaaaaaaaaaaaaaaaaaataaaaaaaaaagggtgggggcgcggctgaagaaatgatttcctggagaggggggaggcgatagttgtaggggtcataacagcgtttgtttatggtgacaaaggggggcccactaatggagcggaggcgtgtatatatataagagatagagagcggggacgggggtgtctaatagaagacgacttgaccgactgtgaggaagaaacgtgggaacgttggggagaccttgtgtggcgaagaggggacacactgtttatattgtcggggggggggggagagaggacacatattgtggtggcaacagagaatttcactctttgagagagggatatatttcaaacgcgctctcataagaagggagagaaaaacaatatatgataaagaatgttctgtagcagagaggggatgctactaaatgagggggggtgatgatcagaacaaaattaacacgcgcgagcgaaatgatgatctggccgcgcgaggagagagcatgaaagaaaaaaatatatgtgcgcggccaaaaaagtgtgtggagatacatgtgacgacattgtgtgaagtgagaccaaatatttgtatactcatagagcggaggggagaggagggaaaacatctgcgctcggtgtataaaataaaaaacaaagtggttggcaagagatggggtttctttggaacgacaacaagggtaagttagaagagcgaaactgttttgggtttggtataaaggacggaattctttgggcaagaaaagcagacccaacaacggggggggattttgggccacaacccgagggaggaggtacttgagaaagcacaaaagggacattcaagggcaaaatttgagccaacacagagatggacacccacacatgagaacggagagacaacaacgccactagagttacattgaggaacaggagcagcatcaacagcatccgacgccacaacaaacgaccacgaggacttaggagagcatccaccggggaaacacgctgtctgaaaaacaaccaagcacacgagaagaacaacacctataaacacgaggaggtggccaccaaaagaacaacatctggggacgaacaacgagggagggctacccaaagacacaaaggagcgaaaaacggttggggacaaggacccccgaagcaggagttagcagatcagcattccgaagtaagacacaaagaggggatgataagtcgagccaccacggacccacatagtgtgagccacccaccaaacagtgtgagagacgaacaattacacagcgattattcatgtgggaggtcccaaaattcgaggagaggtgacatcacccagaaaggttggggtgaaacaatatttacaccttgtgacacagtcaaacacgtgatttgagtgcgaataaataacgtttgagtgtgtcaaagtgtttgagccagctattaaaaacaccacttagaaggagaagcattattgagatcagttggagataacttacgacagtggttggtagccaccacagagggagtgagaaaaagaagaaaagaccgggccaagttagacccacaccagtaatcccacaaagaagaagagtccaccgaagacacaagacagcgaagcaaaaagagccagcgtcaacacacgagccaaaggaacagagcggtgagtgctgtgagcgaccccagaacaaaggcagcgcggagagaaagttggagaggagacaccaacaaaaacagctggagcgagtcaagacgcagaaaaaaaagccgcacggtcgcgacagcaagaagcactagacagcaaagagggatgcgag

SEQ ID NO: 674100 - DNA, 409 bp, Homo sapiens
tctgtctgtgctgtggtgtgctgtgctgttctgtctgtgctgtgctgtgctgttctgtctctgctatgctgtgctgtctctgctgtgctgtgctctgctgtgctgtctgtgttgtgctttgctgtctgtgctgtactgtctgtgctgtctgtgctgtgctgtctgtgctgtgctgtgctctactgtatgtgctgtctgtgctgtgctgtatgtgctgtctatgctgtgctgtgttgtgctgtgctgtgctgtctatgctgtgctgtctgtgctgtgctgtctgtgctgtgctgtctgtgctttgctgtgctgtctgtgttgtgctgtctgtgctgtgctgtgctgtctgtgctgtgctgtgctgtactgtgcgtcgacccgcccgcgaatttagtagtagtagtagacc

SEQ ID NO: 674101 - DNA, 139 bp, Homo sapiens
ccacaaggtcatactgttttcataataacactacatttataccaatagtaccaaaagaatagtgagtaaaactactgttgctgtagaatgaagcaaggcagtgatagtccttgtactctccatggccacgaacttggag

SEQ ID NO: 674102 - DNA, 214 bp, Homo sapiens
gtcgggctgcaaagtgtcacatacttgtctgtccttttatatgaaatttccagaacaggccatctgaagagatgtatagtggacttggtggcttcagcagctgtggggaggtgggactgagagagcgactgctaatcaggatggggtttcctcctgggaatggtaaaaatgttccggacctagatagtgatgaaggtagcacgacactgtgagt

SEQ ID NO: 674103 - DNA, 472 bp, Homo sapiens
caaaactacagtgtgagaacctgactcagggggatctaaaaacaggtccagcttctttgttctttccgctgaacaactcttcttattttgacctcaggctagagataactacttgttatctaatccaaggaaccatgttaattagaattgctgttttagtttttatcctccttgcgtgggggagaaaatcagatgttttggtttaacctttttgagggctatgggaataaaagtaagcaataacaatagtttacaagcacttattatgtactaggtgcagtgctaagccctattactctactttctcttttgggccatttaccaactctgtgaggttggttattattccatattacagatgagaaaattaggcatagaagttgggtagcttgctcaatgtttggctaggaagtgttatagtcagaattcaaacccagatctttttaatgtttaagcttcttatttttaccag

SEQ ID NO: 674104 - DNA, 889 bp, Homo sapiens
  misc_feature (734)..(734): n is a, c, g, or t
  misc_feature (736)..(736): n is a, c, g, or t
  misc_feature (739)..(739): n is a, c, g, or t
  misc_feature (742)..(742): n is a, c, g, or t
  misc_feature (744)..(744): n is a, c, g, or t
  misc_feature (754)..(754): n is a, c, g, or t
  misc_feature (757)..(759): n is a, c, g, or t
  misc_feature (763)..(764): n is a, c, g, or t
  misc_feature (767)..(767): n is a, c, g, or t
  misc_feature (769)..(769): n is a, c, g, or t
  misc_feature (781)..(781): n is a, c, g, or t
  misc_feature (785)..(785): n is a, c, g, or t
  misc_feature (793)..(793): n is a, c, g, or t
  misc_feature (798)..(799): n is a, c, g, or t
cggggcgcgcgccgaaggggccccagcggccgtcggcgccgacggtcttgcggtgcacgggctcgccgagccgccggcccgtggccggatcgaccgtgtagaccaacacctgcgcgccggccagcgactggttctccgcgccgatcgcgcggccgtcgagcaccacgttggcctcgcgaatgatctccaggctgcgtggcgcctcgcccgtgaggaactgccaggtcgccgcgaaggccgcgggcgagaacgaggtctcgcggtggtccacgcgcggcagcacgatgttggtcgcgcccttgagcgccgggccgtcgaagccgatgttcgtcggcttgccgggcgagccgacccacaggccgtcgggctgggcgaacttgtcgttgttgtccgagcgcagcgtgagccacttcacgccgggcgtcacctcgtcgccgttcgggcccttgggcgcgttgagctgccgcatgaagggcgacagccccgagaactcgttgttctcgcgcaggcccggcacggcccagatgccgtgcgccggattgccgccgagcaccacgtggctgacgatggccgcgccgccgccgttctgcacgtagttgcggatggtgttgccgccgcgcgagttgccgatcagcacgaccctggccgcgccggtggcgcgcagaactgctcgaccggtccttgaggaaggcggccgattcggccgtggagctgcgcccggcctgggccacgcngncgncgncngcgcgcccanggnnngggnnggncnaacggaacagcngtcnggcggcanccgtnngatcgaagcccagaagtggcgccaagcacggacaataccgttggcggccgaaacaagcggcggcacacaccacgcatgggcgccacataa

SEQ ID NO: 674105 - DNA, 264 bp, Homo sapiens
ctctggttcctccagtagtactacttcccggtctttctttaccatacaaaaaatagctttcccctaaaccaacacagtaagcaaactttaaaaaactgaggtcctattacaaaccaacgcccagcactaactgctttaaaattactgcataattagatttagttgaatttcaccattaattaggcagccgcactgcagggagcctttgaaatctgagaaaatgggaaaaatcatctgagccacgttttttaagcccaacttcat

SEQ ID NO: 674106 - DNA, 568 bp, Homo sapiens
gtgaacaggaaattaatgtttaaaactaacataaaaaatataacaccctctcttaaatcccacaccacctctaaagcctgcaactcactcctcaggcagaatttcttcctcagggaaacccctaactctggtctttaagcctataaaacaaacaagacaatccttcccccgatcccttccaaaacgcctcccccccccaaaaacaaaaaccaagcccaattaaatcaacaaaaaccttcccagcaaccacctcactaccggccacaaacaaaaaagcgacacccacactaaataaattcccccccccatatactacaatcttcctaacaagtaaccccctaaacaaccaaacaaccacccccccacacaacctccacaaacccccccgacaaaccaactctcgctctccttacctaaatcccacccccccataaatatcactctgcccctccctcaaatcaacacgtaccaaaatgaaaccccccctcaaacctacccccatacataactccaaccccctcttactactccccccggaaaaccagcaacaccctcacaacgggacacg

SEQ ID NO: 674107 - DNA, 1419 bp, Homo sapiens
  misc_feature (523)..(523): n is a, c, g, or t
tgttcactttcatgccaattctttatttccataataaaaaatcttttatttccacctttaggggtcccctggtaaaataagatggaccacaaaacccaggccaaaaacgtgttctgggtctggccgggaacatgtccaggaggcactggtcctggcatggctggggagaatgtcgccctggatctcgggagagagaagggcgaccacgcgcaggtgggtatatcagtcctggccgcaatgtaaccggggctggtttctccaaactattggtgagcacttgggctaacatggaggtggggagataacctgggttcgcatgtgggcgaatctctccaagatattcctcttctgtgcggcaaaagggaacgcgcgtgagactttatgtgggggtgtggtcctctgtggcgcgagtgatgaagatctcgccgctttgttaatgtctcccacaggaacaaactctctccgatgcggggagagcggtggtcacgagtctcctgtgggagcacatctgcgcgagaaacanatttttcgccaaagatggggaggcctctctcgacaaacacagcgttttatatatataacggggggggttaggtgggagctcgcgagaaaccgccagagatggggggctcaccgtgtgctacataagccgaagaacttttgtctgcgtgcgtcgtaccctgcaatcacgagagtaggacacacatttccaagagacggggggggcgactccccgggggtgtgaatacaacccgcgtggacaaacccgcgctatacgcggtgggctcccaaaatacaggcgggcccgcgtggacaacaagaagggggggacttcaccaggggaataaagcgtcactttaaaacaaccccaagggtcgcgtccaaaacacgtggggcgtgtggccccaaagctgttgacagggtgtagcagtttccacatcttccccaagggggtggcccgccgaaaaatcttcgtggttgatattaccccacgagaaggtttgatctacggctgtggtcccaacccaccagaaattccacaacttccacacatatacagggggaggcgccccctggtgttgtggcgtgcacatgaattagcaggggtgtgtctccacacaacgggggccaccaaggcgccggaggagaggggggccacaagggagaaattggggggagtaggcagaagcaacacaacctctcaaacgatgtgtacgccaggaagaaatccacaggcgggcgacgacgaagacacctgtggaacaagcaacacacaaccaaagccggcggggggggagacggatggcccctaggaacgcaagatcccacaccacgagagcggggcgagcgagaaaacgaagtgagaaaacacgatggacagcgcgccagccgccgcctagactgcacacccactgtgca

SEQ ID NO: 674108 - DNA, 440 bp, Homo sapiens
agcgtagggtaggcgagatcttaaattacctccttctctggcccacagtccggggaatgcgtatgctggcgctacgattggctacaccagcagaaaagtcgttgatgttggaggtttcatggaatccagttagacgtcgggcattgtccaggcctcccttgggatcataggcacgggattggtactggtgccgcttgcttagtttctcaatggcctcctcgatgttcctagagtaaacagaaatggtggcagtccaaccttgtctccaggtatggagccaagaatggagtgcaccaaaatatgataccagtagaacaaatacttcatgagggcagttggtgcaacttcttacctgtgttgtctcagtggtgagaactgtgcccgacaagcagtacaaagttgctgtttgttgaaaagattaatcctttgaaactttctcc

SEQ ID NO: 674109 - DNA, 770 bp, Homo sapiens
ggagtctccttctgtcactcaagctggagtgcagtggcgtgatcttggcccactgcaacctctgtctcccgggttcaagtgattctcctgcctcagcctcctgagtagctggaactacaggcacgcaccaccacgcctggctagtttttgtattattagtagagatggggtttcaccatattgaccaggctggtctcaaactcctgacctcatgatccacccaccttggcctcccaaaatgttggtattacagttgtgagccgccacgcctggccctaaatgttttcttaaattaaacacttataaatcttccagatatcaccttttgtcaaaattcaataattatgaatggaccttactatactgatgctttcttactaagctcctctctaccctgaatgcaagagaccctcatagttaggcaagaatatcatcaccccattcaacctgaaaaagctacagaagatggatcgacatccctctgcaaccctcaggattaaggattgtttgataaaagggagagggaaatgtgagagacatgtgaaccaaagcatctccatcttaaataacagctgggtaaaatgaggctgaaagctactggactgcattcccacacggatgacgtactgtaaggcgtgaagtgtcggcgacacacaggccataatgaccttgctgatcacacaggatggacgtcaggaaccaatcacacccaatatggtgacgagactgacctctgagcagctcactggtacgtaggatgggcgcgtgac

SEQ ID NO: 674110 - DNA, 288 bp, Homo sapiens
agtacacaggctcaagatggagacacaggctcaagatggataaagcagcagcactagtggaggtctgcaccttcctgcttttttacctatttagcttctaaaatttttcaacactgattttaagcaaggtctcgctcctgttgcccaggctggagtgcaatggcacgatctcagctcactgcaacctctggctcactgcaacctccacctcctgggttcaactgattctcgtgccttagcctcccgagtagctggggttacaggcacccaccatcttgagcctgtgtc

SEQ ID NO: 674111 - DNA, 852 bp, Homo sapiens
atgggaccctgtacacgtatcctgaaaactggagggccttcaaggctactcatacgctgctcagtacagcggggactcaggtccgcgtgctactccgacacacaccccactataccatttcggtccaaaccaaccgcacccctaggaattatactaccgacaaactttcctagccggcaaggtacccagacatatatgacgggtcgatagataggatatctagtagattgtattagaggagcaagcgaccataattgcacctaactaatgtagacgcaatgagagagctagcgagaggacacgataccatctccataaagggcaatgaaatgacacacacggttgggatgcaagttgcgtcgtgatagccattatgcaatggaattcccggatataatatgatggcgccacacaaggaacaaagcataacaccttgtgaggtgataaaccccacaaacacatattgagagcaaatcaattggccaaacaccaacaatatccacacacacaaggggaccccaaccatggaatgaaacacttgccatcaaaaggggaacgctggacacgcgttggacagcggaccgtcacaatatatcccctgaggaacggcgcactatggacagttgggagaaaacttgccattttcaccttaatgacatcaaggacaacggaacagggcacacgtatatcaacacgatagggagatgggagcgaccgaacacccagaaggattcaccctaacatatggggccttgggtcgcacatccaacaagaggatatggatacattaggcaaacacgccataggaacaacggatgggcgccctacactaaccttcacgccaaccgggag

SEQ ID NO: 674112 - DNA, 187 bp, Homo sapiens
ctggaccggatctgtgccatggtggataacaatgcctacgggaagctgaccctgcaggagtaccaggaggggtccaaggcatacccgcacattgtgcaggcgctgtacctcaacgacgggctggtataggcccaggctggagctggaggcatgggaaccgggtaccacactagatggaggatcaagc

SEQ ID NO: 674113 - DNA, 193 bp, Homo sapiens
ctactctggaggctggggcaggagaatcgcttgaacccagaaggcggaggttgctgtgagccgagattgcgccattgcactccaacctgagcaacaagagcaaaactccatctcaaaacaaaacaaaacaaaacaacaaaaaactcaataattatcagagaaaaacactgtaatataactatattgaaagaat

SEQ ID NO: 674114 - DNA, 467 bp, Homo sapiens
tgcagcggcatgtgcctgtctcttctggggtaggaatgttcttgatttaagcagcaaagagcagagggattataaaacgcaaaggtggccagtgtgcagtggctcatgcctataattccagcactttgggagtgccaaggtgggcggatcacaagctcaggagtttgagaccagcctgaccaacatggtaaaaccctgtccctactaaaaatacaaaaatcagctgggcgtggtggcaggcacctgtaatcccagctactcaggaggctgaggcaggagaattgcttgaacctgggaggaggaggtagcagtgagccgagatcacgccactgtactccagcctggatgacagagtgagactccatctcaaaaaaaaattataataactaacataaataaataaagcatctatccttcagccatttgctaagaagctgctgtattccaggcactgtactacgttaacg

SEQ ID NO: 674115 - DNA, 278 bp, Homo sapiens
  misc_feature (161)..(161): n is a, c, g, or t
  misc_feature (206)..(206): n is a, c, g, or t
ggaccggatgagatagcacggtgtcgtggagtttgtacggaaagagatatgacctatgcagttcgaaaactggataacactaagtttagatctcatgagggagaaactgcctacatccgggttaaagttgatgggcccagaagtccaagttatggaagatntcgatctcgaagccgtagtcgtagcagtttccggataacaatctnaacacaggagtcgcagtaacatcaccaaggaagaagtcagaggatcacgcctattctccccgtatagcctgt

SEQ ID NO: 674116 - DNA, 100 bp, Homo sapiens
aggagagctccaattggatcttcagcaggtgatgccatctggtccagggtctctcttgtcttgcactgtggactttcagcactggagaattctttgcctt

SEQ ID NO: 674117 - DNA, 767 bp, Homo sapiens
ggtccctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagctgggaactccatcacgtggaaaaactagatcctgtgggttatagcattggtgagttctccacgtctggtctctctcgctcatgtaatatactctgaccctgagtggaaaggggttttggtcctggtataattttacctacattgtactagtacactgaagctaaatagtacatgtagggtgctatggaaatactgaaaagaaacggggattccagaagaaaatggtaaccaaattcatacttggtctaacttttggatatcatgatcacaggtgattcacacgtaccacacataaacacacccaccagtgcagcctgaagtaactcccacagaaagcatcaatcgtcttggtacatcgtatgtacaaggcaatcaatttcatactttaaactgggtcaaaaaacctaattggggattgctaagtctggcaaagctgtatgtagttagatgatggtgacaaccttctaagtattaatctaaattagatatggtattccacactgaaaaccctgtatattagggtggtacatggtgggtaattgaggaatttaaaggatccaaattgattgggagta

SEQ ID NO: 674118 - DNA, 479 bp, Homo sapiens
  misc_feature (362)..(362): n is a, c, g, or t
  misc_feature (407)..(407): n is a, c, g, or t
ggaccggatgagatagcacggtgtcgtggagtttgtacggaaagagatatgacctatgcagttcgaaaactggataacactaagtttagatctcatgaggtaggttatacacgtattattttctttgaccagaattggatacagtggtcttaacagtggaatttcaaggtaaggattcaggcaagctcgtccaagtaaattgccagatttctggttttagttacattgtattcattcagcatgtgctgaagatagatgtaagcttagatctttctatggatacttctgtctatccgattgtgggagactactttcatacaggttaaagttgatgggcccagaagtccaagttatggaagatntcgatctcgaagccgtagtcgtagcagtttccggataacaatctnaacacaggagtcgcagtaacatcaccaaggaagaagtcagaggatcacgcctattctccccgtatagcctgt

SEQ ID NO: 674119 - DNA, 175 bp, Homo sapiens
cacacacgcaggacaggagacagagagaagagaacgtacgagagtcatctgattagtccatgcatggggatcctgcgcccgcatttgccccggtagctgcttcggatccacgaggtctgggggactcgggtgtctgagcatacagtactagcgataaccccctcgttcactaaca

SEQ ID NO: 674120 - DNA, 444 bp, Homo sapiens
taatctgtacttgcgtgctactgtctcccaaagtgtgtcttccctccagatctataaagcctgcttctccttccattcctcctcatctccagttttagcacccccataactttctgagaatggttcccgctatctggcagacacatcctatttctgtctgtgcttaatagaccctttgaatgttgcaaggtcacgcccaaagctattctcctttcatgcaccgtctctgaattctagagaaaagcgaatttgtctaccgtaatactcccattgcatttatagtccaatatcatacagttgtgcattatgattattccctaggtaggtttctccgttgtatagtgtagttcacctcaagagaaacataaacattgtaatctacaaatttctttagtaattctgtttattccctgctccttgcgtacagattagggtaccgagctc

SEQ ID NO: 674121 - DNA, 254 bp, Homo sapiens
gaaaaaaaaaaaaaaggaggaaaaatttttttatttcaaaaaattgtcacccacatgtggaaaaaaacatttttatcctggcggtattttttcaaatgggaaagggttaaaaaatttaaaagtccaaggggtttccgggagagggtagttttttgccaaaattggccccaccaaactttttgtttttttccaaaaacattttttccatttttagggaactgcttttaaatttttccttttttaaaaccttttcc

SEQ ID NO: 674122 - DNA, 241 bp, Homo sapiens
aaattgtcaggcagttagtatgagcctgtccggtacagtcccacatttatatagacctcatgagcttcatgtcatggcagcatgagtcaaagcagagtatggagcttgcagcggtccctcataagtgtcaccattgcaccacattgaccctggcatgtgcatctaagattccatgaacagcatgtatcctcgatagttctagctcactttagcacaaatacagtaaatgtgagcatttgcg

SEQ ID NO: 674123 - DNA, 116 bp, Homo sapiens
gttctatttatatagggcaggtagtagagaaagaactatcctacaagtatttcgtgtttactgttttaacactaaagatatcgattgtaaaagtttcagttgaacagtgagaagag

SEQ ID NO: 674124 - DNA, 357 bp, Homo sapiens
atagcatgatttggaagacacacacacacacacacacacacacacactgttttttttttgggcaggcagggtaagccgtccttctaaggtgtggctgtgtatccgttagggatgtaaagctgggggcccctttctgtattggtgtcagtggccgtggatgaccattgctcagagccattatttcatttggggtgtacaaaaattgtgctgttgtaattctgtccacctcttcatttattagtgggactattcctctagagagaacctgcccctcatctattattcagttatcctgagggtactggctcttttgaacttgtgtttgccttagaaatgactattgaaccggatagcttg

SEQ ID NO: 674125 - DNA, 111 bp, Homo sapiens
  misc_feature (103)..(103): n is a, c, g, or t
cggctatctgtgacagctgctagccaaacagaatctggttatgaagttatctcttgagaatggcttgattctctatgccaccaacagtattagtctgggcagngttccctg

SEQ ID NO: 674126 - DNA, 649 bp, Homo sapiens
taaggattcaggctccgtcctaacgaggccgtggctgaggctcaggccccccgccctccctctcagccacagcgtactcccagcccgagctggacgccaccttggacaggttttccacttcctaaggacgagccccagactgaggagaggtccgaggaggtgggcgtggatctttggaggaccctggcggctggcccgggggaggcgggccgatggctgtgctggcggcgcgtgtgcgggggctgacatggcggagtggagctggacctatcggatggtggagctgagccccgtgggctcggaggagccccgctgcctgtccccggggaggcgcgccctcgctaggggcccgacggctggccgggtggccggatcctggtactgcgagccaagggcggaggcccaaggaggaagattgggacaatcggtcaagtgaaaggagcaagctaggattgggtggaaggcaggaactgatgaagcaaggttacacacggtgatgaatagcgagagggggggtcagcgcagggtgctccagcgagagctagagaatgtaaaggctagatggcccattggccaggtgccgcgtagaacggcgccatgaaaaaacaatcccgcaaagtaatcggacatgaaaaagccttcatggagg

SEQ ID NO: 674127 - DNA, 663 bp, Homo sapiens
gtcaagtgactgtgtcctgtggtggagaaggacgttccgtgccgctgggttctgagccggagtggtcgctgcctgggatggaggcgaccttgtagcagcacttgaaagacacaatgaagaatccctccattgctgaagtcctgagcacagattcacaaggacttaatctgcgttgccgcgggaccttgtcagatgagcatgctgtagtgatatctgctatagcccagcaagcagctaagctaacctctgaccccactgatactcctgtgtcgtgctagaatcacatattgccaaccttatgacccagcatcaccgtgccatcactgtggcagtccaccgccctctttgatgctcatatctggccttcagcagcctgcctacgcatctgtacccctactaagctaatccccttaccgcacccctatcccctcaacctcctagcccactaacttaatggcccattcaccacttctctcgtcatccccgcctcaccccccttccacccctccacctccgcacttcgcccctacccaccaccgcctcaactctccaattcaccctcctcttcggccttcctccactaccaccctcccccttctcctcctcatatctctccctctccacacccacatccttcctcccactctgcctcacacccctcct

SEQ ID NO: 674128 - DNA, 1166 bp, Homo sapiens
cagcggcgggaggcaattaagcgtagtagaggctgtgtgttaattcggccgagggcggtgcagaggaggtcagctgcgggagctgtttcctggggactggtgcctgccatgagattgaccccgcgcgcgctgtgcagctgcctgcccagtgcctgcctgtgcgtggatgaacttccccctgttgctggtctgcgactgtggctgctgctgtgttccctgtggccacatggccaatggtgtgctgaaggaaggatgcatgatgcatgcctgaatgcttggtggacttgtagtcatctgatgggtccagctgagtgcccgtgatcccagctttcatgtgcctgcaacccttcttgtttcaggtgaaagccccttgtgcgcttaagtgcctcgacttggctgtgtcgctcagacaaggattgggactttgtgcggtgatcttacatgatgcaggcagacagaagttagttgcagacactttaaggaatgtgacgaagtgtgcctagaagaacattgtcaatttattaaccgaagcttgtggttaacacgggatcggagacaattgtcgacaggcgagcattcattccctggatcgggtcaacttggacacttgatctgggcgagcagagcccaacactggcattaagccaacgctggagacacaggaggcaaccctttgcgcatcgtaacgtcgtaagttcagttgggtccattttggcggtgtccacgcaaagctggttgggtgcaaagggtccagtcgcctacagttcaaagcttccgcgtccggtgatgggcatgcacccgtacaggggacacagggcgcaaagggccccacgcaagggtgcttggggctgggccggaggcccttggggcattcaacccaggaggccttggtgcattgttcccaaaaatttcaggggttcctcgttgaagcgggccccccctgcagttgctgccgtgattcggtggaccaacttcccttgggccgttgcctggcttcccttcggggctttggaccggttgtggcgacgaccatggtgccttgaaaggccttgggccccgtgtggtggaaaccgtgtgcctggacccaccgtgggtcggcgccaccgcagacccattgggttgactaaccttgctgtagagccccttcaaccagagcatccagcgga

SEQ ID NO: 674129 - DNA, 675 bp, Homo sapiens
gcgcacgaaatatttattaatgcggtggtgggttgacagagctaacataccaaaccaagatgaattgccacttgggccgaaagcacatcattctacattataacccactggtttctgctagcacattgggcaagcaagttgctcagtctgtaagggagcatctcaaaagatccacgctacatatcactttgctcctaagtacctaatcctctgcttactgcccgtctgaggcctggtcaccagcagacaagaggcaactaaggggggtggaggtcgggatagagcttattgaccaaaccggtgacactggcttcatttatcaatgccccccagctgtaataactgaaacgcctactgactggtgaacgccttagccaactgcatttttatacatggtgcgctacgccctagaaaaagaccaaaggtttgatactacctcaacaacgcagaatccccagaatgtatgcttaattcataaaccccacccctggggagaagtgccgccggaggccctttatacgccataaccgaccgggttgcagggatagacttcaggtgccttggttccccaagcgggggaaactactactggcttggcccacggcgccagacaactggctggcgccaaaaaaaaatattgtattttttgtgtgacggagtttcacacgattttgg

SEQ ID NO: 674130 - DNA, 1957 bp, Homo sapiens
  misc_feature (1483)..(1483): n is a, c, g, or t
tgtgggcgctttagtgcctccgtgtcagctccactgaggaaggagctggacccctgctcctctcagctgcgctctgttctcccgatgaggcttgactggacgggcgagcagttcagcaagaactcaaaacaacgggcacagctctcacacggattccagtactcactgaacacggctcagcacataaaaagcacagagtcttgttgaatgccactgggagacaaagccggggagggaggtgcaggcagtttatagaggttccagaaagggaagtggttggcaacggtttgtccttttacgtgcttgacacccaatgaccacagcaggcctgtggccagcggggacacagtccacaagtgggggtttttaacagcttgttcttaagagacgcgttcccataaccacagagtaactgagcactcaggtgtctcaggcccacggaggatttaatagatgaaaccctggatcgtcgtcgaagccgtggttgttaagaagctttaaatatattgaccggaaaacggggagaaaccagagggtggaagagccgctcgcactgcggtgcgatccctgagggctcggggcagggactggggaccgagcaggagctggcggggtgagctctgcgaagcgggcgtgagaccgagcgcccatgggccggtcactgccgggtgcccgctcaccccccgacgccagcaggagcgcgcgcgcaggccccgcggggccgggagggcggcacgggcggggcccccgtgctctcaccgccccggggtgtggttcccgcggacaggccgggcggggcggcgggtttaaggcgccggccggcccgacacggctcactcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgaaaccctgtcctcatctggaacaaggtaaaaaggggtcactatggagttcagnggacagaactcttgcctggtgaccgggaaaatctggccattcagacccggggtggtccagaaaagcatgaagtaacgggctgggtgctggtatctcctctaagtaaggaggacgctggagagtatgagtgccacgcatccaactcccaagggcaggcttccgcggcagccaaaattacagtggttgatgccctccatgaaataccactggaaaaaaggtgaaggtgctcagttataacctgcgaatccatgagcctctgtagctaaaggtgctctcagacagccgacagctataaccctgctcttgcctgacacacttctcttaacctaacccactaacactttattacagccagctggttttacacagagaaatcaaagataacacatcaagactatctacaaaaatttattatttacagaaaaaagcacatgtagctttaaacaaaacaaataaaattcttatcacaacagt

SEQ ID NO: 674131 - DNA, 187 bp, Homo sapiens
cagtgagccaagatcacgccactgcagtcagcctgggcgacagactgagactccatatcaaggaaaaaaaaagctctgcttactattgtgaatatttccaaccactagaagtataagcatccatattctcatcacctggaatttgacagttcacaatctaatctatgcggatgactggtcaccttgt

SEQ ID NO: 674132 - DNA, 1158 bp, Homo sapiens
  misc_feature (684)..(684): n is a, c, g, or t
aagagtcgtatcaacgcagagtggcattacggccggggactcgcgccttgccgtgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgaaaccctgtcctcatctggaacaaggtaaaaaggggtcactatggagttcagnggacagaactcttgcctggtgaccgggaaaatctggccattcagacccggggtggtccagaaaagcatgaagtaacgggctgggtgctggtatctcctctaagtaaggaggacgctggagagtatgagtgccacgcatccaactcccaagggcaggcttccgcggcagccaaaattacagtggttgatgccctccatgaaataccactggaaaaaaggtgaaggtgctcagttataacctgcgaatccatgagcctctgtagctaaaggtgctctcagacagccgacagctataaccctgctcttgcctgacacacttctcttaacctaacccactaacactttattacagccagctggttttacacagagaaatcaaagataacacatcaagactatctacaaaaatttattatttacagaaaaaagcacatgtagctttaaacaaaacaaataaaattcttatcacaacagt

SEQ ID NO: 674133 - DNA, 907 bp, Homo sapiens
ggtagcgcgaggctatcagtgtggactgcaatgagctattcctgacggcagtccccccggcactccccgcaggcacacataccctgctcctgcatgagcaacagcattgtccgtgtggaccagagtgagctgggttatctggccaatctcacagagcatggacctgtcccagaacagcgttttcggatgcccgagactgtgatttccatgccctgtccccagtctgctgagacctgcacctagaggagaaccagctgagccggctggatggaccactagtcgtttgcagggctggtcagtctacaggaactctatctcaagccagtaatccagctctaccgcatcgctccccagggcctttttctggcctcaggcaacgttgctgcggcttgactctcaactccaaccgtcctgagggccacttgacatgccgctggtttgaaatgctgcccaagttggagatactcatgattggcggcaacaaggtagatgccatcctggacatgaagcttccggcccctggcaactgcgtagccttggtgctagcaggcatgaacctgcgggagatctccgactatgccctgtgaggggcttgcaaagcctggagagcctctccttctatgacaaccagctggcccgggttgccaggcgggcactggaacaggtgccgggctcaagttctagactcaacaagaacccgctccagcgggtagggcgggggactttgccaacatgcttgaaccttacggagttgggactgagcaacgttgagggagctggtcttcatcgacaagtttggcctgttgaacctcccgagttgaccaagttggacatcaccaatacccaaggtgtcttcattcaccccgggccttccaccactggcccagatgagaccttctgtcaacac

SEQ ID NO: 674134 - DNA, 236 bp, Homo sapiens
gactagaggatccctgatccttaaaacactttgttggctgttctcaggtagaactcagtacgtctggtagcctccaggatgccgcttagattattaaacaacatgtcagtggttggaagagtcaaatgttatttttgatttttctggtatggtttcggttttaaactgcatgttggcggataacttgccgctttctattcatctcccatacatgacattcaaagtggcatgcaaac

SEQ ID NO: 674135 - DNA, 1609 bp, Homo sapiens
tgtgggcgctttagtgcctccgtgtcagctccactgaggaaggagctggacccctgctcctctcagctgcgctctgttctcccgatgaggcttgactggacgggcgagcagttcagcaagaactcaaaacaacgggcacagctctcacacggattccagtactcactgaacacggctcagcacataaaaagcacagagtcttgttgaatgccactgggagacaaagccggggagggaggtgcaggcagtttatagaggttccagaaagggaagtggttggcaacggtttgtccttttacgtgcttgacacccaatgaccacagcaggcctgtggccagcggggacacagtccacaagtgggggtttttaacagcttgttcttaagagacgcgttcccataaccacagagtaactgagcactcaggtgtctcaggcccacggaggatttaatagatgaaaccctggatcgtcgtcgaagccgtggttgttaagaagctttaaatatattgaccggaaaacggggagaaaccagagggtggaagagccgctcgcactgcggtgcgatccctgagggctcggggcagggactggggaccgagcaggagctggcggggtgagctctgcgaagcgggcgtgagaccgagcgcccatgggccggtcactgccgggtgcccgctcaccccccgacgccagcaggagcgcgcgcgcaggccccgcggggccgggagggcggcacgggcggggcccccgtgctctcaccgccccggggtgtggttcccgcggacaggccgggcggggcggcgggtttaaggcgccggccggcccgacacggctcactcgcgcccttgccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtgggcacagagcgcttccctctccaaccctgcgccggtcggcccagcgaagggcacatccgacggggcgtccgcggcggcctcgccccgggctgctcactgcgattcccccgggggcattcccaggagccagattgggaggggacaaccagttgcgcagaccgcgtgcactgcccacggagcctgatgtggccgacagccacccccttcatctattatctggccgcgatttacttatggacgaggtaagatgcgtttcggttcg

SEQ ID NO: 674136 - DNA, 1052 bp, Homo sapiens
  misc_feature (578)..(578): n is a, c, g, or t
gcctcttctagcgactggtatgagagcaggtggtaaggcttctagtggttgatggcccttgttgtccgtggagctccagaatcttcttgtcatccttttgtaggtatattggtaggagtactcgaaattctcgggtgcacgttcctctttcagagtgttggatagccagaatacaacgcagagatccctatctcccgaagcccagttcagtagtcttctgctggctgcaataaccatccgtcctggcccaacaaagccggggtctctccagagtgggaaaagatagttgcgttcctgctaatctcaggcagcagcaccgcgtccacatccatttccacacgtgatccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgaaaccctgtcctcatctggaacaaggtaaaaaggggtcactatggagttcagnggacagaactcttgcctggtgaccgggaaaatctggccattcagacccggggtggtccagaaaagcatgaagtaacgggctgggtgctggtatctcctctaagtaaggaggacgctggagagtatgagtgccacgcatccaactcccaagggcaggcttccgcggcagccaaaattacagtggttgatgccctccatgaaataccactggaaaaaaggtgaaggtgctcagttataacctgcgaatccatgagcctctgtagctaaaggtgctctcagacagccgacagctataaccctgctcttgcctgacacacttctcttaacctaacccactaacactttattacagccagctggttttacacagagaaatcaaagataacacatcaagactatctacaaaaatttattatttacagaaaaaagcacatgtagctttaaacaaaacaaataaaattcttatcacaacagt

SEQ ID NO: 674137 - DNA, 435 bp, Homo sapiens
  misc_feature (371)..(371): n is a, c, g, or t
  misc_feature (413)..(413): n is a, c, g, or t
  misc_feature (423)..(423): n is a, c, g, or t
caaaaaattgggtgggcatgatggcactggcctgtagtctgagctcgggaggatcacttgagcccggggggttgaggctacagtgagccgtgattgcaccattgcactccagcccgggcaacagagcaagaccctgtctcaaaaaacaagaaaaatttggttctttttctttttttttgagacataatctcactctgttgcctaggctggagtgtaatggcacgatctcggctcactgcaacctccacctcctgggtttaagtgattctcctgcctcagcctcctgagtagctgggattacaggtacatgccaccatgcccagctaatttttgtatttttagtagagatggggtttcaccatgttggtcangctggtctcgaactcctgacctcgtgatccgcccacctcggnctctcaaagngctgggattaca

SEQ ID NO: 674138 - DNA, 641 bp, Homo sapiens
  misc_feature (74)..(74): n is a, c, g, or t
  misc_feature (283)..(283): n is a, c, g, or t
tattcgaataggagaccttaaacctacaggtgaaattcctaagcaggttaaagtgaaaaaactgaagaatctanagactctggattccaaacctggagtttatacttcatataagccatatttaaatagagatgaagagatcataaaacaattacagaagggtgtacaacagaaacgtccttctgaggctcaaagtgttattcttcgacgctattttttggaactgacacaaagtttcatcattccattagaaagatatgtggcaagcttgatgcctttgcanaaaagtatttccccatggaagagtccacctcaattaagacagtttcttccagaagaatttatgaaaacacttgagaaaacaggacctcagctaacctctagaataaaaggcgattggattggactttaccggcatttcctaaagtctccaaattttgatggctggtttaagacccggaggaaggaaatgacccaaaattggaggcactccatctagaagctctttgtgcacgaggacttacttctctggatacagaaaaacacagaagtagaaacagtagaccttgtcttgaagctgaactaataagctgttgcaggatgatcgagagcacttacatgtgaacgctgcacatatggca

SEQ ID NO: 674139 - DNA, 588 bp, Homo sapiens
  misc_feature (74)..(74): n is a, c, g, or t
  misc_feature (283)..(283): n is a, c, g, or t
tattcgaataggagaccttaaacctacaggtgaaattcctaagcaggttaaagtgaaaaaactgaagaatctanagactctggattccaaacctggagtttatacttcatataagccatatttaaatagagatgaagagatcataaaacaattacagaagggtgtacaacagaaacgtccttctgaggctcaaagtgttattcttcgacgctattttttggaactgacacaaagtttcatcattccattagaaagatatgtggcaagcttgatgcctttgcanaaaagtatttccccatggaagagtccacctcaattaagacagtttcttccagaagaatttatgaaaacacttgagaaaacaggacctcagctaacctctagaataaaaggcgattggattggactttaccggcatttcctaaagtctccaaattttgatggctggtttaagacccggaggaaggaaatgacccaaaattggaggcactccatctagaagctctttgtgaagaggttcgaaaactgtgtgtttgtgtaatgattaacaactgttgaaaataaagataattatgcttagaagttgaa

SEQ ID NO: 674140 - DNA, 926 bp, Homo sapiens
  misc_feature (398)..(398): n is a, c, g, or t
  misc_feature (556)..(556): n is a, c, g, or t
  misc_feature (572)..(572): n is a, c, g, or t
  misc_feature (660)..(660): n is a, c, g, or t
  misc_feature (759)..(759): n is a, c, g, or t
  misc_feature (799)..(799): n is a, c, g, or t
  misc_feature (802)..(802): n is a, c, g, or t
cttcaagatcgtttgagtgaccgagtcggagaccataaacgtctaaggtcgtgggtgacatagagaacggctgtgactacctcccttcctcagatggggagtggtgacaagcccctgttcggatccctggcacctttctaagtcgcatgatgcgttgtcgtatcacccgctgcgatgagcacacgcaaacccaggcctcattctacttcaccagtcgcaagcctctgattcaggctggagcagtcgagctcagggcgggactgacctatgatgcctggccctgcaggacatgtaccatgacctcatccgaacgctggagatcgtggcatagcccgctgctatcgttcattgacattatgaaagacactacatggcatatgtcactaccaagcattgtntttcacagcgtctagcgtgttgctacgaatagaatactaacgatcacttgttgccttgtcacttcctcacgaggcgttgccaaggtagaagttgtgactaagggccgagtatggggttatatgtaaatgaaatgattggatgccacaaggccctaggnactgccctgttgtggnacatgcgagtgtaggagtcgcgcgatccagtaagatgttgctaaggtatttgcaaggagtatcctaagactagtaagaattaggtggnctatttatctggacgtttctatccttccttcgctcctttccctgaatttcacaagaaacggaaatagcaattctacccgctaggcaaggtccctacccntgttaccgcatattatgtcttatcgtctaatagagtgccnganatcgagaaatagctggtccacttgttcttgatgacccccccagaaatccggggaacgtgagtcgttcatgcatgctggccctgagtttgtgagcgcgaaatcctaggctttaacgggaaggcaa

SEQ ID NO: 674141 - DNA, 413 bp, Homo sapiens
  misc_feature (173)..(173): n is a, c, g, or t
  misc_feature (242)..(242): n is a, c, g, or t
  misc_feature (275)..(275): n is a, c, g, or t
  misc_feature (286)..(286): n is a, c, g, or t
  misc_feature (334)..(334): n is a, c, g, or t
  misc_feature (350)..(350): n is a, c, g, or t
  misc_feature (388)..(388): n is a, c, g, or t
accagcctgggccacatagtaagatcctgtttctaccaaaaaaaaaaaaaaaaaaaaaaattagctgggtgtggtggtacatgcctgtggtcccagctactcaggaggctgaaatgggaggatcacttgagcctgggaggtcgaggctgcagtgagtcctaattgagccactncactccagcctgggacaacagaaagagaccatgtttcaaaaaaaataaatacaggttgtagtgggtatnggtatgcataccagggaggcccgacctcgtctnagaggggagtngtcagaaaagattttcttagggatttgatgttttttaatccactttantttaggtattattttntaccttaacccactgccatccctttttaagggattttnttttggcccagtttttaggttccta

SEQ ID NO: 674142 - DNA, 100 bp, Homo sapiens
atcccatgtgttcacccatgcttgctcgcagtttgctccatcaccaaatggttgcttaaccccaaatatctgagcagcaacttgagctgatccttctggc

SEQ ID NO: 674143 - DNA, 223 bp, Homo sapiens
aggtggcgcgtctcagactagcggacctttaggctttcgagctgctcctttatctctgcacacctgtgcccaccagcccggtgtgtgtgtgtgcttgtgtgtgtgtgagcgtgcgtgtgctcagtcaaccagacaggtgtgtgtgtgaacatgtatgtgcatgtgtgtctgagtgcgtcctcagggaggactcagcccaaccagcgaggtctgtttgtgtgcg

SEQ ID NO: 674144 - DNA, 1105 bp, Homo sapiens
  misc_feature (7)..(7): n is a, c, g, or t
  misc_feature (452)..(452): n is a, c, g, or t
  misc_feature (695)..(695): n is a, c, g, or t
  misc_feature (718)..(718): n is a, c, g, or t
tcccccncccaggagaagatacgagaggaaccggaaggagaaggaaaaagagacgaggcgggacgaccaaagagggtatgtggcgtacacagcagggtcacaacctcaaaacagccaggctttaagcccacacagtgggggggctccaccaatggcaaagccagctggcactcccccaggtgcccagggtgttcaatggggcttctcccccgctgcgcggaaaatatgggggaccacaaaatggtggcgccaacaccagaaaggggcaccgccccacggtcctaatgaagaacggtgtgtcaagggtactgcccggccgcccaggtgtccctggtccgcccctgtaggggcgccacacgtagtgtgtggaatggggcacccccccgacggttccccccaagggccccccttcctgcaggccagctgaacggtgtgtttttcctggaatgaangtatcccgctcagccaggcccccggcgttttctgaccccatccccgccgcgttcccctgagagcgtcttacgacgccccacttggcccttgtggccccaagctggcgtggcgttctcctggagcctccaccagagccccgggaggttccccgggagcccagccttcttttgtctttccaaacacaccaacgatggagagaacccctctcgtggtgggacccaccccggttatcttctcagccnccttggattggtggagattttcncagtccagcccctctcaggagggttgacatttcctcacacattggatgaagggacacatgatcccaccatcgccggacacacccaggtcgccccaggcgcgttaatggggatattctttcatcccgtgctcagatccccaccaaatattgaggaggcgtttaatccgagaccctgaagaagatgggcaccagcagacccttgatgataattccaccaccaccattccagggaccctgttttgatgtattataggccggaagatgtttttgctaccctggaaccccttacctagatccagccctccagccctgtccaactccagtttaccaggttaagggccgaagtgtttccagtgggtctccagtaaaggatcctttggggcccag

SEQ ID NO: 674145 - DNA, 366 bp, Homo sapiens
agcttaagataagatactcattggtccaaacacacgcatttagaggttacttcgtgactagcagagcatgaaattgacatgaggccggatgcggtggctcacgcctgtgatcccagcacttcgggaggccaaaatggcaggattgctttagcccacgagtgcaagaccagcctggccaagataataagatccccatctctataacgaaatcagagatcgtccatctaccaaataggaaataagactgtataagtcactctgaatattactgtaggccacctgaggagtcactctcaaatttcatctaatctaagacacttattaattggcacatatcacttattgtatatcttaagactggtcctg

SEQ ID NO: 674146 - DNA, 664 bp, Homo sapiens
  misc_feature (63)..(63): n is a, c, g, or t
  misc_feature (172)..(172): n is a, c, g, or t
acaacatttgagctgatttcaagaatgagcagtgatgacattagaagtaggggagtcatactnatggccagcagagacgaatagtcagcagcatacagactgtacgttacacaatgatgcacatacaggagaagggatttcatgtatgaaagtaccacaagcacctgtgttntgtgcctcagcatttctaaaatgaacgatatcctctctactactctctcttctgattctccaaacatcacttcacaaactgcagtcttctgttcagactataggcacacaccttatgtttatgcttccaaccaggattttaaaatcatgctacataaatccgttctgaataacctgcaactaaaaccctggcccactgcagattattgctacgcaatgcaacagctttaaaacctatctaggcccatgaatggaaaacaaatccaaatccgatccttgaaaagcaaaggctctaaagaagctcttcagaagagacggtaaagaatgaattcttttacttatcacccaaccacatttcttaaaaatgtgttttggtgtcttttcctaccaaatttctgctctacaaggcagtcagttaaatctctcatttcataattttcactgtgatagatccttgctctctcctcttttaataaatttaataaaactttaa

SEQ ID NO: 674147 - DNA, 136 bp, Homo sapiens
gggtgcgagataactcacttctcatggctcatgtgtctccagagtctcagatctgtggggcactgagtgggctctgggcttgggtctaggggctggccaactcatcaccacattcctcttctggctcatcctcctc

SEQ ID NO: 674148 - DNA, 883 bp, Homo sapiens
  misc_feature (37)..(37): n is a, c, g, or t
  misc_feature (110)..(110): n is a, c, g, or t
  misc_feature (122)..(122): n is a, c, g, or t
  misc_feature (124)..(124): n is a, c, g, or t
  misc_feature (135)..(135): n is a, c, g, or t
  misc_feature (137)..(137): n is a, c, g, or t
  misc_feature (142)..(145): n is a, c, g, or t
  misc_feature (147)..(147): n is a, c, g, or t
  misc_feature (157)..(157): n is a, c, g, or t
  misc_feature (164)..(165): n is a, c, g, or t
  misc_feature (190)..(190): n is a, c, g, or t
  misc_feature (204)..(204): n is a, c, g, or t
  misc_feature (212)..(212): n is a, c, g, or t
  misc_feature (224)..(224): n is a, c, g, or t
  misc_feature (241)..(243): n is a, c, g, or t
  misc_feature (261)..(261): n is a, c, g, or t
  misc_feature (267)..(272): n is a, c, g, or t
  misc_feature (282)..(284): n is a, c, g, or t
  misc_feature (292)..(293): n is a, c, g, or t
  misc_feature (300)..(300): n is a, c, g, or t
  misc_feature (302)..(308): n is a, c, g, or t
  misc_feature (333)..(333): n is a, c, g, or t
  misc_feature (336)..(336): n is a, c, g, or t
  misc_feature (339)..(340): n is a, c, g, or t
  misc_feature (347)..(347): n is a, c, g, or t
  misc_feature (353)..(353): n is a, c, g, or t
  misc_feature (356)..(356): n is a, c, g, or t
  misc_feature (359)..(359): n is a, c, g, or t
  misc_feature (361)..(361): n is a, c, g, or t
  misc_feature (379)..(379): n is a, c, g, or t
  misc_feature (388)..(388): n is a, c, g, or t
  misc_feature (398)..(398): n is a, c, g, or t
  misc_feature (404)..(404): n is a, c, g, or t
  misc_feature (417)..(417): n is a, c, g, or t
  misc_feature (422)..(422): n is a, c, g, or t
  misc_feature (445)..(445): n is a, c, g, or t
  misc_feature (551)..(551): n is a, c, g, or t
  misc_feature (590)..(590): n is a, c, g, or t
  misc_feature (763)..(763): n is a, c, g, or t
  misc_feature (853)..(853): n is a, c, g, or t
tttgtacacaggcaaactttactgtggaaactaaganatcaggagctctctccactcccctggccctccagggtggggtgaggagggagtagaccttgggggcagagganaggaggggagtnanagctgtaggangnggggnnnnangttggacggngcgaatnnacgttttctttaaaaaaaaaattanaaaaatctatttanacccgganaaaaaaaaaggnaagaagagacgggctgnnntgtttttatttacaaggnaaaaannnnnngagggggtcnnntttttttnngggtttngnnnnnnngagggggccaagggggtaggaggtnttnatnnccccaanaccctntcnttntnttccctccccaaaaccanttaaaatcntcttaaaaancccacnaaaggggtgaagntggtnagggagggactggaggtgggganagggactcatttacctctgccctctagtctaggggcccagccagggcaggagcttgatgggctatggccccccttcccagcccctcttggggctcccaaatggaantggaagggtgtttggtggggccctcaggaggagttattnagggtaggtgtggcatcggtcgactgccagtctgagctggtcggagtctcagttaaagctttttaggacggggtgagggtggtattgcccgctggggacctcaagtgaggagggatgagaatggcgttgagagacggttggatggagagttcaccagcactgaagttgaaganagggggaagtgggcggttgttaggcagctgggttcccagacatcgcagttcatcaaagaagctgtgcgcacaggcctctagtggggagancttgaggatggggtgtactccagcaggcta

SEQ ID NO: 674149 - DNA, 201 bp, Homo sapiens
ggacttcttaaaactttatttgggctgggtgcggtgtctcatgcctgtaatctcagcactttgggaggtccaggtgggcggacagcttgagcccaggagttcaagaccagcccaaataaagttttaagaaattacttggccaggcctagagagtcctttcgcgaaaaacatagcttttctatgagaagatgatcaatattt

SEQ ID NO: 674150 - DNA, 525 bp, Homo sapiens
actctgaggaccccaactcgacggacggcatacagagatcaacttcttcctggtttagtcttgggagagtgtatgtgtcgaggaatgtatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctattaattttgttgatcctttcaaaaaaccagctcctggattcattgattttttgaagggttttttgtgtctctatttcctccagttctgctctgattttagttatttcttgccttctgctagcttttgaatgtgttcgttcttgcttttctagttcttttaattgtgatgttagggtgtcaattttggatctttcctgctttctcttgtaggcatttagtgctataaatttccctctacacactgctttgaatgcgtccgtcgaagttg

SEQ ID NO: 674151 - DNA, 919 bp, Homo sapiens
gccaccgtgctgaagaccccacatgggacggccagaaacgcagactttgcccacctgcatgccctcgacccgagacccagacccagaacggcagctatgtgggccagcactcccagggaccatcgagcggccacatacagcggactcctacctgaagcggaagaggatttactaagatggctggcaccagagataactcaaagggccatgacaaccaaaatcagcattctgggagattctccctgactgctaatagatattatgatgctttattattctaaagccaatatatatctcgtcatattcgagataactagacagaaacctctcatgaaaagacgacacttataccatgacccaaaaatcaagcccgaggaagccaccccaagggacgcaccaccaaacggcgcgaatgcatgcggcgagaggaacgacatcctgcgacagagaccacgatcaacctctaaattgacttcatccctcgggcgcccatatggccaatccacacgacaaaacagggcccatggcaacaaacaccaccacaatgcaccaaaggaccacactcctcaccacccaaacgacacggcacgacggcgggccccccaccgggaacccgtggaccgataacaaaaccaccaaaccgcacaatacaccaacaaaaaacactactacacacgacaccacgtaaccagaacgatggccagaacacagcagaaccaactaccacaccaaacaaaagaaaaacccaacgccatggcacaactacaactacggccaatccccagcataaaccacaaaaagagaacacatacaaccgccccaacgaccccacctggcaaagacgaaagaaccaacataacaccccctacctcccgaaaacaagaaacaacaaacgaagggaaccaggcaccaacacatg

SEQ ID NO: 674152 - DNA, 120 bp, Homo sapiens
acactttttttgttgtttaattttttaaattttattttccataagttattggggtacaggtggtatttggttacatgagtaagttctttagtagtgacttctgagattttggtgcttaaa

SEQ ID NO: 674153 - DNA, 169 bp, Homo sapiens
  misc_feature (37)..(38): n is a, c, g, or t
  misc_feature (104)..(104): n is a, c, g, or t
  misc_feature (119)..(119): n is a, c, g, or t
  misc_feature (156)..(156): n is a, c, g, or t
attaatgtaacccatcatatcaacatactaaagaggnnaaaatcatgattgtattaataggtacaggaaaagcatttgacaaaatccaacactcattcaagatnaaagtgctcagtagntcaggtatgcatgtaatcccagcacttttggaggccnaggcaggaggatc

SEQ ID NO: 674154 - DNA, 1748 bp, Homo sapiens
acaaggagagggaaaagaaaccactaaattttgctttgtttccttgaacgaatgtggcaacactagtttttgtgattttattttgtgcagtgtcatgcacaccagcttcttgatacaatgggcagataaccaagctattgcgggccctagtttctttcttcttttctccacaaaggccattcctcttacagagcatagtggtgacaatatttccgctcgtgccaacctctctgtgttcaccgagtagacaattacccacctgtgcgcgcctgtgcatcatactcccatatcttgtctcacgccctctcacacgcagtcgcctctccacccgagagtgggcttactcttctctctaactcatcacaaagttgagagagagactccctgcggcgtctacatctgaaactatcatgcctccacagacgtacaacacccggcggacacacacacgtagaacccaaacacgcacgtggcgcgacgaacccccgtaccacactcgaaactggcctaacacaccgcctcttagacaacacaagcatcgacccttacactcacgagcccccatcgcgctggcactaccttcaccccacggcttccccctgcctcgcaacgtcgtccttagagaccaaaatgtaagttctcaacacaggaagaacaacaatcaacgttagcaacatgaaaacgctgccaacgcgaagattgacactaacaagcacacacaacaagccaccacaacaacacccagaaaacgacaaacacagagaagacataaaacaaacaagaaactagaaacataaaaaaaaggaaaaaaaagatcaaacctaagtagccaacaaacacccagaaagacgggaaaaagcaaccaacgacaggccgcgggctgagcacgtcggaggagaacagagagcacagcacaggcagaatccgaagctaaaagaaagaccgaacgccagcacgacaacaagacgacacgagaccgggccacgggcgcgaagagtgaccaacaaacacaggcgcgccgaagcaacgccacgtcagtatggagcgtgtcggggatccacgggggcgcagtgtgacagccactcgaataggggagtagagagagagaggagcgacgaagataaaaggcgagcgtttggtgcaggacgcagcatatctgccatcgactgaaggaacaaacgaacaggctgcagtggaataggtgacgacaaacgatgaagagcagggtgaactgacatgtgtcaatacagacacatggagtagcagagagaaacggacaggagcaggggcggagagcgcgagggtggagtggtcgatgcggggggacgggggggaggcaagctagcagcagggcgaacataccgcagaagaagaaacgagagacgcaacacggacgggcggggccgaacacgaagataacggagagacagggaagcgtgacaacaagagggggaggacagaggagaagaagcggaaagtgggggaccacagggaagatacaagaacaaaacagagagagtgatggcaggacggagcaaacgcagcggccgcaactcgccgagagaggtgaagaaagggagggcggacggaatcgcacgagaagggagcggatcagcgaccggacgaaagcaaagagtaacaaaccgcgagagaaccggagaagaagaaacagaagaggcagagacagagagagaacgggagcaacagtgagcgagcaaggaatagcgaacagatgaagaacagagcgg

SEQ ID NO: 674155 - DNA, 421 bp, Homo sapiens
ctggagccggtgtttctgctagattatcactgtcgtgcctgcccagttcttccagcccacttcttccttcaccaacatgcaagttctttccttccctgccagcctagatagatggacagatgggaagaggcaggcgcggccttcgttgtcagtagttctttgatgtgaaaggggcagcacagtcatttacacttgatccaacctctttgcatcttacaaagttaaacagtctaaaagaagtaaaataagaaggcaatgcttgtggtatgtacagggcatattggcggtgcacgcctcattacgattcgcctgcttgcttctcctgttcaatcgtttctttggaaggcaggggatttttctcttgcgtctctgtcttcttcagtttcgacttatcgaatttctcgatctcagccatatcggg

SEQ ID NO: 674156 - DNA, 685 bp, Homo sapiens
gcagcctccccgaaggcggggattaaggttgagaccctggccgtggcaaaagaagtttttttttgtttaaatgtaaacccctgctttggggaaagccccatcctttaaaatttattttttcccaggggccaatccaaaatccttccaaaaaggtgttccaaaaagtaaaaacttcccccccctccctgaagttattgagggtggtaagaaaccataacgggtaaggttttttgagtgctaactttatgccaatatttgttctatggaccttatttaaacaattaactcgcttagttctctcaacatctctgtgagttggctactgtcatttatccttatattacaaataggtccagaggggttagtcatcttgtccaggatggtggaaccaggttaaggatcgggcagtttgggctgggcatggtggctcgcatctgtggttcccagcactttggaaggctgagttggcagattgcctaagctcaggagttcgagaccaggcctggcaagcatggtgagacccccgtctataccaaaaatacaaaacattagccaagcgtggtggtgcatgcctgtggtcctaactactcaggtggctgaggtgggagaatcccttgagctcagaggttgcagtgagccaagattatgccactgcactccagcctgggtgacagagtgagaccct

SEQ ID NO: 674157 - DNA, 114 bp, Homo sapiens
tgatctagaggatctccacactgggtcgagttccaaatttgaatctttgagttaaatctgttttttaaaaacaaaactgtctgggcgtgatggctcacgcctgtaatctcagca

SEQ ID NO: 674158 - DNA, 186 bp, Homo sapiens
tgaggttcaccgcgttcacactactaacccaagcttaatagaagccggacgtaagagtgttttagatcaccccctcccctactaaagctataactcaccttagtttgtaataaactccagttacacaaaataaactacgaaagtggctttatacatatcttaatacactatagcttagacccaaac

SEQ ID NO: 674159 - DNA, 902 bp, Homo sapiens
tcttaaaaaccccggtcctgggggggttgggggtttaaacctaactggaaatcgattccattcccgggggaaggcccttgggaaattagcccttattcccctgtgtccttccgaacagggagaatatttgaagtaaataaaaaccggaccggggataaccccgggtctgagaactcacgatcccactgtcacggacttcaaccggtgagaacaaacagaccctctaaataacgcgggttgcgccccatcggggatttgcccggagacccaacatcagagggcctgtaacccctattggcggcgacatgggcctctagaatcaggagatcggcgctgcgtaacccctaagagggtacacttggtcgccggtggggggcccaaactgtctcatgggcgacacacatgggagcgtcactagcgccagtcccgcgttgagacctgggcgagaagtcctccaacgcatcggtccctgggcccgagagtgtacgcggtgtaccttgcgcccccgagaagtgtccgccccaaaaccaagaaaaatctcaaaaatgcgcaggctaccagggaaacgtactaaagagaccctgggaggaatccaaggaccacgagacaccgagtcgcgcctcaaacaacaaacattaagagcgccccaaaaagggcccataccgccgaagctgagcagtggcgtacacagagccaccgccctctactaaaggggcggcaggcacacactccccccgtgcgtacaacacgaccacagacgaccagtctaacccccccctggggaagcccacagcaaaaacggggccccctaaataaagggacccaagcggactaatggccacccgttgcccacggccaaagcgcccgcggcccgcgaaaaacactgtttcacctggcgcggc

SEQ ID NO: 674160 - DNA, 467 bp, Homo sapiens
tatttctccattgtaacagtactttttttcccttttatataaatcagcatataattcttatgctaatacatgaagctgagtaaatatccattttcttcccatagcctgtcacccaatagttttagcattgattatttttgcttgaataaattattcctttggcagttggaaaatggtaattttctaacatttcttccacatttatttgcatttttatataaagaagagcattcgttctctgctcccactgcttcacttgactaaccctaaaaaaatatatatatgtgtgtatatatatatatatatatatatatagagagagagagagagagagagagagagatagagaaacaggcaggcatggtggctgatacctgtaaccctaacactttgggagtccaaggtgcgaagactttgagcccaggagtttgagaccagtttggacaacatagcaagacctcgttcct

SEQ ID NO: 674161 - DNA, 100 bp, Homo sapiens
aagagttgaaattaactcagacaaggaccaaaaatccaagatgaaggattagtaaaaagaaaggtgaggaaacgaaccaagaccaattaagagacaaaag

SEQ ID NO: 674162 - DNA, 521 bp, Homo sapiens
  misc_feature (411)..(411): n is a, c, g, or t
  misc_feature (521)..(521): n is a, c, g, or t
ggtagtgcacccagcaagccagccagccatgtgatgggtgcacttaccctccttggcttggtatcttcatttgtactaggaagtgggtagtagattggccaactctcttcttactggaggctatataaataaaatgtaagacttcagataactttgtaaattaaaaagcagagactaagaatgaagaaaagaagcaacagcaaagaaaaacgagaaaacaaaaaaaaacaaaacccggggtgcgtatctattattggctgggcagcacgaacgaaggtgactatgtacgaactgcatgctaacagactgcagccaaagaggtacgttatcccagagcaccagcatcgattgttcgtcgaaccacgggtgaggtaaaccattgcggcggacgccacccacaagaatagctanggagcaccgctaataatactatattaacatacaacaacagacggagttttcgaacccagcttattaaattattatactactaatgcgttctggaatgcatccgacacaan

SEQ ID NO: 674163 - DNA, 279 bp, Homo sapiens
cttagaatcaaatgtgtctgttatcccttataaatgctgcgaatgtttcagagatggctgatatctaaacaacaagaaaactcaaattatcattttcttatgtgctcataagagaaacgcattactaagaaaaagagagaataaatataactctaaataaaataaataccagccgacttaagtaaattacaatcaatattctgttagaccgcttacacctgctataaattcatgtagctgctagtgagtgttgcacccaatagcgtgagcaccacagta

SEQ ID NO: 674164 - DNA, 107 bp, Homo sapiens
cattctgcggtcgactctagacggactccccctgctggggtatgttgtgttgagctccgcttactgatgctccgcttactgatgctccgttactgatgctccctatg

SEQ ID NO: 674165 - DNA, 337 bp, Homo sapiens
cggcacgaggccatctcaaaagaaaagaaaaaaaaatgtttctagagcttaacctttgggcatctcccgctccctagagggccctgtggaacagggtgggagtttccatgtagagcctgctcgcaccctccagttcccctcttttttctcgaccatgaggttccccattctataagcagcttcctagtctctcctgtaggggacacttagttagaaactggaactagggatgtaaaaggcagggcagccagcctgcagagagaggaggcccggccctgaaactctggggaagccccggacggtggagaaaactgatctgagtctagaactggttcag

SEQ ID NO: 674166 - DNA, 737 bp, Homo sapiens
tcgtgctgtacgagctggcgcagtacgcctcggagccctcggagcaggagctgctgcgcaagatggcctcctcctccggcgagggcaaggagctgtacctgagctgggtggtggaggcccggaggcacatcctgtgccatcctgcaggactgcccgtccctgcgtgcccccaccgatcgaccacctgtgtgagctgctgccgcgcctgctaggcccgcttacgtactccatcgccctcatcctccaaggtctcaccccgaactctgtgcacgatctgtgcaggtggattgtggagtacgagaccaaggccagtgccgcatcaacaagggcgtggaccgaccaactggactgcgggccaatggagcctgtcggggagaacggcggccgtgctggctgtgtgtcccactgttcgtgccgcataggtcccagattccgcctgcccttcaaggccacccacgcctgtcatcatggtgggccccggcaccggggatggcacccttcagtaggcttcatccaggagcgggccatggcgtgctgaccagcagggtcaaggaggtgggggagacagctgctgtactacggctgtccgccgctcggatgaggactacctgtaccgggaggagctgggcgcagttccacaggggacggtgcgctcacccagctcaagtggccttctcccgggagcagtccacaggttctacgtccagcactgtaaagcaagaccgagagcaccgtga

SEQ ID NO: 674167 - DNA, 433 bp, Homo sapiens
gcgatggaacctcactacaggacgtaattaacctcaccttcaaggggtacaataatagagtagaggcagccaagtagcaacatatttctgagttgcaatcctttgcctccactgtgagacaaaccccagccacatctccagcacacaagaactccaaacgcctgaaccgcagctgccaggggttcctccagaacctcctccccgaggagcttgctacaagtgccagaaatctcgccactaggccaaggaatgcctgcagcccaggattcctcctaagccgcgtgtcccatctgtgcaggaccccactgaaaactggactgttcaactcacctggcagccacttccagagcccctagaactctggcccaaggctctctgactgacccttcccagatctcctcggcttagcaggtgaggactgacactgcccgat

SEQ ID NO: 674168 - DNA, 477 bp, Homo sapiens
cacgaggtggaaccccgagaagtaccacgacgagtaccgcgccgagctgatgaactggatccacaagcggatcaaggcgggcgagcttgagcacccgccggagccgccggaggagccgaaggacgagcacgcgccgatcaacttcatggaggcgctcaagaacagcctcgcggcggtcggcaagggggggcacaagcccgccgcgggccgggcggtcacgcccaccccgccacggacggcaaagaccaacaagaagaagccggcccggaaggcgtcgccgcgggcaccgcggaaggccgggtgatctcggcggggcggcggtagactgcccgtgtgatgcacttcctccgcgcacggtcgcccggcttgttggctgtggtgctgaccatcttgggaaccgctgcctgccagccggtgcgaagggacggccctgagcggtcttcggccgcatcggcgctgcaagagggatggtgcgac

SEQ ID NO: 674169 - DNA, 936 bp, Homo sapiens
  misc_feature (732)..(732): n is a, c, g, or t
cggtgattgttcactcgtgtgttggttgccgttatgtagtgactcaagcacgcgatataacccctggtgtgccaggccgcgattgggggccgtccctttgtgcaacacaagtttctctgtgtgccggaaggccgatgtccccttgccgggtcaaacacagacggggttctggaaaacactggttcgtttctcgccccggcgacatcgcgtgttgtgccctcgccccggtttcttatgagcttccccgatggtacacctggcgggttcctctgagaacatgatgtgtggggatcacccccccgaggttgtctccgggtgcgcccccccctgtcgactgataggagccaccccccccttgggtcaacactcaagcgagccccgtgggttcggtcggtttctctacgccccccgccgcgtttgttctctcctggggcggcgagcactctcatctttttgttccccggagggtccccaaggtggtggcctggagcatctgcctgttacacgccgcgcttggaccaaacccaccccactggggaccatctctcaccacaccataagtgagcatttcttcttatacacacgaaagacccccctccggagtatctgcttattggagcccgacgactccccgtctcccgcgggagagtgcttaaccgccgtccccatcccgcacctgtcatattcccgtggcaacaataccaagcacagccggacgctacacccaaatanaaggtggtcctcccccgcgcatcccggaggtcacactatgggcgcccccccaccatcgcgagacgcctcaggggggtactccccgcaaagaaagggcgagtagttttcgccacaccagatgggtgcgacgaagcccgtggctaactacatatgggaaacaccggggcccccccccccctaaaaaaatgtcggcccaacaaaaca

SEQ ID NO: 674170 - DNA, 333 bp, Homo sapiens
tcgacgccaaatatgtaccaaaattttggacctttaaagtaatagttgggactgggcacggtggctcacgcctgtaatcgcagcactttgggaggccaaggcgggtagatcacaaggtcaagagatcgagaccatcctggccaacatggtgaagccccgtctctactaaaaatacaaagattagctgggcgtggtggtgtgcacctgtagtcccagttactcaggagactgaggcaggagaatctcttaaacccgggaggtggaggttgcagtgagccgagatcaccccacttcacctcattgcctgtgcgacagagggagactttccatcta

SEQ ID NO: 674171 - DNA, 127 bp, Homo sapiens
ggcgaggctaggtgtgtgtgtgcggtgggccgaaggctaacttaagaaggagcgcgacagtaggacgggaaggcaaggagaggcatgtgtctggccgagaagagggacgcagctgacggccagtgaa

SEQ ID NO: 674172 - DNA, 471 bp, Homo sapiens
  misc_feature (20)..(20): n is a, c, g, or t
  misc_feature (32)..(32): n is a, c, g, or t
  misc_feature (87)..(87): n is a, c, g, or t
  misc_feature (93)..(93): n is a, c, g, or t
  misc_feature (456)..(456): n is a, c, g, or t
  misc_feature (459)..(459): n is a, c, g, or t
  misc_feature (471)..(471): n is a, c, g, or t
cttccccccttccccccccnccaaaaaaaatnaaagcggggcacgccgggtgccttaccctgtaaacccctagcctaccctaagagnctgacncgagaggtctgcccctgggtaacagagcaagacactgtcctaaaaacaaaaaccttttgttcgattattaaagactgaagaaagggcccaggcgcaatgggtcatgcctgtaacctcagcactttgggaagccgaggcaggaggatcacttgagccccaggagttcaagaccagtccctggcaacacagtgagaccccatctctctacaaacatttaaatattagccatgcatggtggtgcatatctgtaatctcagctacttgggaggctgaggtggaaagatcacttaagcctgggaggtcgaggctgcagtagccatggttgtgtcaccatattctagcctgggcaacagagcaaaaaantanactcaagaaaan

SEQ ID NO: 674173 - DNA, 409 bp, Homo sapiens
  misc_feature (8)..(8): n is a, c, g, or t
  misc_feature (366)..(366): n is a, c, g, or t
  misc_feature (381)..(381): n is a, c, g, or t
gaacgagnctgctactcctgaacatgagcagaaccaaaaaagcaagagaccacaccttacatgagaagtcacctttaatacattagctgtggctgttagtgagttgtggcccaatgagtgtcagtggctcccggtcagtaacagtgaatgggcagtggggaaagaaagaaagcagtttcatctcactacccctcttgaaaatgttctcagaagatcctttctttgtcgaaacaaacaaacaaacaaaaaactagaagattcctactccaaagatgggggaacaagggccccctagagtaaatgtgaactcaccctgaaacttgtaatcagaaaacggacagggccacccttaacttaaattttccngttgggaaaatggantttgggcacaaccccaaggggctttgtt

SEQ ID NO: 674174 - DNA, 655 bp, Homo sapiens
  misc_feature (335)..(335): n is a, c, g, or t
  misc_feature (365)..(365): n is a, c, g, or t
acgatcaggatgcccagcctctcccgccgctgtctcgtgcccaggctgcgctgctggagtctggagcagcactgggagggactgcccttccttgctctcaaaagacacctcctaaagcgtgttcttctttctctgctcctcgtgtgctccctgcttggctcccacgtccagatccctaacctgggattagaagctctgggattcgaagtcctactgggtagccccagcctgcccctctgccactctctcccgatgtggcctctgcagcagcctgacctgctcaccgtccgttccagtctgcacggtgcctttggcataggtgcttccctgccttnccccgcctccaggctcaaacccagttctgncccattccccttgtgaaactcaagtgctacctttgccataaccaaaagagatttatccctcctctaaataatttgcgtttagtataatccatcttcttattcatttatccatttgatccccaaagaaatgtatatttcttaggccctgggtctggctcttaaacccggggagagaaccaaggtgattgatcactggttgtacggtgaaccgaatggctgcaccttggttagataggtatgatcagagagacgcaagcgatctagattcatcaatgggcgtcagctgcctc

SEQ ID NO: 674175 - DNA, 512 bp, Homo sapiens
gataaaacctttcttcccacatgttactggaagtccagctgtaagacaggctctaactacgcatgtgatccaatcactggatcagtaatgtcctcaggggctgggtgctgtgtgctcatgcaggtaatcccagcactttgggaggccgaggcaggtggacttgcttgaggtcaggagttcaaaaccagcctggccaacgtgtatgaaaccctgtcctgtactaaaagagagacttaggccagcgaggtgtgatcatgcctgtaattccagcacctttgggcaggcaaatgcggtcaaatcacttgaggtctgtaattcaagagcagcctggctcaacatggcgacgaccccatctctactaaacaatacaaaatttagccagctgtggtggcacatacctgtaatcccagctacttgagagactgaggcacgagaatcacttgaaccgggagatggagtttgcagtgagccgagatggtgccactgtactccagcctgggtgacatgagcaa

SEQ ID NO: 674176 - DNA, 183 bp, Homo sapiens
taactttgttcaccctgtaaaatctgatctttttacttcttaatctctgctttgtattcattggtatgagcttccatcctcctcagctcttcatatttatccattaggtcttgactcagctgattacacgttgcactcacagattccaaacttatagcttctacagtgacgagacgcagaagg

SEQ ID NO: 674177 - DNA, 533 bp, Homo sapiens
atatctggggtcaggtgtcagagggtcagggtgggaggtcaggggaggggtcaggaataaggaatggggggttagacgggtgaggtcagatctgtggatcaggggtcagggggtcaggcctaggggctgggcatgggtcagggatcagaaggggtcaggctagacctctctcttcctctgtgtcctcaggtggagaagctgggatagggctctcggaaaactgcgggggctgggtctggcccgtcaggatgcaggaaaagggaaaagtcactctcgccctgaagggtgagcgtcgggggggaggtgagaatgtggtatcccttcccaggggggcagatctccttgaacgcaggggtgccatcggtggggcagcgctgacaccgcgcgccccaggccttgccgacactggcagagcagagctggcgggtcaggcgggtggccagggggtgctggactgggtgctcagggctcaccaggcggaaacacatggctcttctcctccggggttggtctgcattgcactgtgtacggca

SEQ ID NO: 674178 - DNA, 547 bp, Homo sapiens
  misc_feature (295)..(295): n is a, c, g, or t
tcgagaggttcttggtgaggtcatcacggaaacacggcaacggataacgttaggcttttggacccctgggaccaggtttttgtttgggttggaaaggattctcaaaaagaagaaaagacaaaagccttgacttctggtaagcggtacattgagacggacccagccaattgggattgggggacgcccatccccgtggtaaagcaagggtttgagcctccctcctttgtggggtggttccttgggtgggaaaaaaaataatggtttgtggaccccttggacagggccatggtttaantggttgccttaggaggggcagggcccccccatgttaccggtgagggcccttttggaattgtccttccctcaaaaaggccttaaagggagcaaagcagctttgctaagagggggggggggggggggggttgttttttttttttttttttacaggatcccaaaaaagccccgcaaaaattcagagtccctgcaaaattgtttaaaatgtcagggtttgggaaattaaatccaataaaaaccttttgaagggtga

SEQ ID NO: 674179 - DNA, 239 bp, Homo sapiens
atatcttttaatctagccatctttctaacatttagctcaatattcaccgcagaaatgcagccagcatctcgcaaacataaatccattctttaaaatactctctttaggaagctgcagacatgccgactgcgtgcttctctgcaccagtctccagtgttagttctacataggctcccttctgtgcttctgtctttgcaaagacctgtttaaactaaaaagaaactttccaaacaacaaaa

SEQ ID NO: 674180 - DNA, 192 bp, Homo sapiens
ccctacgacactgaggaagaactgctggagttgatgaacaacacgccttacggcctgagcgccacgctctggaccaacgatttgagcaaggccctgcgcatggtgccggcgatcaacgcggggacggtgtgggtgaatatgcacacgatgctcgacccggcggtgcgtttggcggcaacaagtcttcgggtc

SEQ ID NO: 674181 - DNA, 270 bp, Homo sapiens
gaacagtcaggaccgggttgaccacgaggagtggaaatggtgcctaggcattcatcttggggggatgttggtgtgggtgcagtcttaaggctccagtgttaaacctaaaccagggaatggacaatggaggaggcactttggtggaggcaagaggtcagccaaggtccatgggaaaatggaaagggtagcagttatgcctccaggtttcagcaaggttagtttcagggtccaggtccattattccacaagcacttatgtccaattcattca

SEQ ID NO: 674182 - DNA, 197 bp, Homo sapiens
gggtgcttgaggatccaaagtgatagagtagacactcacaggacaatacaccaagggagaaggaagggaagaaataaagaaatcaggacctggaggagagctttgtgcctgttgctgcaccccctaggtcatccaagagagctgcagaagtactccaggtgattcttgagagcccccagaggaacttggcaggtggt

SEQ ID NO: 674183 - DNA, 902 bp, Homo sapiens
gctctctctctctctctctctctctctctctctctcgagcgctaacactgaacgctcctgcccctcctaaagctgaagccagagcgagagttaaaggccaagaaggcagtgtagaagtgtgtaccagcagacacaaaaagaagaagatccgcgatgtcacccaccttccccggcggggcgaagactagtgagactccgggagacagcccataatatccctcgggaagcagctgctccccagagagaacaacacatgcttgcactactcattgctcatcatccaagttctcgcggtgcaacagtagttgtcgtgccatgaaaaatgatagaagacaacaacacacgtgttgtacatgtgtggtgattgttgagcacgccaacgaagccaccatattaaaacggggtgatagaaaacatctgtcgatcacattatgagtgtgcgccagaggaacaaacacctcatgatcttcggcgatcatgataggagagacagaaggggctatatggtgcgaagtggcctcctgaataacgactgctgtggtagtgtttcgccaacaaatatttgggcatcatctaaatgtgatggtccagctgtcataatttcgtgaatatatttatatatatatctttctatcacgcaattaaagaagcagaaatactagttcaaatatactgtggaagacatataagcacgggggtgacagcacaacagcagagcaaaagcaagagggaccctagtgacacatgagcttgtacgggacccgcagatttttgcgacccaaggggggaaacaggcgggaggcccccatatagggagccgaaaaatagagaaaagccaggtaactcgattagaacaagagcacagcaaggtaagcgacagcaaacacgacgcaagaggcgaa

SEQ ID NO: 674184 - DNA, 124 bp, Homo sapiens
gtcgtgtgacatcatgggtgtgccttgtgtgcggttctgtacagacggatgactgtgtcctttcacttgggtacaccttagattttgaccaaggtggataaaggttcacctaatgcttacttgg

SEQ ID NO: 674185 - DNA, 616 bp, Homo sapiens
cctgagcggagagctttggggggtaagcagccccatagttcccgcgattatcctctcgaggtgcgtacctccttatggttcctatacatctccgaggatcgtgtggggtgtagtttttcgatttcgccgctcgctgcgcccgttttttgttgggtcttctctaagaggtgcgctgcttgctccccggagagacacctcaccacaccacccacctgcgaccgactcccctgttgggtccggtgaccctctcgcctccgccccaccacgttgggccccgccctccgagcggacgcccccctggcgcgcaaccgattgattttttgccgcccgccccctcggtccctctccgtgggtgcgacgcctgccggcgtgggcgccttttcccactccaggtttctttgtgccccccaccccccgcgcaggcgctcttctcttgtcgactcccccgggcgcacacacactagagggcaccacgcgacaacgctgtggtcgttgagagcacctctttctggccccccccccccccccccccgtttttttttttgttttccccgggccccgccaaggggcccgcccccttttttttttttccggggaaaaaaagcccccggaagga

SEQ ID NO: 674186 - DNA, 1744 bp, Homo sapiens
  misc_feature (1)..(1): n is a, c, g, or t
  misc_feature (1170)..(1170): n is a, c, g, or t
  misc_feature (1492)..(1492): n is a, c, g, or t
ntctcgctggttgataggtgtgggtggttgcttcgcaccgcgttgtgtgggggtggttgttgtctcctggtggtgtgcctcttgttttgtgttgctcgtttgtcggggcgtgtgtgtcctcgggtgggggtttggtagcggcggcgtcccctcgtcgtggtggggcccctccctggtgggggtcttcttcgtgtggggatgaccgactacctgcttgtgctctttgtggctggcggctagagcttggtgggtccgacacctcggtggtgttgggatccagctatgtgggttccgcacagacgagatcgtcctctttggggccttggtcctttttgtggtgcctgggggctcacgtagtctccaccgcccgcccttctgtgggtgggcacaccaatgggtgggcaccacccaaggaggtcttagtagaggtgcccccaaaggggattgatagtatgtccctcttcctgggggtatttctctgtgctccccctatggagcccgtgtgtttttcgccgttgttttctttggtgccctgaccccaagtgtttgggactgactcgccccttgccggcgccatcccttgtgggcactgctgtggtcatatgatctttttctgggggaccccttccacggtgggcccccctgcttcgcgaggggccccccccgggtgcccagggggtatgtttcttcgcgggcgcttacgtggtcattgggggttacaccctcacgcgccccaccccgggttggggcacccccgcgccggtgccgatggttgccctacgggcacacggcagtctctcgagggggcgttggagccctattgtcgtctctttcccccccgtggcccccgctctggggcgcacgccccccccgcggtttgcgtctagtagggtgccgcgcccggaggggtttctggcagcgcttttccgcacggtggtgcgcccccaggccccccatcatctggcactaagggggccgcccctgcgcgcctggcacccctcgcggcgcgctgtggccacacaggcggggggtgtgcccccgaggcgcgctctctctgtgcgggagagggagtcgggcccccccatttccccttgacgacagactcccacttctctctcccgcggtgtactctctccgccctcctcgcgggtgtgcccttttcgttgcacnccgcgtgtgctcgctacggttggtggccacgccggcgaacgacttgcgaccatcgtcgacagcagagagcgcgtccactttctccacctcgtctctccccgccgcgctgttttcgcgtagggagcacaccccccctcgttcacgcccccaccgcgtgacacgagaaggtcacacccccgcgcacgtatcgcgccgcgcgcctcgccgcgcgctctcctgcggggtgtgcttcgcagcgcgctccccggcagcgccccttgtggatggtgccacccccagggtgtctcaacacggcggtcccagggtcaccgcctctcgatangggaggtctcccctcgcgtgccacgtacctcgtgagccctctcgtcccacatcgggtcctgtacgcgtctgcccacaccttcgggtactccccgccccccggtggccctcggaccctctccggtgtcgcctcacggcggcaacgcgctcgtcgcgtcgctcccattacccggtcgatcccaacaccgtgtgtgtcccccagcctccgggtaacccgccgtgatagtgttctcgtctatcgcccagcccagtg

SEQ ID NO: 674187 - DNA, 386 bp, Homo sapiens
  misc_feature (4)..(4): n is a, c, g, or t
gaancattgcttctagttgccatgacattgggacagatctactacctgaagagattttttgaagtccggaggttgtttaaaaggccttttcctgttgatcccaaattcatgatttacttgtttaccaaacaccttggtcataataatgtcattagtttatacatttttattttctgaacgttcatgacttatgtttctttgtgattagtaggtgttggggaaaacctgtttaagagagttagagtgaaaatttgacatttgattggcctataattcttacttgaaaggagccccattatataggcccttccaagaatccagaggctgttaatgctgtatgggactatggtctttattatgtttttacctttggttttcataataaa

SEQ ID NO: 674188 - DNA, 555 bp, Homo sapiens
ggctgacctagagttacccccatgctgtcttcagcgatggtgtgtcaacaggttcactaatatttgtcatgctgtagcatttgtaagattgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttatgaaaaaaaaaaaaagaaatcctgatgtggacattatagcacactgctttctccacagagatgctgatatcaaaaacttgaagatacagtgaagttctgaataatgttacaaaacgtggtacctgtatcagagacccatttatgcaaaattgttaaaaaaaaaaaaaccccaaaaacaaaacccgggacgagacaccaattgaccctccggccccaataaggcctctccgggggttcttcagaggaagcgtcctctacgggatattggattggaagggcgatggccagagtacttacaataaaca

SEQ ID NO: 674189 - DNA, 304 bp, Homo sapiens
ttttatacctgtatacgcgcttctcttattccatatagtatctcaattcatccaaaaccgtatccaggccatcaccaatcattctatacaacaaatgtttcttcttacatccccacaatatcaccctttaccacaagacctcccttcagcttaatctctcccactctaggttcccacgccgcccctaatcctgcttgaagcagacctaagaaacattgcccattctctctccataccaaccccacaaaaattctcgacgccccaacacttcaacactatttagttatgtcttattactctaaga

SEQ ID NO: 674190 - DNA, 740 bp, Homo sapiens
tgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaaagctcctttatgtaacattccagataagtgttgatacgggtcctcttgtgaagccacccgtgttaaacctttttagaagatttgacagtgtgggtcttggactctataagtgcttgttggacagtcgcgagcgtaaatgctgtcggtgtgtctgtgtgggacaaacacaatctggtaatctacagcaaagtactttctacattccgttcagggggcacacccaggggaataagaataaaaggctattatgactaagtggtaaaccctatgcactatcccttgcatttggggcaactttttaaaaaaaaagaacacggatttttaattaataataatcctgtagtgacaatgtgttcggtaatttggtgctccacattacactttggttggtacaggtggggtgggggagaatggcgggtttacaccatttcagatcgcggtgggtctaacgagtattacggtttcaaattacgcacaacgaacatgattttaaaatctggtatgtacatctgtttaaaaggcccccattttttacgacaaaactctggtgccaattgaaagaaac

SEQ ID NO: 674191 - DNA, 1435 bp, Homo sapiens
gtgcttcctgaggtgaagctgtagaaacgattgctatctagcaatgccgaattctctgaatctagcgtgtcctgtactagttggactctcattagtctaagggcagtaaacaggtagagatgtgctgttggctgaaacaggtatatggcaaaagatagggcttccattccaagtaacattatcgtgtctaactctttggcggattatctgcgtagtgtctactgtgcttgggaagcataggcgtgattacgtgtgtggttgtgaggtcgacaagtgggatgtcaccgtcttaggaatagatccatagcgccgcatcgcctggcgactttcgcataagcaaggcagtatgacactagcgtatgagaacacagagatcatcgtaagaatgtgacatgacactagaggaatagtggtcggcgttccttgggctaccatgggcgtcctggcctagcgtaacacgtcagttttggttgagctctccagggtcccacgtaatgtgcttaaggctccgtcggtgggagttcccatgactaagaaacatacggagaggcataagggttcacgtttagggatcacgatgaggatgacggttggctagggcacacgttgggatgacaaatggggctcttagggtggcttccaatggcctgcgaaggggaagtcgaacttgcattgggaaattaccacagatgcccgtaccgacgagctcgtttggcgatagccatcgcgatagtccgccaaattgccgagagaggaaccttaggtgcggcaagccggagaaaggcgtcttacggagggcaaaaaagcgtagggtggcaatcaggaggagtagacactacaaggtgcgacagacaagggcccgttggtccaatgactagggagaaaagtgaaccccggtaagacggtaacgtaaggaacgaggcaaagggaacgtcccggaacgtttgaagcaacaacaagggagtgggggtatgccaagggggggcactcccgagtggaaggatgcccagaatgagcgacaacaagacggagttgggacaaatacggccaagcgccgttagtctgatacacacagagcaaacacggatggcagggacacgtgacacaggagcgaggggttaccaccgaagagcggcacagaacgggcacaggcacaaagaggcacagttagttgggcgcactaaggggacgttccgatgtggacgaaaaagaggccgccacagtgtgggaagagccaggaaatcaccgagacgagcggtaacagagaacctgggacgcattgggcagccatgggagcgaccagagctcgagaaaggtcggacccccaatattcgggagacagggacacgaaaggacacgcacggtgaagcatccgcggcgaaaggcgcccaagcatattgaaactgcagcacgcacatatgggcgaaaagcgacg

SEQ ID NO: 674192 - DNA, 365 bp, Homo sapiens
gcgagctgcggtactctaagatccgatcagtgcattgtgcagatgcaagttcccttactcatgatatctaacgtaattctttccgggcttggtgatggttgtctccttgtgcttcaactggcttgtttatactaattggagagccttgccaagctggtgcaaagtaacccagtatacgtgtgtcctcctcatttgattgtgggcatacaccatgtcttactcatctttaaattcctagcactgattacaggactgggcacctaaaagatgtgtgctgaaaagcatactgaatttcataacgaactcttatccatatcctagtacatattgactgatgccacccttttcccacaatggcagtggat

SEQ ID NO: 674193 - DNA, 232 bp, Homo sapiens
catgctcgctggtcgtctctacaggtatccccgcgtttcgcctgtttcccaagctggtctcaaactcttaggctcgagtgcaactgcccgcctcaggcctcccgatagtgcttgggattacagtgctgagccattgtcattcccttatgcgattctatcactcagctagtatcccaccttgggggcctgcaggtttctctcgaccatgggctccctgctttgctagagttcc

SEQ ID NO: 674194 - DNA, 593 bp, Homo sapiens
atacaggaaatcagctatgccaggaaatagctctgaacaggaatcgcgtataaccatgaaacagctatcactaggaaacatcgatgacctggcacctgttctacctgtcatcgggatgatccatgaaacagatcatcctcgtgctcatcataatctaagtacgagaaatacattagttattaatttatctttatttgagacagggtctcactctgacgcccagtctggagcgcagtggcgcaagctcagattactgaaaactctgcctcccggcttcaagcaattctcatgcctcagcctcccaggtagctgggattacaggcattcgccaccacacccagcaaattttcgtattgttagtagagacagggtttctccatataggtcaggctggtcttgaactcctgacctcaggtgattcacctgcatcggcctccatagtgctgtgattacaggcatgagtcaccgagcccggtgcatttttgagtattttgaatgaagacaggatttcaccatgtaggccaggctggtcttgaattcctgacctcaaatgatctgcctgcctccgcttcccaaagtgctgggattacaga

SEQ ID NO: 674195 - DNA, 323 bp, Homo sapiens
aagcctaaggaaatggggtaaatcacaggacaatctatcttcccaacaaacaaacgttgctatgtcggtaagtgtttgtcctagagggacaaacacgctgaaatttacattagcagtgctgtgcaagattcttacctaattcaagacctaaacacagcctgcagtgaaggtaacagtcctctgtacaggtgctttagaacagaagccataagctgatgagcctgacagggaaaaggaggcagtgaagacaggtgacaggcacctggccagggaagaaggattcaaggaatgccagactccttgaaatcgcctgtggttaagag

SEQ ID NO: 674196 - DNA, 169 bp, Homo sapiens
gctgctgcagccggacctatttggccatacatcgggctctcacgaagcactgggtgtagttcagcccaaatgcatcccaccttgtcccctcagcagacaagacctgggctgcttgtgtcgtgagcgattttcagcggtatgttacggctccgtctccactcctgacgaa

SEQ ID NO: 674197 - DNA, 1285 bp, Homo sapiens
agcgtgagagcgcggcgcgacctggacgctgcgtggcggggaggaggatggagactgtggcgtccgctgcaacgtgttggggctgcggcgtgagaatgtgtggctggtgtagtgcacctgcgctctggggaatgtgcttggctgtgctggctgtgcctgagccatggctgggatgacccccttctctggtgctccctgaagtctcgtgggagcctgtgacccatgggatcgttgagcagccgggtgctgctgccagccaacgaccatgcccttgacccagaccaggctgcatgtggatgccagtggctgtgggggctcgtgccctggatgtgcctgtgacatctggatgactgattgcggcggtgccactgggattcttgttacatgtgctgggcagcacacaatgctgcaagctggaggccacgctgcggtcctatcttgcgtaacatagtcaccacttgatctcagagaatcactgggacgacggactcgacgtgacgcgacgcgcgggaccgaagccaggccacgcctggctccttcaagcaccaccatccgcaaacgggagctgacacatttacacccggacggctacacttcttacacactacttattctctcactccacgcacccagtttacttctctgctcgacacttgcgtcgacaacacccacgttgcagccacttccgaccgactctttggttgacctcgtacgggccagcacacgcaacctgcgcacgcctttacacacccaaaacgatacttctttctacagtcgctccagaattcctggaccataaccatttagtactcacgggataacctggttacccacggctgggatattccttctggtgcacacacgcacattcccagtccacgttgcacagttaactttacgttcggaaacccttggcgacgcgattttcccggtggaagccaagggaagaaccaatattggactggattaagccacacagccacaccttgcacacagggcatgtgggcacagttattcggggacaaccaacgatgtataaattccggagaggaaatctggcagttggttctcgttttggatctatacaagtggcccccacgagctcagaaagctattggacaggcccacactcgatagaggcaccacatagcagagcacccagtggacttatgtggcgttagcgcagtggtgctggtgaaccggagggcttctaaagtgtacacgtaggcgcgaagctcagtgtggaagtgacagaagccagatgatgcagaagcagcggagacaa

SEQ ID NO: 674198 - DNA, 177 bp, Homo sapiens
tttctttcgcccagggctggcactggccattgtcacggaggaggagacggaggctgtctattggatgctccctcctactgccactgagggccctgagcaccaaatcctgtgcttatggctcttgctggagggtcctgggtgcatgagggtcctccgcctaggcctcacctattggca

SEQ ID NO: 674199 - DNA, 303 bp, Homo sapiens
tatcaagtagcttaaaaaataaaataagctgggtgtggtggctcatgcctgtgatcacaccgctttggaaggctgaggcaagaggatcacttcaccccaggagtctgtttgagacgatcctgggcaacatagtgagactctgtctctacaaaaaataaattagccaggtatgagggtgtgtacttttaggtcccagctactctgagatggaaggatcgcttgaccccaggaggtcaaggctgcagtgatccttgatcgtgccactgcactccagcctggatcacagagcaattccctctctca

SEQ ID NO: 674200 - DNA, 228 bp, Homo sapiens
ggaccggacatgcctgtatctcaacgatattgattctttgggctgtagtcagtattggattatgatcaatattatcaccattagtagctccacaatggtctgtcggttctttggctggtcaatatttcccaacatgtcttctacaagagagagttactcatctcgtacatggtcatatctgatagagttggttgctgtggcaaatgcttccgttgagatcaggcatgt

SEQ ID NO: 674201 - DNA, 375 bp, Homo sapiens
gcacgccctagggaaccttcctcctcagatacataacattctggtatttgtagttcttgcctgttagctctacctcctagggaacattcctcctcagatacataacattctggtattcgtagttcttgcctgtttgctctaccccctagggaacattcctcctcatatacataacattctggtatttgtagttcttgcctgtttgctctacctcctagggaacattcctcctcagatacataacattctggtatttgtagttcttggccgtttaattctaccttcctagggaactttcctcctcacatccttaccatcctggtattggtagtccttgcctgttaactctacctccaggggaacattcctcctcaa

SEQ ID NO: 674202 - DNA, 821 bp, Homo sapiens
tgatagcgcccggcgctgcatttcctggcgacacctcgtagtcatgcctgtggcttgcgcacccttgatagaacagaccaggggcctatcgatagagaccggtgcaggcctaggggtagtctacctgtctggacagagcaagagcacaaaatgcagagacactggctcagtaagtgccttagacaatacggtttcggctttggctacagcaaacaactggatatgcttcatggagggatcataggctatgtaaaagctaggcagcgtgccgatctcctggctgccaggcggctagcctctataggacaagatctagccggcctggagtgcttacccagcatgtctacaggatccaaggaaccgtcagggttagaccatagtctacgatcttggtaacattggctggagataatgggaatgaggattctaccactctggaaaaattcatgcctgcaggtttaattgacaaggtgacagtaggctgatgggtcgaccaaagtcggagtaagatatgtttacaaacaggacccccaattacgcacgcacgtcatggtacccaagcgttaagacctgcatgaacgaacttcaaacaatctggcatcctctccaactaattttccactcatattcaagaagcaccataaagctgcacgccctagagcgccagtcctgaaccatcggaaaccatacaacaacagccgcaccccaccacgtgggcccgacgacggtgggaagcagccctgctcatgacttcacaagccctaaccagaagggcggcgcataatctccacaccacgacgactccacacagaaccggcatc

SEQ ID NO: 674203 - DNA, 109 bp, Homo sapiens
cgaggaacagcacttgcctgccttttgattcaaagcaacttcagaaagatcccgtgtgtccatttccacatactggttatttgaacatttcctaaatgacttcctcatc

SEQ ID NO: 674204 - DNA, 397 bp, Homo sapiens
ttaagagttcgaggtcggtaccggcatgtgctgtaggccagcgttgtgtgtaaagaggctgacagtgatgagtgtatgatttgatatcgtgattttgtattctaacatgttatagtttagttgttcataatagttgtatatatttatggggtacaaaatgatgttatgattcatgaatataaagtggagcaattaaatcaagctagttaacatatctatcaccttatacttattttttgtggtgagaccacttgaaatttactcacagcgatttttttctgttttgcttttgagacagtctagctctgtcacccaggctggagtgcagtggcacaatctcggctcactgcaacctccacctcccgagttcaagcagttcgctggcctacagcacatg

SEQ ID NO: 674205 - DNA, 520 bp, Homo sapiens
cctcgcttagtgctccctgggatgtcagctccttgagtgtttatgggagacagtgctgagtcctccactctacctgtgacccaggctccctctgccctcaggtttcaccctcaacagccaggtgcagcagaccattgccctgcggtatgcgtgcagcaagcttggcatcaactttgacagcttcgtggcttgtatgatccgcctggagaccctcttcaaactattcagccttctggacgaagacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccaga

SEQ ID NO: 674206 - DNA, 464 bp, Homo sapiens
  misc_feature (94)..(94): n is a, c, g, or t
ggtgactcatagaggatccctggcgatgtcgcgtgcatgtgaggcaggagagcatcaatggtgaaagcacaccagcccctgagaagccaagacncaatcttgtccctttcctttgcagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccagaatggtttccacctttctctcgtgatatgctatctgggctgtatcctgggctttttatgctttgggaaagaagatgttctcgggacatggcacgcgaatcgcca

SEQ ID NO: 674207 - DNA, 883 bp, Homo sapiens
cggggcccggctctcttgtcgcaagcgcgactgttcggttcttctgttcggatgctctggggtggtaaccactttccctggctggtcggcggcgatcaccgtgagcgtaccggacaggggtcggcaagagatcgctgtccgatcgcgcagcgaggtggtctcgatgggacttataccgttggtatcgcggtcgtccgttgtgttatcggtgagcgtcctgcgagtctctgggcaggccaagcctaggggcgccagagcgcctgcgcgcgtacggcgggccggcaaggggctagaggcggctccctgggtgacaaccgcgcgccccaacgtttccccacgtggccgcgaagaccggctcatggagcatctatcgggctgcacgccaacatctaagcacaggcgaagatggtctccaagcgcattgcccaggagacctttgatgcagcgtgtgcgcgagaacatcgagggacgtagcgatggggccagaggaggcagtgacaagaggccgtggagcagttagaagtcgcaagggggttgatctgagcaacgattgtaaatgacggctacctaaagtctctgcagacggatcccaggagcccacatatgacatcctgcagatgctcagttgagctccagggagtctgtggccagctctcgaccccaggagggtgtcaggatacctcaacccggcgtctgcgcaccaggtgcaaaacagagacaaaggcctgccgcattcatcgcggccccagaagggggcctacgccattcatcttcactggcatggaagcttgtgcacttgcaggtgaccagtgaccttctgctccagtcctcaatgcctggtcggtgctgactgcatggacagacacgacctcctggatgcccg

SEQ ID NO: 674208 - DNA, 681 bp, Homo sapiens
ggtgttcaggcgcttcgtggaggttggccgggtggcctatgtctcctttggacctctagtgccggaaaattggtcgcgattgtagatgttattgatcacgcacatcagggctttggtcgatggaccttgctctccacgtgaggagcactggccatgcctttcaagctgccatgcagctcacgtgattctcatccttccaagtttcctgcactagtgcccactcagaagtatgtcctgatcgaagcctggcgagataggcaggacgatcaatacaaaatgggcagtccacacgtatgggccaaggaaagattcgaaggcctacgcagagaaggagcaaagcccactgattgacatgattttgatgcgtgtctaaacgttattgagaggcaaatgcaaacatgagtgacacaggaataatcaacgcacatgatacgtcaagaagcttcaaataggcagctctcctgcaaatgcttctcccaaaaaatgcacctggtacctaatgggtactgctgctgctgctgctgctgcgtgctgctgcttgcttgcttgctaatggttccatgcaaaaaagtatcaccgccgcgagtaagaaaggctccagcccagaaggttcctgcccagtaaagccacgaggccatgaaagcagcgcctgctccaaaagctcagtaacggtctaaaagc

SEQ ID NO: 674209 - DNA, 344 bp, Homo sapiens
ccagcccacatctgatctaacgcagaacatgaaagaaggattcagacttcacagccttctggactaacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccaga

SEQ ID NO: 674210 - DNA, 1022 bp, Homo sapiens
  misc_feature (81)..(81): n is a, c, g, or t
  misc_feature (84)..(86): n is a, c, g, or t
  misc_feature (364)..(364): n is a, c, g, or t
caagctcacaagagaaagaaatctgtaaggcatgtagaatttggactcaatcatgttggtctttaatgtgcctagagcaanggnnngggcactttgggggcggtggaattcaagacgctctggctgaagattcagaagtatctggtaactctcttttccttctgggcatcctctcctctgttctaatcctcccttacactcattcctggtccattgtattctgaccacatccttaatcatggtcaaaactattgagtcctgggcacattggtcatgaaggaacaagaaggcaatgagagactctcatgccaaccactgccctgaaagccctgctgttcagacagcaaaggggccagcactggcnaagctcttatgcttgctctgaaaccttcttgggaggagtcaatagggtctccttttgaaagtgtccctggccttttgagaaagcagtgtggtggagggagatggttctggcaggggccgtgaatggttgttttctacttgggatttctttcctgctttaggagatctattgggaaactgattataaccactcgggcaccatcgatgcccacgagatgaggacagccctcaggaaggcaggtttcaccctcaacagccaggtgcagcagaccattgccctgcggtatgcgtgcagcaagcttggcatcaactttgacagcttcgtggcttgtatgatccgcctggagaccctcttcaaactattcagccttctggacgaagacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccaga

SEQ ID NO: 674211 - DNA, 642 bp, Homo sapiens
  misc_feature (81)..(81): n is a, c, g, or t
  misc_feature (84)..(86): n is a, c, g, or t
caagctcacaagagaaagaaatctgtaaggcatgtagaatttggactcaatcatgttggtctttaatgtgcctagagcaanggnnngggcactttgggggcggtggaattcaagacgctctggctgaagattcagaagtatctggagatctattgggaaactgattataaccactcgggcaccatcgatgcccacgagatgaggacagccctcaggaaggcaggtttcaccctcaacagccaggtgcagcagaccattgccctgcggtatgcgtgcagcaagcttggcatcaactttgacagcttcgtggcttgtatgatccgcctggagaccctcttcaaactattcagccttctggacgaagacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccaga

SEQ ID NO: 674212 - DNA, 1125 bp, Homo sapiens
  misc_feature (81)..(81): n is a, c, g, or t
  misc_feature (84)..(86): n is a, c, g, or t
  misc_feature (364)..(364): n is a, c, g, or t
caagctcacaagagaaagaaatctgtaaggcatgtagaatttggactcaatcatgttggtctttaatgtgcctagagcaanggnnngggcactttgggggcggtggaattcaagacgctctggctgaagattcagaagtatctggtaactctcttttccttctgggcatcctctcctctgttctaatcctcccttacactcattcctggtccattgtattctgaccacatccttaatcatggtcaaaactattgagtcctgggcacattggtcatgaaggaacaagaaggcaatgagagactctcatgccaaccactgccctgaaagccctgctgttcagacagcaaaggggccagcactggcnaagctcttatgcttgctctgaaaccttcttgggaggagtcaatagggtctccttttgaaagtgtccctggccttttgagaaagcagtgtggtggagggagatggttctggcaggggccgtgaatggttgttttctacttgggatttctttcctgctttaggagatctattgggaaactgattataaccactcgggcaccatcgatgcccacgagatgaggacagccctcaggaaggcaggtttcaccctcaacagccaggtgcagcagaccattgccctgcggtatgcgtgcagcaagcttggcatcaactttgacagcttcgtggcttgtatgatccgcctggagaccctcttcaaactattcagccttctggacgaagacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccagaatggtttccacctttctctcgtgatatgctatctgggctgtatcctgggctttttatgctttgggaaagaagatgttctcgggacatggcacgcgaatcgcca

SEQ ID NO: 674213 - DNA, 1376 bp, Homo sapiens
  misc_feature (81)..(81): n is a, c, g, or t
  misc_feature (84)..(86): n is a, c, g, or t
  misc_feature (364)..(364): n is a, c, g, or t
  misc_feature (878)..(878): n is a, c, g, or t
caagctcacaagagaaagaaatctgtaaggcatgtagaatttggactcaatcatgttggtctttaatgtgcctagagcaanggnnngggcactttgggggcggtggaattcaagacgctctggctgaagattcagaagtatctggtaactctcttttccttctgggcatcctctcctctgttctaatcctcccttacactcattcctggtccattgtattctgaccacatccttaatcatggtcaaaactattgagtcctgggcacattggtcatgaaggaacaagaaggcaatgagagactctcatgccaaccactgccctgaaagccctgctgttcagacagcaaaggggccagcactggcnaagctcttatgcttgctctgaaaccttcttgggaggagtcaatagggtctccttttgaaagtgtccctggccttttgagaaagcagtgtggtggagggagatggttctggcaggggccgtgaatggttgttttctacttgggatttctttcctgctttaggagatctattgggaaactgattataaccactcgggcaccatcgatgcccacgagatgaggacagccctcaggaaggcaggtttcaccctcaacagccaggtgcagcagaccattgccctgcggtatgcgtgcagcaagcttggcatcaactttgacagcttcgtggcttgtatgatccgcctggagaccctcttcaaactattcagccttctggacgaagacaaggatggcatggttcagctctctctggccgagcggctgcgctgcatgtagccctgacccggggcttcagatatcattttttttccctgccccactgacggctacctggcacccccactttttttttttggnacatacatgctccagcgacatacactggttgccagaccctcccccgcctgcaaccccgccccccgccctgagcccagaggtatgcacacccgacccgccaggcccaaaagacgcccagccgcaaccaccgacgcgagcccaagaacaccctatccgctcttttgtaacaataccacagaatcgtatcccccacaccgcttagacgacgcgcactcccctccccaccacaccccacgcgtcccttcttcgagaccccttgacccacccccctacgccccaccccacagcgctactaccccccaccccccccgccccccctatccacagtatcaccttcgccaccctccccacccaacacgacaagcgcacacagccgcacgcacacgccaaaacacccaccccgccgccgctcagatagagagaacaccagaggcccccacataataatagcgttccaccgcgcgcgtttacaacataaattactataataacaagata

SEQ ID NO: 674214 - DNA, 923 bp, Homo sapiens
cctgacccaatacgcaaaataaccccctaataaaattaattaacactcattcatcgactccccaccccatccaacatctccgcatgatgaaacttcgcgctcactccttggccgcctgcctgatcctccaaatcaccacaggactattccttagccaatggcacctactcaccaagaaaggcctcaagccgccagttttcatcaaatcagcccaaaatcactcggaggcacgtgaaataatggatggaattcaatccgcatacctgtttcgacagcccaatgggagccatccaagtatacctttaatcatgaccatcttccatacaacattcggggcgagaggccacaaatactaacgggatcaatatactctacagtccagaagcccttgaaaacaattcgagaattaatccctctcttgagttgcaaccgtattagcacacaaggcctatcaataagcgcatagtgttcacatccacgtgagagccaacatcattcattacctgacggggggacaccaggaaactttaacagaacatttaacatatcgacgccagtccacaatagcaatatggagactagacccatatgtgtccactgaaagtctgaacggaaggcatactacaaggcagaaacaagacccaccactacagcagagatgacctataagcatagcactgcagaacttgaccccttcaatcattgaacgccctaaggcagacagttccaacttccatattttgtcacgaaaagggaattaaacaaccccttggaaatcgctcgcgaatcggataaaatgcacctgacacccttacgtagcaagacaagaaggccacggaaaacgtagcgatactctgctcgtaaggaatgtaacaatctagcgaactcatgtgaccgaaagtgtccaagccaacttaacacca

SEQ ID NO: 674215 - DNA, 545 bp, Homo sapiens
  misc_feature (16)..(16): n is a, c, g, or t
  misc_feature (38)..(38): n is a, c, g, or t
aaaatacatatttatnttgtaacaagatttatgatttntaaaaatgtgtcgacctatacagccatcagaaataacaatatgcgatatttcatcttatctggtctttgggtaaaattaaaaggcaaataagaacggcatccaaagcaagggcatgactgtgtatgcagggcacggtgacaaggccactgcctacaatggtagtgttttaacaatctgaaatcattcagatttaacaggggaaaaccttcagaatgaaacacaggctccaggttcctgagatttcctaatagagaagctgcaaagagaaatgcgggttcattactcagccaccgtgctgcactcagctatcctgcacatagcaattagagtggaactcagggcaccatgtgcactgcatacaaagccagccaccctctgagaggaaccaaaatgcacaagaccccacagcatagaaagcagccagctattaagaaaagtttttccaattggtacattctcggcaaacccttgcccacaatttcctcaggaagcctctgtggctatca

SEQ ID NO: 674216 - DNA, 125 bp, Homo sapiens
  misc_feature (25)..(25): n is a, c, g, or t
ccaggctttcatgccgccagtttgnttcattgtactgacaacctcagctggcatcatggaccatgaagaagcaagacgaaaacacacaggaagtaaaaccttttatttttggcatgataagctct

SEQ ID NO: 674217 - DNA, 488 bp, Homo sapiens
ggtggcgacgggggtctcatgggtatctagtttcagttttggggaggaacctccatactggttttccataatgggctatactaatttatatccccaccaataataaacaggggttcccatttctctacttccttgccgacacttgattttctggttttttggataacagttattctgacagatgtgaggtgacatctcataggggtttggatttacattttcctgataagtgatgtggaacatctggttcatataccagtgggccacctggtatgtcttcttgggaaaaatgtctatgcagatccttggctcatttttaaatcaagttattcattggctggctaatggagttggcattccatatatatttaagatatggaccatttttcagatgtatagttggcaaatattctcccccattccatgggcggtctcttcactcggcggatggtttccttggtggtacagaaggtttaagttaattaaac

SEQ ID NO: 674218 - DNA, 1558 bp, Homo sapiens
gctctgtcgtgacgttggtgtgacctattgtgcgtttgctggtttgcatactatcttgatggtagcaatcgtcactgtctgtgtcgaacgtctctgttctgtcgtgcgattgtagttgtacgtccttttcttggtttattactttacgtcgttcgtgctgttgtgtaacttgtgtatttgagtcggtttctattgctgtcgtctcgttgcttgtgtcatgggttgttctctttcttgtcttcgtcatgtaccctctgtttgtggtccccctacgttctctgggtgtggcatgtgtggtcttgctgtcaatttgtgggtatcctcctccctcgtgggttttacctcgttgtttctttctatgtgtatatcgttcgtgtaagccattgattggatctcttcatgtggtttttatcgacattatgtgaaatcttgtccgatcccagggatgccaggttgcccgttttggaccgatataatgtggcctaagatttattgcaggtgaatgttgttgcccgtgtactcacctggctcgagtggtcttgtttttgttccgcctatataattcaaggtgggtattaagttgggggggcccaagtgtggtatgatgcatatggcaatcgggcacaccaaaggatggcctggcccaagtttggcaactatgtgtgcatagaagttacttcaatgtgattggtggctcgaaaccttatgttaggcaatatggctgccatggcatggctcttttttgtcattcagtgatgttccatgggcaaccctttgggtgatcccttgccgttggccgaattgtccctttgtagggtctctatcctgtaagtgttgcccaattaatggtatatccctcgtattgcacgggcttcgattctcacgtgtcgttgtaacgtaatgggatgtctatataccagtgtctttcagatggggtcttttcgcgttgacaatcttctcatagacacactatgactatgtcgcgtatgacaggtgcacgcatctgttgtagtttggtatgtggtgagtggaacagttcatcacttggtagagccaagcttcgctgccaatgaatgctcctggtcaccggctgactaataggtcccatggaggaggctccataacacggtggccattaggagtgacgattggttgctagcaccagaataggctggaaccagggccttcacccagtgttctcccctggtacctatgctggaaatgttgcgcagccctgtaagtgctccctgcattttgcatatctggggtgagcaaggagagacatgtcattgacgaactaccatgataccaccgagaggattgggatctggagctcacgacaaggaatcccctaacccttgtggagagcttcgtggatgtggaggacattgggttcccatggtgcaataaggttctagactttaaaatttgacataagagtggagaatagggcgtgtgtggctacagcctgtggtcccagcactttgggaggcaaaggcgggcggatcacgagatcaggagtgtaaaaccccgcggtccaatatggaagctgtttctt

SEQ ID NO: 674219 - DNA, 449 bp, Homo sapiens
agcgctgagcattacgccggccgttggtggctggcaggacacgtggaataacaagacgctgaatctggggtgcttgggtccgtaggtttcttaccttcttaatttaagggctttcttacaacatacgggcggacatcatcttctttagaagagatggaaaagttggcggattctggctagctctttgggggcccaggcggcgaggcacggtagtatcagtcagtccaggaatatccttctctcctttttttacaataaccaagtggagaacgctcagattggcttccacggtggcaaccacgaacggatttcctctttctttctccagtcctcctgggtctgtaccaggaatgccccttactcagtagcaggcggacacggccatgggtcaagacacccggcttcatggggaaacctggtttggtatggctcagcgctgggtaccgagc

SEQ ID NO: 674220 - DNA, 477 bp, Homo sapiens
  misc_feature (460)..(460): n is a, c, g, or t
aattattggtgatttttcataatcgatgtggtctactaagaaagataacaatttgtgctaaaatgcccatgtttacctgtattgaccaaagctttcagttgttcttcattctgtgctcaggattgaaatgctgcgtagacgttgtgttgttagtgctgggcacggattctgggacggtgagctgttgatttcctaacagaaagatattttgatctattttcctatggaattgtttctattattatcttttaatttctttttttatttaatagtaatagctcctttctccttcctctgatttttatatgctgctaaatatattttaaatatactgtgtttgcacacactggtagctatgtgtttgcacacattggtagactgttatcatttgtggtgggaaccatgtaaataagtagactgtaaagagagactatcttgcattatgactgtatgaatttcnaagtgctgtttgattgg

SEQ ID NO: 674221 - DNA, 154 bp, Homo sapiens
tcggcccttgttatgggcccgaaatttcccatgctatttacctctcacacaggcacagcctccctcatcatcagcatcccccaccagagtggtatgtttgttacagttgatgagccgacattgacacatcatcacctaaagtccatacgtttac

SEQ ID NO: 674222 - DNA, 788 bp, Homo sapiens
  misc_feature (405)..(405): n is a, c, g, or t
  misc_feature (432)..(432): n is a, c, g, or t
  misc_feature (434)..(434): n is a, c, g, or t
  misc_feature (444)..(444): n is a, c, g, or t
  misc_feature (538)..(538): n is a, c, g, or t
  misc_feature (581)..(581): n is a, c, g, or t
  misc_feature (589)..(589): n is a, c, g, or t
aaatcactttgattttagcgctagtgatgaggaacagtaaacgtagatgttgccatccatgtcctgccgacaaatgcatcatagcaaaagtttttctggtcatacacaaatcaaaagctgggacatgaagccattagcagaagtgtagaagggacctcaaattcagctggaaaagttgcccccattcaacttgcaatttagtagtactggaaacatttgtcacccctgagcagaaagatcattctccactgtggcagaggtggaggggaccatccttgtgttttgtttggagaagacagaatatcttcccccaaattgggcagtgattcttttgtaaatttagtctctttcaaagtaggttgaggagcctgctcgtttaattactggatggtgcaattaaaaagnaatctgctaaagagatctaaaatggtntntatcaagttntctttcttagtgtcttcatcctgagcaatgagcaatgtttgaagtcctcaataggccactgccctggaccctttcattgtttcaattggttgancctaagtgtaccagctctctgggtctgggcagccacttttttnttcttttngagacagagtctcgccctgggcaacagagtgaaggcttcatatcaaacaaaaaaagataaaaataagacatataaattttatttctcaacataagcttcatcaagttcgagacacttttgtaagtaatgataacaaacatttagtccatcctcaaagaactgagggtcctaagaagttaaccatgtaaatgcaggacat

SEQ ID NO: 674223 - DNA, 521 bp, Homo sapiens
  misc_feature (13)..(14): n is a, c, g, or t
  misc_feature (17)..(17): n is a, c, g, or t
  misc_feature (446)..(446): n is a, c, g, or t
  misc_feature (514)..(514): n is a, c, g, or t
  misc_feature (521)..(521): n is a, c, g, or t
ttttgagacgganngcntctgtcgcccaggctgcagtgcagtggtgtgatctcagctcactgtcacctctgcctcccgggttcaagagattctcatgtttcagcctcctgagtagctgggactacaggcatctgccaccatgcccagctaatttttgtatttttagtagacatggggtttcatcatgttggccaggctggtctcgaactcctggcctcaagtgatccacccacctcggcctcccaaagtgctggaattacaagtgtgaggcccctgtgccggctggttttgtgcctttaactaatctctctggcactagagctttgaaggctggaggcagtggagcatgcagagacctgggaagggcgcccggcgtgggcaccacctgtgccaaggccctgaagggttgcacgtgggggtgctgggaaggccaaggtgcttcgaanccaaggggtggggcaaggcaagcgtcaagagccctgggggttcgtgttcccagcgtaaggcctgaganaagattn

SEQ ID NO: 674224 - DNA, 939 bp, Homo sapiens
gcttagaatcattgcttggactgagtccagacaattcccttatgatgaccctagcttacgagtaaagtccatgaaagacttattatacagatcagtaggaaaatgtaaacatgttaggttcgttactcaaatgtgtcagccagactttgagaatacttcagtgcagaaggttccggagccttatcattgagagcgtagtgatgtgatgcaacagatgaccgtaatcgtcgtaggaacaggatgtgtgtgtgacgctgtttcatggagaacagcggtgcaagggccagactggtgctggtgaacggcacgttgttcattggggacggtgtgagcggttcctggtatcagggcgtgggagggctatccttctccgtgggagtctcatcgtgcctagtgtcatgcttgtgtgcccgtcattggggcctctcctgacagtgccctttgtagcggctgaaatgcctgtccctggctagagaccctcgtggcgatatgagctttgaccaagctctgctccggcagttagcagagcctaagactaggatctggggttgggagtcgagttctggatagggttagtcaccagggctggaattgataggccagttattcaaaatttagtgatccatttattttgctactcgagtatgagaatgtagttgggaccaccgaaatgagggcatcattgggaagagtaaagggactgggtagcttgtgcccgggattgtacgaagaagcaggaagtagaagaggccaagagaggagatagccggaagaaaccggtggcctacacccagatggcggtaatttgtaattccccctaatcagagaaggcccccagaaagaatgggaggggagaactactacaactcgaacacgaagagaaaagagaagggagaagacccgcagaacgggaaattggcccgggctaacgggcaacaa

SEQ ID NO: 674225 - DNA, 906 bp, Homo sapiens
cggacgcgtgtgacccaggtttggtagtcacttgactgtgtttatgccatttacagtgaaatagaacttggacagatagaaaataaagattaggtacatatgactggcaacctgaataagagttgggatgcttcgggtatatcacccgcctgtgaggttattgtgactctcctaagtatatatagttgtacacgatactatagtgtaaacaggaatctgcgaaacccatttaggttatctcttgaggtaagctctgatttagcatgtaatcctgataaaatctattacatcatgggatactatataaagcagacttaattctagtgcgtgttagtcattcaatagatctcgaatgttgactcgaatgtctataaaattgtgaggtccggcctttgttcaacattccagtgttcactgcctctggccattgcctttaacaaggcaccgggttacttcatcagctccttacacactaaaagtgctgtttattgtgcatcaagctacacaaataggcccgctgcgtaacgtgagtgctagatactctactagacttactcccccatcgctggatacggaaccctcaagaaggtacaggcgctgacgtgtccgataatactgccctcccttcatccctagtgagagtctgctacccctataagcacaggaattcctataccaggaaacaaagagcctgctcgataccaacccgtaaagtagggacaaccatgcaccacggctacgtggcataactaacctttacacctgccctgctccggccactgcccccgttgccgcccaataaaccccctgacacatactggccacgagtcttcccttcttccgcacaccaattcggctagcggctggctaaccttccccgcctcccctgctcaaacaacaccctcc

SEQ ID NO: 674226 - DNA, 140 bp, Homo sapiens
tgtgctttgggacgggcgtacgtgcttgataatcaccaggtattctatttcttttggaagaggtccaatcttccggccggaagataggacctctccggaagattgtgactccccggaagattggacctccccgggaagat

SEQ ID NO: 674227 - DNA, 240 bp, Homo sapiens
gagacgtgtcaacatttttggtgaagacttgaaagacttcttaagagaaatatgaagggcactgtatcctgaaaagccatacaaaggatcggggtttagatgtatacacataggggagaaagtggaccagtgattgaccagcatccaaggagagtggtttggcacatagatgatgtgcgtggcattctcacacaggactctgagtgtttggatcgacccatttgaggtctctcaccacat

SEQ ID NO: 674228 - DNA, 138 bp, Homo sapiens
  misc_feature (1)..(1): n is a, c, g, or t
nggtggtgatctagaggatcccaatgacatcaagatttggcacaatctggtcagagtctagctgtcctatctttcataaacaataaaaatgcagcatcttaaggttgccatggagtggcagccatggagtaaatggca

SEQ ID NO: 674229 - DNA, 880 bp, Homo sapiens
  misc_feature (24)..(24): n is a, c, g, or t
  misc_feature (63)..(63): n is a, c, g, or t
  misc_feature (76)..(76): n is a, c, g, or t
  misc_feature (78)..(78): n is a, c, g, or t
  misc_feature (87)..(87): n is a, c, g, or t
  misc_feature (218)..(218): n is a, c, g, or t
  misc_feature (230)..(230): n is a, c, g, or t
  misc_feature (242)..(242): n is a, c, g, or t
  misc_feature (252)..(252): n is a, c, g, or t
  misc_feature (258)..(258): n is a, c, g, or t
  misc_feature (264)..(264): n is a, c, g, or t
  misc_feature (267)..(267): n is a, c, g, or t
  misc_feature (270)..(270): n is a, c, g, or t
  misc_feature (278)..(279): n is a, c, g, or t
  misc_feature (433)..(433): n is a, c, g, or t
  misc_feature (462)..(462): n is a, c, g, or t
  misc_feature (481)..(481): n is a, c, g, or t
  misc_feature (490)..(490): n is a, c, g, or t
  misc_feature (495)..(495): n is a, c, g, or t
  misc_feature (500)..(501): n is a, c, g, or t
  misc_feature (504)..(504): n is a, c, g, or t
  misc_feature (506)..(506): n is a, c, g, or t
  misc_feature (537)..(538): n is a, c, g, or t
  misc_feature (552)..(552): n is a, c, g, or t
  misc_feature (569)..(569): n is a, c, g, or t
  misc_feature (592)..(592): n is a, c, g, or t
  misc_feature (607)..(607): n is a, c, g, or t
  misc_feature (625)..(625): n is a, c, g, or t
  misc_feature (679)..(679): n is a, c, g, or t
  misc_feature (687)..(687): n is a, c, g, or t
  misc_feature (689)..(691): n is a, c, g, or t
  misc_feature (712)..(712): n is a, c, g, or t
  misc_feature (734)..(734): n is a, c, g, or t
  misc_feature (794)..(794): n is a, c, g, or t
  misc_feature (796)..(796): n is a, c, g, or t
  misc_feature (811)..(811): n is a, c, g, or t
  misc_feature (853)..(853): n is a, c, g, or t
acataacacacgctcttaggccantttaggtgatgggcaagtcagaaaagtcatgatggatanaactgatatcaanantccaaagcnaaagaagaaacagacgatggactccactggagatcagacctctcggtccttgtcctgctcactcaccatcataagctagtgacaaatgatacgcactctatgcaacctacgatgatggtaatttgcaagtnatcagactgcanaaaatcagctgntcgactgatncaaaanatggangcnacnactgagcnntgtacagactattttcaaatatgcttgcggaggctaggttgaaacgtaatgtcattcccgagacacagactacccgttacggcaaacttatgacattttaagagatgaactaaaagatcgtatttgaaagatgtccttcaagaacacaaaaaantgaaaatatagtagcagtgcagaaagcanaaagcattgtacaggtctngtataaatnaatcngcaannganancagaagtggagacctctactcaaactgttannagacatatatgggnggccaatagaaccaganaactgggagcaaaatatggtgcntcttggacagctganaaagctattgcacaactnaattctaaatatgggaaaaaagtccttattaatttgtttgttggcactgatganaaaaaaanannnaatcatgtaattcatattgancaacctcgacttggcctccctntctagagattactatgaatgcactggaatctataaagaggcttgtacagcatatgtggantntatgatttctgtggncagattgattcgtcaggagaaagattgccatcgatgaaaacngcttgctttggaatgataaagtatgga

SEQ ID NO: 674230 - DNA, 202 bp, Homo sapiens
  misc_feature (89)..(89): n is a, c, g, or t
  misc_feature (123)..(123): n is a, c, g, or t
  misc_feature (189)..(189): n is a, c, g, or t
  misc_feature (199)..(199): n is a, c, g, or t
actcagaagtgcctagctgccactccatttatatgaggcaagacggcttcctggctcatcccagcagaacagaaggctgtatgtttganaagggccccaggcagttttatgatgacacctgtnttgtcccagaaaacttcgatggagacataaaaacaagagcccggactgtatcgggaaggacccacntaccaaaggngag

SEQ ID NO: 674231 - DNA, 138 bp, Homo sapiens
agcagtcgttcgatgagcagaggtggtgaggctgatggggttactgattacagaacaggctcgtctagagggatatgaagcatcgcacaggtccttagagcttcatgcgggggctcgtagctgttctggcgagcagtt

SEQ ID NO: 674232 - DNA, 934 bp, Homo sapiens
  misc_feature (142)..(142): n is a, c, g, or t
  misc_feature (171)..(171): n is a, c, g, or t
  misc_feature (186)..(186): n is a, c, g, or t
  misc_feature (202)..(202): n is a, c, g, or t
  misc_feature (207)..(207): n is a, c, g, or t
  misc_feature (209)..(209): n is a, c, g, or t
  misc_feature (218)..(218): n is a, c, g, or t
  misc_feature (263)..(263): n is a, c, g, or t
  misc_feature (275)..(275): n is a, c, g, or t
  misc_feature (311)..(311): n is a, c, g, or t
  misc_feature (343)..(344): n is a, c, g, or t
  misc_feature (390)..(390): n is a, c, g, or t
tttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgnccatgtcgggctgtgggaggctgatcagngcgtgtgagagtggnttcccttctgcctgantcccnantccctgacntgccccttccttgtttttcctcctactggtctccaccaaggcttngttagcccccancctgcctggtgtgcagctaacccctcccatccccanagccagaggaggccacagacccctcaggggannttccgcgctggtgtctgggctgtgctccctcactaaagggaagganaggaagctgggcgtccatccgggccccccaacacacagtcccatttagaccactgaacagcggtctccttccccataagccagcacatgctgcctccctgagagacccgggcaaggaggcatgcctggatggaggcccgagacaatggcgcctgtgctgaggatttgtgctgtgatatggggcaactcattccaggtcttagggcccttcaccccccttggtctcctaagttggggaccactatcgacgatcccacaaagacaccacagagggccttgcgccactcagggtgccacacataacaacccataaggggaaatggacacagacctgaggcatatccacactaaaaaggttaggacccttaagaggttcgaaggcgacataaaggcaaaccggcgaaagatccctcagggcaacttggacacaccccaaggtgcgacaaatcgcgaggaacccatccatacgccccgcaagtggccgatactcgcccatgaccataagatgaaaccaagcgtggaacggggaatcccactcacatccc

SEQ ID NO: 674233 - DNA, 150 bp, Homo sapiens
gtgttgcccaggctggtcttgaactcacagagtcaagtgatcctcccgcctcagcctcgcaaagtgttgggattacagatatgagccaccatgctgggcctgaaacatagtatcctgcaaatttgtttgttacagcaacacttgtcattg

SEQ ID NO: 674234 - DNA, 614 bp, Homo sapiens
ggtgcatctgaccccaaaaggttaagcttccatcagagtggtgaagtggccagtgtgtggcgtgagtcccagcagtggacagcacacgaagtggagaatctggttgggatggctccggggagagaaaagtggttgtggtggacaggagcagggtgccctgagcgacggctccgtctaggggttagagggcctctcccttctagcaatctgaaatacagtaggggtgtcttgcgtgttgacgacgctgcagagggacgaagtgatgagtcgagtgggacacgcatcgaaggggtcgccagtggtgggacccggagcgcccttactcgagccaccatcgtacaaaagttgcttggtccgcgggcgcgctcacgccggtcggcgactttgctacgtaggacaaacagagaacacagaacgcacacagagaacgaacaagcgcagaaggacaatacagccagaagagcacagagggcgagcgcaagcggccgcgagagacgagcccggaccaacagcgcacaggagaggaggaagcaccgaacggcaagagaagcacaccgaacaggacaaccaaaggcgaccacgcgaacgacacaacgagaggaagctgacgagaa

SEQ ID NO: 674235 - DNA, 395 bp, Homo sapiens
atgtgaggtagtcatactttcattattctgcaggtacatgtgcaggggctcagcctctgggcgcagtaactcagctactatttgtggctttcttcatggcttgttttgtgggctgcgacgcccatctttatcaccagaattaggaattcatggtagttatctgcaccatcagtgttgacatccaactctttgaagcacatgtctgcaccgtttttcctgatataggaggacactcggtctctagcaatttcttcaggtcatccgttgtagacggcatggatattcccctttatcagggagtatttgtggcatccgtggatgatagagctaaaggctttatccagatcggtcaaagcacgctcccgggcatgccccatcaggtattcggtcgacgc

SEQ ID NO: 674236 - DNA, 499 bp, Homo sapiens
ggagtccccggtctgcggaatttgcccataaacaaaagccccgcactggtgaggtgcggggcttttgcgtttaatgagggctcaatgcgcctgcgccaggatctgggcaagcccaagcttgtcccggcagaccttgacgagatcccgccggaccgttgcgcccgctgcgttgacgatcagcgtcttggacttgtccttattgatccgcgcagtgacgaacggcgcgaacagctcgccgtcccgtcgccaatccagacgcgcaatggcggcggcgaacttgttgacgtcggccggtcctttgcggagcttgaacgccatgtcatggtagaggatgccgatgacctgccagcccggcgatgacagatgcatgttgcttctgtcatcccatagtggaccgaaggcagcggcgagcgcatccaaaaactcggcgatgttggaacgaatttccggtgcccgctgcaccgtcagattcggacgctcgatcgtagcgttgcggccg

SEQ ID NO: 674237 - DNA, 147 bp, Homo sapiens
gcagagcttaaattatattgaactatttcatcagaatcatcttattgtgaaggttcctccctatcatgacccacatatatctctgcctgtgatcagtgggatatatgtggtgacaatgctggaggtctctggtgtccaccttccctt

SEQ ID NO: 674238 - DNA, 143 bp, Homo sapiens
  misc_feature (9)..(9): n is a, c, g, or t
  misc_feature (11)..(11): n is a, c, g, or t
  misc_feature (62)..(63): n is a, c, g, or t
agtaacggnanggcgatcatctccaataatgtacatcctagccaccaacggggtgatccacnncattgatgagctactcatcccagactcagccaagacactatttgaattggctgcggagtctgatgtgtccacagcctgca

SEQ ID NO: 674239 - DNA, 392 bp, Homo sapiens
  misc_feature (1)..(1): n is a, c, g, or t
  misc_feature (185)..(185): n is a, c, g, or t
  misc_feature (291)..(291): n is a, c, g, or t
  misc_feature (359)..(359): n is a, c, g, or t
  misc_feature (368)..(368): n is a, c, g, or t
  misc_feature (389)..(389): n is a, c, g, or t
natcacttcacccgtcgttacgtcgaccggctccgcttcaacacattgcaccgcaagaaccccgacttcaaatgcagcttatccgccagcgccttcgcccacttcgacccccgaaacgccttgaacaaccccttcgccgcagccgtcatgttcatgatcggcggcccgccaccagcaccggccgncctgccgaaatcggaacgattcaccgaactgggcatcgacggataagtccgatccgtatgcgcgctgttatgcggaggcggctccatcccgatcgaccagcaactnaacgcctccagcgccatgttacgacatcggatcattgttgggcgagcactgtctttgctggcccatgnaacgatttncccgttcgtttcgaaggtttnaaa

SEQ ID NO: 674240 - DNA, 1267 bp, Homo sapiens
gggttgcatattagaagccactatggatgtgccggatctctatgggggtatattaaaatggcccgcaattagggcacccccccgctttgtttgacgctatattccataaccaacggtgggctgctccgacaaatgatccggtcgttaccacaactcacggtgaatactggtgcgggatatgacgccgcttttcttacataattcttcccggggggtatcatcgggtcaccaacacaaagtgggggaaataatatgtgccacaaaactttttgcttgggtaataaacagtgtactacagatgccccgccgcgcgtgctcgttgttccaccggaaagcgcaatggtgactttccccccgaagttagtttctgtgaacatgtcttttttatggcgtctgacacgaggggggatttccgcccgggtcgcccgcgtatgttaagatatatatatggaggcaggcatattgtgtaacagaacatgggcgcgtgccaaattgtcaatgggggggatttgaatgggcttttcttgggagtgttcgccctctctcaacccagaaagtacaggtaagggtgtctctaggtccccgagcccccactaggtttatcgtgtaaagtatctggggggacaatagcccgggggagaccaaagagtttccccgaagccgttcttttggataaggagttttttccgccacaatctgcgcacttgtttctcacaggatcatagggcggccccggcccacacatggggttctctccacactggctatagccccctctgctgtgccgcttctacgccagagggttgtccccgcgtttctctctgagacctagcgcagcccatacgtgtatggcccaccagcgcacccaggttccccggcgctgatttcagccccttccacgccttttccccttgggacgtctctcttttttaagccaaggtgcccctgcacaggccgggtttttccccccagggctgcgccccctttccaagaggcccctggagcaatccccaggactgggccacacgggtttctccatagacagcctgggggcaacgtttgcacgcttattctccgcagccgttcctgtaatggggtggcctggcccccttccttcttgcgtttataggatgcccctttattgatgcccctgagtcctccatccccgggacccccccgggctccgggccagcccccagggaggttgtggacgggctgtaattgataagaattgattattgggaatttaattggggacagacttcca

SEQ ID NO: 674241 - DNA, 600 bp, Homo sapiens
gccgggcgtggtggctcacgcctgtaatcccagcactttgggaggcagaggcaggcggatcagttgaggtcaggagttcgagacaagcctggctaacacagtaaaaccccgtctgtactgaaaatacaaaaaattagctgggtgtggtggcaggtgcctgtagtcccagctacttgggaggctgaggcaggagaatggtgtgaacccaggaggcggagcttgcagtgagccaagatcgcgccactgcactccagcctgggtggcagagcgagactccatctcaaaaaaaaaaaaaaaaaaaaaaaaaaaaaaaaaaaaaaaggataaaaaaaaaaaaaaaaaaaaaaaaaaaaaaaaaaaaaaaaaaaaaaaaacaaaaaaaaaaaaaaaaaaaaaaaaaaaaaaaaaaaaaaacataaaaaaaaaaaaaaaaaaaaaaaaaaaacaaaattgtggtccttttggcaatattccctatttgggaagggcttctataataatctggcttctttttaaaaaaactctgtctgggaaaacctttgtgtttcctccttttatagtgtggtaaataaaattctttttgcaaatttttttatcggc

SEQ ID NO: 674242 - DNA, 412 bp, Homo sapiens
cctacaggatccccagcaagaatggcattagagtttacttaaaaaacatcatggtactgagtcagagctttggctaggaatgatttggaaaagaactgaaggcattattccacaggacattcacacgttgtgtgctagcagacagagaggagcaggaaagtgttttataagcatttgcggtgtaccatgcaaggcccggcttcatcgtattcctgtttgctgatccacatctgctgcaatgtggaccgagaggccaggatggagccaccgatccagactgagtatttgcgctccggaggggcaattatcttgatcttcattgtgctgggtgctagggccgttatttccttctgcattctgtcggcaatgccaggtttcattgtgatgcccctctgatatgccattcttgctg

SEQ ID NO: 674243 - DNA, 287 bp, Homo sapiens
  misc_feature (151)..(151): n is a, c, g, or t
ggggggggggggttccccccccccggttttttccttgggtttttggcccccccaagaaagaaaacggccccccccccgggccccccctgccccccccccccaagggggggcctgggggggcccccccccctttcccaagcttggggggggnggctttggggcggggaattatgggaaaagggggggcccccccgggggtttccccccccccccttgggccggcccggggggccgggggtttggctcggttttatactggggcccaaaaaggttttttttgggcccca

SEQ ID NO: 674244 - DNA, 206 bp, Homo sapiens
gtggcagtgggggcgccatcggcgacgtgggcatttggtgggcgacgattgagcccaccgaccgatccgtcagtggccgctgccccagggcatggggtctgcctgggggtgctgggacctctcctgacagccccctggtctgacagttgtgctgctgaaagtgcggctatggacgggcgcggggaccggtgggccgggcctcgggc

SEQ ID NO: 674245 - DNA, 738 bp, Homo sapiens
tcaggtaatggcagggcacaggtttggtggctggagaggttgtgaggtggatgcgctgccgtatttcgatcaaggttatgaagcccctggtgtgctggtgaagcggatgtagtcgctggtggaggaggaaactcgcagataccgacactaactaagaactacctgagctacctgacaggcccggattattgctgcctttgaaacatggacataatgagaaatatgaatttgatagactggctgctcgacaaacaattgaatgctcagtatggaaacgatcatcgagcttccagcccccctcctctggtcgagaaaaatgacattaatgcatggcgaagaaatgtgtagatacaattcatatggcccaattagagcatcaagcagtaagaattgataattctggaaataatgtacagagaatggatgtgattgactggaaagtataaatgagaatctagttcatactgattgatcgaccgacacagaaggaacctccagcagaggtaagaaaaaccatattcaagatgcagaagtggcacgaaaaagaacatggaactcaccggtggaatctacattgagaagaccgtggaggtcctgatgggtatcctggtccagtacgaattatgaacatgacggactactgttcacgctggaagatgaactcttccacttagcatgcacaatggcaggcacgcacgaaacttcgggaaagagtctgacagacatagccgtcgacaa

SEQ ID NO: 674246 - DNA, 159 bp, Homo sapiens
ggattagacagtcgaagggaatgtccgggctccagccgtccagcatgtctcagcccaacaaggacagtggagtggaggggaagggaagtcatactaaagagtccaaagtcagtagcgccacatctggtttataaagtaagagatccagtgggcacaatg

SEQ ID NO: 674247 - DNA, 837 bp, Homo sapiens
  misc_feature (11)..(11): n is a, c, g, or t
  misc_feature (61)..(61): n is a, c, g, or t
  misc_feature (67)..(67): n is a, c, g, or t
  misc_feature (73)..(73): n is a, c, g, or t
  misc_feature (82)..(82): n is a, c, g, or t
  misc_feature (92)..(93): n is a, c, g, or t
  misc_feature (102)..(102): n is a, c, g, or t
  misc_feature (112)..(112): n is a, c, g, or t
  misc_feature (114)..(114): n is a, c, g, or t
  misc_feature (120)..(121): n is a, c, g, or t
  misc_feature (154)..(154): n is a, c, g, or t
  misc_feature (163)..(163): n is a, c, g, or t
  misc_feature (182)..(182): n is a, c, g, or t
  misc_feature (199)..(199): n is a, c, g, or t
  misc_feature (205)..(205): n is a, c, g, or t
  misc_feature (212)..(212): n is a, c, g, or t
  misc_feature (231)..(232): n is a, c, g, or t
  misc_feature (239)..(239): n is a, c, g, or t
  misc_feature (252)..(252): n is a, c, g, or t
  misc_feature (259)..(259): n is a, c, g, or t
  misc_feature (265)..(265): n is a, c, g, or t
  misc_feature (268)..(268): n is a, c, g, or t
  misc_feature (300)..(300): n is a, c, g, or t
  misc_feature (342)..(342): n is a, c, g, or t
  misc_feature (351)..(351): n is a, c, g, or t
  misc_feature (427)..(427): n is a, c, g, or t
  misc_feature (439)..(439): n is a, c, g, or t
  misc_feature (443)..(443): n is a, c, g, or t
  misc_feature (592)..(592): n is a, c, g, or t
  misc_feature (825)..(825): n is a, c, g, or t
gctcgcctggncgtagacatcctccacaggaacagtgaggaaagctgggcgctggcttccncctggncctggnacggggggnggtgggaacnnacccctgcnctgcctcaancnctctgnncagccagctagcccggcgcgacccgctggcagncgctgagtnggaaggggggggggggggngatgaaggtggggtgtngttgtnggcctangcatccccgttctccatgnngcccagntgctcctccaggngggaganggggtngcnctggtccttgaccagggccctcagggcccggngctcctgcatcacctcctccagcttcccagcctccccggctntggccaggntgccgctgggggtggcatcagcagcagtggtggtggaggcgggggcccctaggtgggaggagcccggggccatggngggcgggctgtnaganaacacgttgcgccggctgatcttcaggtcccgctgcttgctgggcacgtaggcctcccgcagtgagatgaggatcgggtcggcatcccgcccgctcacccactcctcagcctccagggctgcctcgggcccggctgtgtcggggtacanatcatcctggaagaggtccgactttcttggcacagtcatgacgatgggctcacacttgcgctcatgcagtttgtagaaccgggcgatctcgcacttgctgacctccaggccccgcttgggcatgctgcccataccccgctgcggctccttgctggtgaacgtgttcaggaagtggatgtagggaggctcctctgtgatctcaaagtaccggatgctggagtcacccttgccgnagacgtagacca

SEQ ID NO: 674248 - DNA, 770 bp, Homo sapiens
gggctgtctcctcaggagatcgcgtggttagtgagctagggttggggatttctcatcaaattagaaaacgcgctggtggctaaacgagctgatgccatgtacacaaataccatgatggacgttatagagtgtcataaacttggatctatcaagcaaggagtccaatgcgagttccagatatgcaatagattacgcgccagtcacagtgaccatttctggagtttctgccataaccccactaagttgtctcgttaacagccaagttctcatggagtgtcccaagtgaagtggttggactttcttttcctttccaccattgggcacatttccacttcgtcccacatcttgcgcatgtaagaacatacagcatttgacataacttggaaaacatcctggatcttctgatgccaaacgggttacaagcttccttggatctcatttcagttgatataccagccactattttattctcgatcagtgagactttgggccacgtgtccagggtactgaccatcagtgtcagcattagggtataggttaagtatcttatgggtatttctttaatggcacatgtgaatcttgtaagtgtaaaatgaaattactttctcttgttcctctgatgatgggtctacaattcaaaagagacatccggatataggtatggggatgatccaggatcatgtgtgactgatacatattagtaccttgtgctataaaaaaaaatagaattttgtacaaggccaaaaaacaaagaacacaattaaaataac

SEQ ID NO: 674249 - DNA, 141 bp, Homo sapiens
atcccctgtgcattcgcaaggtccaagtacctgacgtagggtcacgtctccgataggtagctttttctatatcggtggttcatcttgcatatcctgcaccacgtccgctgccttacacccctcctcgcgcctgtccatatg

SEQ ID NO: 674250 - DNA, 244 bp, Homo sapiens
actacatacttccggggatgtatggatgttattggcatttttaagtgtttagagttttttggggttgggggagggttttttttcctggttttccttttttcctcttaatgggaggcactgacctggcccaggaaatgaagagattcttttttgaggctattaccaatgttatcataaggtgacggccacctgtaacaaaaaggtggcacgagacatgatcactgaggttttatttgcacctcaa

SEQ ID NO: 674251 - DNA, 240 bp, Homo sapiens
tgggttccaaaaaaaaaaaaaaaaaacttccggaaggcggcggtttttttttcccataaaattctattccaggatgtcatggttgcgggagggctcatatttattggtggttttggtttaggacccccctggttcataatatccagattactaaaaatggggggaagggcttttaatctttttttcataatatctttggcccctattacagaagaaataaatttctttcctttttattta

SEQ ID NO: 674252 - DNA, 821 bp, Homo sapiens
atgtggtggggctgcggagtcgccgatccgccggaagcgccagtgacaatggggacccgtgtgactgacgagtacgactacctattcaaagtggtgctcatcggggactcaggcgtgggcaagagcaactgctgtcgctgcttcaccctgcaactgatgttcaacactgtgagacgcaatgagcaaccattcggctgtggagttctgccacccgcagcatccagagtggactggcagagacccatcaaatgggccgccagaatcttgggacacctgctggccatggatgctgctacctgctgccatcacctcctgcgttaactaaccctggttggggatttggccaatcgttgggggggacctggccactttgacttggaggttggtaccacgaacaatttcagtacaaaaagacaaccctagacctatagagaacctgttgtgagcatgctaggcttgacacgcgagctcgctgggaacaccaaacggcaaaggaaacctatggcgaaagcaattacagggtcccaagttcctaaattgggcattggggtttgtggcaacacgaaaagggaaggtttgacaccttggtgtcccacaccttgatggggcgcttggttgcccctaacttgaacagaatgtgacccaggatggcacatattctagccatgaaaacaaaggatacaatagctttgtctcctttccaatcagaaggaaaacttctaaggaccctatgcggatttacaccaacttaaaccggtacgtagggaaacggcattacataggaaagctattcctacaacgaggaagaatactaaaccagg

SEQ ID NO: 674253 - DNA, 213 bp, Homo sapiens
caggagtttgggaccaggcctgggctatatagcaagaccccaatcactaccaatttttacaaattagctaggtgtggtggtgcgcacctggggtcccagctactcgggaggctgtggtgggaggattgcttgagtccaggaggttgaggctgcagtcagctcagattgcaccactgcactccagcctgggcaacagagcgagaccctgtctcc

SEQ ID NO: 674254 - DNA, 231 bp, Homo sapiens
cggtatgatacatatgaagccagtgatttacattcatcagatggttatgggcctgagtactgtcctttggacggggaacttacgagggatcgcattcgtgtcgcaagctctatcgcaagtacaacctttctgcaccggcgaccatgtccatggatccttccgatgaaggtgacgacgactcagatgatctaatgggggtcccgaggcgcgagttactcgctcaaatcttcg

SEQ ID NO: 674255 - DNA, 1023 bp, Homo sapiens
cagatcacaaggtcaagagatagagaccatcctggccaacaatggtgaaaccccgatctctactaataatacatagaaaagttaggctggtacgtgtgtagcgagcagcctgtaatcccagtctactcgggaggctgaggcgaggagaatcggcttgaacccaggaggctagaggttgcagtgaggccgacagcacgccatggcactccacgccgtggcagaacaagagaagagatctccggtacccaaaaaaataaatgataatgactaacaattaggaagccgggtgtggtggctcagcgccttataatccgcagcacttctgggaaggactagcggcaggtggactcacctgaaggatcagagacagttcacagggaccacgccctggcctacattagcagacacctcatcatctagctagacacacagtacaaaacatagttaggcctggcgcattggctggtgctactgcctactaagccccagcactactttcagcagcgctgacgcaccaggcaccagactcgctctgcccatcgcagcaacggcgcagcacatccgctcgcagacagccccagggatggcaacggccacacaaagcaactcaccatcccgccccgcgcgacccaccccgcgcactcacgcgcaccactccgaaccggcgccgcccgcgcgacccacagcgtgcacaaccacaccccacacacaccaccgcaacccgacccaagggtcccaaacacctcccacaagcggaccaaaccgaacccccacctggacggcccccgcaacccatccagcacaaccacccgccacacggaacaacaacttcccacgcacgcccacacacatcccacccaaccacccgaccccacacaccccacaccggccagccgccgcacacggctcacaacacccgccacgcatccgctgccgaacaccaccaggcacccagcccaacccaaccaccgcgcgacccgccgacccagcacatccacacccacacgcaccacagccggcacc

SEQ ID NO: 674256 - DNA, 478 bp, Homo sapiens
cgaccggtcctgtatggtaactccttacagatcaaactccctgttctactctttccccccttctcattaccacactaaactagtcttcaacacacacacacacacacacactctctctctctctctctctctctctctctctctctctctctctctctctctctgtctctctctctcttcctgcacccactccagggccaagatgatctgcagtggggaaattgtggcagtcaagggagagattctatcagtgctacatactctcttctaaacagcagtagtgggaggggaacctctctcaactctttttatagagccatctttccccctatatctaacccaagcaggggtcttataagaacagaactatacaaatcctatatccctcatgtatatatgtgtaaaaattcctcaacaatatattagccagagacactggaaaagtgggagttaacatggcagcgctggggggatcctc

SEQ ID NO: 674257 - DNA, 280 bp, Homo sapiens
ctggcagatgtggttcgcgctctcctccacgtgccgtgccattgccagcttagggcactgttggcagagccccaggccatgggggaagggaggagagttagtaggaacaagtccagggagaggggaggagtgggtacagggtggcgggcacctagctctgaaggagaaagacagagggcactaggaggctggagctggccagcagcgggaggactggaggcttcagagcagcagagcagggatcactaagggctgaggtctgaggcatatgggctggcat

SEQ ID NO: 674258 - DNA, 473 bp, Homo sapiens
tcctgtggtgctttgctggatgactagataatcagtaaagacagaattcaggaaatcgggattgacagatgtgtcatggcggaggagacgcacgattgaaagaatgccttgtgctaggccagtgctgagcattttctataagtcagttccccaagtcctctgaagaactcaaatccttcagcacatgtttgttccgcacaggttagcagtggtcacaggcaggccctgagggtggactgcctgcccaggttcctgtgctgtggctggcgctgggctttgctcagaggagtcaaggagaagtcacttggccccagctctaagaagacttgctgtccaggacaaagattgtcaagctgtttctctaaggttcatagtgagaaatccgttttatgttgcaacctgtaggaacacattagtcccacagtcagaagtaaaacatttcatctcaagaaaaaccagagaagacaaagaat

SEQ ID NO: 674259 - DNA, 711 bp, Homo sapiens
tgggccaaatctcgtggtgtttcgcagaaaaaaatccagaaaaatttcaaatgcagttgagtattcttttttaaatgcagattttcaaaacatatttttttccaggtggtctttttggtgtctggctttgctgagtgtaaaatgttggtttatctgggacgatctggtctctctggctccaaagaatatttgggagtgatgtgggcagtacctagcgccagcctcgcgggacactgtgttggtactataagcctctggcagtgctcctctggtcaactgggtgggggtattatctggctatggtttttattctacagacaaatataaccagcgaactatttatttaaagaagaggattcttactcaccgtgggaagccacatgtgacacccaactgagctctcaaggtgctctgaggattatttttacaagacagttaacaattatattgaggtggtcttgatgctgacaggtgcaaggacaagggggagcccaagggggtgtggttgggtgccctctgggtgtccccagggctatttggcccccggcgcgctcttgagaaaaatctgtggttgggggaaatattggctgcctgaggatctcctctgtggtgagaaagcgcgccacccacggccccaaaggtgtttttgtgggcgctctgagagggggggaagggcccttgtggcttgggggagaccctctgagaatatcg

SEQ ID NO: 674260 - DNA, 219 bp, Homo sapiens
cagtggctcacacctgtaatcccagcactttgaaggctgaggtgggaaaatcgcttgagctcaggagttcaagaccagcctgggcaatgcagcgagacattgtgtctacaaaaaaaatttaaaaattagccatgcattggtgacacgtgcctggagtcccagctactcaggatcaggaagccgaggtgggaggatgcttcagccaaggaagtcaaaact

SEQ ID NO: 674261 - DNA, 199 bp, Homo sapiens
cctaaatttcgacgtggaaaggagacagtgcggcagctgtcaccttagtcagtcacagcttaaggagaatagatggtagtagcaaagttgagcatcacttttagaaaggtggaggggtggtgaggggtgcttgcagcatgagaggcacagcagggcaatgctgcttaagtacctctcacatacaagtgagcaaatacat

SEQ ID NO: 674262 - DNA, 122 bp, Homo sapiens
cctgtatcatcactgagctgggctctcccctaactctcaggagaactatccttgccgtatgccttttccaacttcacctcatcgaggtaggtgattaatgatcccagtagtcactgatagtt

SEQ ID NO: 674263 - DNA, 366 bp, Homo sapiens
ggactcaagcaatcctcccacctcagcctccctagttgctgggaccacaggcgtgcaccaccacatttggctaatttttttatttttgtagagacaggggtcactgtgtcacccaggctgatctcaaactcctgggttcaagcaatcgcctacgttagcctcccaaagtgctgggattacatgcgtgagccactgcgccctgcctgtttgtagtaatttttaggcaccaaatctccctcatcttctagtgccattctcctttctgttcaggtaaatgtcacactgtgcccagaatggatgaccaggaaccttaaagagtggctgaaaagattgcagagttatcataataaattgctaacttgggta

SEQ ID NO: 674264 - DNA, 3033 bp, Homo sapiens
gcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgcctttttttttcttttgaaacagagtcttgctctgtcacccaggctggagtgcagtggcacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacgtttgccttccttttgacttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatcattattttgttttttgtgaaagcagggctgggtagtacaatataatgatgaaaacagtgagggtagtacaatatattcatttgtctgtgaatgcttcttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacatttgctattcagcaacaacattttccccggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctactttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggcaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaaacgctgaggctatttttagagccttcatctggttatagactagttggtaggagagcaatacctttgaaaagttaagaaatagttttatacactgtgttaaggatgttgtcaaaactaatactcgtgtatgcaaagactttaacatttattaataattttttctatagattggtgaaattggtttgtaatttttgtcatttcacttttgtggaaattgagcaaaggtgagagataaaatgatgtgatcaggctgggtgcgttggctcatgcctgtaatcccagcattttgggaggccaaggtgggcgcctgaggtctggagttcaagaccagcctggtcaacatggtgaagccctgtttctactaggaatacaaaaattggctgggcatggtggcacatgcctgtaatcctagctacttgggaggctgaagcaggagagtcgcttgaacttgggaggtggaggttgcagtgagacgagattgcgccattgcactccaggctgggcgacagagtgagactccatctcag

SEQ ID NO: 674265 - DNA, 531 bp, Homo sapiens
  misc_feature (494)..(494): n is a, c, g, or t
ggcacgagaagaaaatgaagagctctctgggttccaaaatgctgatgttgaatacatgatatatatgcacacatataggcacttgcatgttagcatgttcatgtctgtgactgtcttttgagttatataggagtggcagagattgtgtcactttaacttgttgtcgacttagcctgaaaaccttactagttcagaatcatactcctgactgtcttctggagcaacagggaactgcatggccaacttaaagtacttgttataaatgaaccagaaatctgattttaaaatacatttttcattttaattgtttttgcattttgttttgttaatccttaaaggatggattgtgcttttaagaatgtaagtgttatgtatttgtcatgaatcaacaaaacagcttttaaaaaagactaattggaacaagtgggtggcactggcttaatgctgttaatgtttctaaacgattttacatttagattatatatccggattcntattgagatacctcccaagcactggttttatagaaga

SEQ ID NO: 674266 - DNA, 152 bp, Homo sapiens
ggctccgtaacttattccttttgtgatctcctcatcgaagggcgccaatgtcgaaggcgtcgcaggtgtcagctcccctcttggggggatcagcgggggagggtacttcttgcaacatgaccatctgccattccagggagcggagcattccc

SEQ ID NO: 674267 - DNA, 951 bp, Homo sapiens
  misc_feature (631)..(631): n is a, c, g, or t
gtgtctgtcagagtcgtgctacttgccagacataaatgaatcgcattcggtgtggcccttagaaactataagtggtagagttggaacactgttgatggtgtgatgttttcccagtagacgtgtacacgctactatgagaacaacaacgtcctatatatacgtgcactactaatcgctaggggcattgttacaccgtagtctacatgggacccacgttagaacatggtaagcactataccatggggccttctctactgagagtttctgtgtccctcatgtccgtacatacgcgtgctcgtcaggtagagttttgaagaccctcttgtgagacggatagggtgaaaattgcaatagaatctctctctaaggggcggaatatctattctactggtaaagtccgcctagcgcttaggaacacggcggtcgttggagtcgttctctaggtgtctgtggacggaatagttcatcaagtggcgacatcacttatgctgccgttagtcgttacgtgatcctctctggaagtctgtgtgtcgttgggtgaacccaggcgacaaattaaccgtatgtagcgtgtctacggtggctaagaacttatcctagtatcggctatcgaccagcaactcctatcttntcacctgttgcataacgagtccagcaagtggcagattaagttgtactttagtactatgttctaatactcttggaactgtgtgtccgcgcttttgggaataagctggagtgccgcaataaccctagcgaggagcgagatagtttgattcgacgcgtaaccaaagtcgaccgctttttggagaccatcgagaccgaactcgtaccccccagaccggggcgctccgcggggactggggtcaactttggtgggttcgaaagacgaaagttgccgccaagaagggggtggccgtttttactaaacagctcgcttggtgatcttcg

SEQ ID NO: 674268 - DNA, 1226 bp, Homo sapiens
gccattcggaacctgaaaccctcatccccctgtgtgcagattcccataggccgagtaaggtaggttcttctcggagaccacaagcaggtgaggactgtggtcaacgcaatgacgcggtgcaaaagctgggtctggaccggtctctgttcgagcggtacccacgagggactgcgagcgatactgctggatcagctcatgttaccgcactgtcagtgaggggcactctgtgctcttcgcgccatctgctggcggttctaacaagaagcatagctgaacgactgtggcatggggcctgacgcgatggcactgatctcgagctcgtcgcgtgaggcccagcggctggggcaaagggaaggaagctaggccctggttcattctttggggcccaacggttttagagcgcccccaagagatccggggaagacaccgtgcttgaaggtgcgcatctgtgaacagagagggacaacagtggaaaaacttccgagggggcgaaacccctggggagtggcagggtggggtatgaaacgctcgcggattacacggattattccactgcgagggccaagcattgaacccgtttgggagagaaggctgaccccgtgtaagcacgccaaacccaaggggaaagcaattcggtccagttacccataggaggggcaacccataccacacaactggcgagcgaagggccccctttccttggacggcaacttctactcgcgcaaaagagacgcccggtaaccaggggggggaaagaaacggcgcgcctattagggccccacgagggaattgttagctccgtctagatacccaatagccgaaatccgaaagacaatagggaggccccaaggggtggaaaggccaggaaggtatgggccggcctaatagatatggcgtgcggcaggaaggacaagcgctgtatacccgggctaaacccttggttgagccccaacagaaaggccgaaactcctttggggatcctccaatactgggggtcgcaacccaaccagaaaggcgtagtaggctatcaatggaacaggtttttcgtggggagacatatcagcattggttggaaacccccctaaaatccaaaaagttgaaaccgatgtgggcctggttcacacagacgatggccccccaccgcgaggggggacatcctatgccctggactcggggagtaaacaagagcattacccttcgtgcagtacttgcgtggcccccccatt

SEQ ID NO: 674269 - DNA, 848 bp, Homo sapiens
tggggagtccctttgtggctgcaggctcataccatcctaactctgtaagcgactttgggtgataggagtctgtgattgtagggtctcccttgatctgagaaatggctacctctcgatatgagccagtggctgaaattggtgtcggtgcctatgggacagtgtacaaggcccgtgatccccacagtggccactttggtggccctcaagagttgttgaaagttccccaagtggaggagcaagggtggaggaggccttcccattcagcacagtttcggtgagggtggcttatacgtgaggcgacgtggaggctttggagcatcccaagtgtttgctccggctgaatggacgtcttgtgccaaattcccgaactgaccgggagaatcaggggtaacccgtggttgtttgagcttgttagaccaggacctagggacattttctggacaaggaacccccaccaggtttgccagccgaaacgatcagggatctgatgcgccagtttctaagaggcctagattcccttcatgccaatttgcactcgttcaccgagatctgaagccaagagaactttctggtgacaaggtggtggaccagtcaagctggctgaccttgggcctggccagaatctacgagctaccagttggcccttacaccccgtggttgtacacactctgggtaccagaggtcccgaagttcttctggagtccactttttgcacccctgtggacattgtgcagtgtcggctgtatcttggcgcagatgtttcgtcgaagggcctctcttctgtggaacctctgagccgactagtggggcaaatcttgacctgattgggtgctccgaggatcatgcct

SEQ ID NO: 674270 - DNA, 631 bp, Homo sapiens
ccgcgcgcgtacctgtagccatggaagataccgcccagtcagcccgcattaaggagtgcggcctctgcctgttagacgtggacgtaaccctcacgccggctcgacagatcgcagaggcggacggatatgactactgtaagatatctgagcagctgcctgacgacgatgaagtcattgacacgttggagtatgtgcttgacgagaacggcatagtgcgagataagtacggacgactgatgtccaagcagaccatccagaaccaactgctataccagcatcgtcaagagcttgaacatctgtgccttaattatgtgcatcttgataaccatgctgctcatcgtcataccagtgatgagcttccagatctaatgctggacatctagcaatacgtgcggacatgagctctggacatgagcagcgagctactgtactctagctacgattcatagcactgcgccagaagtcgagtcatgtcatgagcctatagtctgatacgctgttctacaatgtctatcaatagagagcacgagtttctggcgaatacccgagggctgggacaagcgctactgcatggatagcccggaccacgatgcttctataccgagcactattggtcttgctcgcccttgcg

SEQ ID NO: 674271 - DNA, 214 bp, Homo sapiens
accagttgggcttttggtcttcctctccccatgcaaactggtaaaaggcctcaggatttttgagttgtcctcagccccctcctcttgtttcattttaatacatgttttctaataacccagtttgtctcttcttactttcagaccatcaaactccaaatggtcatgcagccaaagtcttgaagtctcggacaatgaccccttctgtcgtcttcta

SEQ ID NO: 674272 - DNA, 275 bp, Homo sapiens
aatagaagttccatgaatactatgattgtaatgggcccttttggaactcttgtgggagagaaaccttatagatgcaatgaatattttaagccttcttttttgaagatatccctcgtttaccgtagagatctcacaagaagaatcattggccaggcgcattggcccatgcctgttgtctcagcactttggggggctgaggcgggcagatcacttgaggttgggagttcgggaccggcctggccagcgtggtgaagccctgtctctactaaaaatac

SEQ ID NO: 674273 - DNA, 123 bp, Homo sapiens
ccccgtactagctccgacagcccccgtactagcccgacagtccccgactagcccgacagtccccgactagcccgacagtccccgactagcccgacagtcctacttggataacacgttcgcgag

SEQ ID NO: 674274 - DNA, 373 bp, Homo sapiens
tgattacactgggggcaggtggctcatgagctcttgagttgtgctgggtcctgcgttcctcttcaccatacacaggcttctggctgcgcaggatggctgctgagcctgcgtgatggctagcatgcgcaagtctggggcggaacttgtacttgcttgatcatgtgtctgatgctgatgagcgtggcacgagcattcttgttgatggtggtcctgcacatattgaggtggcaggcttccagcatgagccgagatctccgcttaatgaccaccacgacacctttgccgtcggctgctggctccacagcccacagtcttagcggtagaatcagtccgttgtagcggaatggaattgcgggccttcaagttatatggg

SEQ ID NO: 674275 - DNA, 135 bp, Homo sapiens
cctgtgacaactcactctgggggcgggttacggagtgttccattagagcagctaggcatctggagataaacaggtagttcggttgatggtggagaaagacactgtcacggaccagccagtcacaagccagatcca

SEQ ID NO: 674276 - DNA, 625 bp, Homo sapiens
  misc_feature (481)..(481): n is a, c, g, or t
atgtgattgagaaagactgagtagctcaggcctaggcttagaattcgctgcgtttgtggaataaaagaacaaaatgatacattagcctgtcatatcaaaaacatataaagagagaaattatccctaagtcaagggcccccatacagaatacaatttcttattaagggtcattagatgtcgattgaatccttttcactagtgcagtatgcaaaaccaaaggtgaacaaacactgaagcacacgcaactctcacagcgacatattctgacccacgaatgatgccttgggctgggcaacacgattgcactgttgtggagacacttcggaacgtacatgtcggatgacgggacggagctgtccttggcacaggtcgagccaacgcattacaggatacctcctcttgaagacaggacatcactaagttctaatccacatacccacgacaggccttcacagcaaactgtccacacactctgcgccanggaactccatcaaactgcgttgtgctgtctagaaatagcaacattatccatggttgaacgagacaggcgccaatgatggtaccaaataaggccacgaccctcgctattattccggactgcgcgttacactaaatcgacatggtg

SEQ ID NO: 674277 - DNA, 106 bp, Homo sapiens
  misc_feature (59)..(59): n is a, c, g, or t
  misc_feature (75)..(75): n is a, c, g, or t
aactttgcaagaaataaatttttattttttttcattatcatacagcattcaagttttanttggcttttttgaggntccaaatctgagatatctatgttatttttat

SEQ ID NO: 674278 - DNA, 378 bp, Homo sapiens
gacggaactcatttacacatggatattataagtatcatcctggtatctgtgcttgataatgatcagattttgtgtagatattatgttcatatattaaattaaaatcccacatagtaaagttggtacaatttgtcctgaagctttgtgttctggctgcacctgcataagctgctacaaatagaataaagaatttcatagcctgtatctatcattaagatgcatggaaagaaatgggctttgcacacaatgggcttggcgctgactgggaacaatggaaaaaattacattagctgtggttgtaaagtttttttgtttttggtttagtttattttttcttttttcttttttttttttttcccatcttggtgaaacgcactt

SEQ ID NO: 674279 - DNA, 338 bp, Homo sapiens
ctttcattggcaaggccaaggtggaaggactgcttgaggccagtgagttcaagaccagtctgggcaacatagcaagatgctgtctcaatgacaataataatgatagtaaggagaagaaccagactaaagaacttgttgaaccaaatttaggagaaattgtatgagtttttttttgtgtgtgtttattttaatgcaacaacacatcaagcctagaaagtgacaatgaataaaaaaccttggcagggaaaaagagactgcaatcagatatagtggcgaacaaggtcaggactactgtaagagctaggaaggcactgtctctacagcaattgcaagacaat

SEQ ID NO: 674280 - DNA, 518 bp, Homo sapiens
aatactgcactatgagaaaaccaaaacttaccgctataatcaaaagcaaagtcaggaaactatttgagatttacatagattagggggagctggccaatgggttctagaattctttatagaaatctggacttttaaagaaaactgtgctgttcacttacatttacaactatttgactacttgggtgggcccctctctgaagataaattcatggagccacatatcctccaaatgtacataggttgtagatttcaagtggtgtaaaatgtcctagatccttatgaacttaaacacaatcacagatgttctggaatgagggaaaaagtcatgtttaaaaacgctagcaggtagagcagtcagtttaaaactaaatggagtcattttcaaaaactttcttgctttgttcttagcacctcattcccccccattccccttcctttaacaaaagaaaaaaaaattgaagtgtttatgtaatgaaagatatccctatgatattaaaaataaaattgtttctcgagag

SEQ ID NO: 674281 - DNA, 225 bp, Homo sapiens
cagggtaatgctttcatttatgtgtgtatatatattatatttatgtatatatattatattatgtatagatttgtgtacatatttatatatttatatacatatttatgtatatatatatttatatattatgtgtatatatatttatgaatatttatgtatattatgtatatatgtatatatatttatattcttccatctatattcacttaagtgggtagtcacaga

SEQ ID NO: 674282 - DNA, 587 bp, Homo sapiens
gggtggcagagaaactgcttgaaaagctgccatccttgcagctggctctgcctgtcttcctgcgcagagctgggcattcaggacttcacagtccccttgcccctttctttctattgactatgggtggagcctgaaatctctgctgtttcaagcagaagatgtgattaggacccttcatctcaaatttctagtgagaaagagggaatgtagcagggatgtgtgtgttgaggggcaggggttagaattcctgcccttcatccacatctgagtgtagtcctgtctttagggagtataagccaggaattctttccttccccagtacacagagggctcctgctgccccctctccctcaattcctcctgaagttatggcagagatgcctctgattagagcaggattgaaggtattgtgacctgctactgaatagcggacaaaagctctagcctgtaaatccctatgaaacttggggaaggaacccccagaaaggaccagtgatgggcaacccgctcgggtccccttctacgctgtgggagctttgtcattttgctcttcacaataaagcttgctaccgctcaaaaaaaaaaaa

SEQ ID NO: 674283 - DNA, 363 bp, Homo sapiens
  misc_feature (250)..(250): n is a, c, g, or t
  misc_feature (342)..(342): n is a, c, g, or t
aagagtgcggtgatggtgtaagtgtgtgtgtgtgtctgccagaaacctgattgggtaggtgatgttggctgtggtctgaattggggtctgagtgtaagtctgcaatgactgtcattggcccatgttgtgtcggatgatgatgggacagagtttggaaagctgaagctggaggttctggagggtttctgggagatgggttgagttgtaaaggtcttgcctgacaatggtgctgcttggaggggctggaggngctgtcccccttgaactagctgaggctggataagaatttgttgctgctgtgtctgctggttatgctctccttctttttgctgggctgcttgnaatgaggctccagatgtctgg

SEQ ID NO: 674284 - DNA, 197 bp, Homo sapiens
cgagcaggtggtgttgggaactaatcttatctacaatcaccattttaccaaaaaacacactggttcaacccacatgaggaagtgggagggattaaccctgccctacatagccccagcaagattgtttgacaagcaaaattgcccaaggccagaccaaggtcctagggttgatgtccaccggacctggcctaaaggag

SEQ ID NO: 674285 - DNA, 119 bp, Homo sapiens
cagaagcaggggctgagatagcacagggcaggtgggggcccaggtgcgtctaagaccctcccaccccatcaccctgcaggatcaggcacctgaaaggggatctatgcccagggggtctc

SEQ ID NO: 674286 - DNA, 402 bp, Homo sapiens
  misc_feature (82)..(82): n is a, c, g, or t
gcggccgcctactactactaaattcgcggccgcgtcgacgtagatgaacagtgtcaggtaaagtgctgtgaaagacgtgttntatatctgtgtgtctgaattatccagaagcacttgaatcactcagttttaaccaaatacgctgtaatgagacttgcctcttctcatatgaagacacatgtctttctgctgtcactcaggctaacacaaagggggaaaaaacgcttgaaaaggctttcaagtcttgtaaggcactctccttttatgatagtaatgcactatacattaggaattggtcctgcaggattatttcatgtttctagaatgagggctgaggtcacagttctctctttggagctcattcatgaaagtatgaaaatgtgtgaaaaggtgtcgacgcgg

SEQ ID NO: 674287 - DNA, 433 bp, Homo sapiens
  misc_feature (11)..(12): n is a, c, g, or t
  misc_feature (368)..(369): n is a, c, g, or t
ttttttgaganngagtgtcgctctgtcacccaggctgcagtgcagtggtgctatcttggctcactgcaacctccacctctggggttcaagcaattctcctgcttcagctcacaagtacctgggattacaagcctgaaccaccacgcgtgctaatttttttgtatttttagtagagacggggtttcaccatgttggtcaggctggtctcgaactcctggcctcaggtgatccacctgcctgggcctcccaaagtgctaggattacaggcatgagcactgcgcccggctctacattttttgctgagtggtaaacatattgtagtgggtaaaagaaattgagacaaagaagcctttcttgtcagtttgaannttctctggctgagaattagctataggtattggaggttcaaagctcctctgaggctcttgctttg

SEQ ID NO: 674288 - DNA, 285 bp, Homo sapiens
gccaacatggtgttcaggcgcttcgtggaggttggccgggtgctatgtctcctttggacctcatgccggaaattggtcgcgattgtagatgttattgatcagaacagggctttggtcgatggacttgcactcaagtgaggagacaggccatgctttcaagtgcatgcagctcactgatttcatctcagtttcgcacagtgccaccagagtatgtcgacagctgcagagcagacatcatacaaatggcagccacagatggccagagtttagcagaaaggaagccag

SEQ ID NO: 674289 - DNA, 245 bp, Homo sapiens
gtatatctggttataaagaataatagagtgacacatggttctgtgcttggtacattgaaataagtcagggcagaaatcggggggggcctcattaccttacggtttatatgtgtgacacaaagcggagggtagggagtagagttaaaagataccaggttagagagaataaatgtcatagcacagaggggtcacttaaatatctggaaggtcagctcaccttcctaggaaaggtaacttatcctaag

SEQ ID NO: 674290 - DNA, 372 bp, Homo sapiens
  misc_feature (38)..(38): n is a, c, g, or t
  misc_feature (232)..(232): n is a, c, g, or t
acaaaatggcccaagaccccactgctgctggaggcaantgaatttatggcagaaaaaagtaatgaaaaattttggcaatttttggaaactgtgcaaaaattagcaatttataagcaaacagaatcagattattcttattacaacttaatcctaaagaaagctagacagtttctaaacaatttacacatcaaccttttaaagtttgctttctctataaaggcatactccccanctattcagatatttcagcagattacagctaataagccaccaccaaataattataatacatttataattattcataagaaacacacctataaaattaataagattaaaaagctactgaagagagctacttcaaagactaga

SEQ ID NO: 674291 - DNA, 248 bp, Homo sapiens
gaggaatcgaacaggctgttcagagccatgcagttgctgaaggaggaggccagaaaagcccaccaacctctggctttcagtggaggcattaaagtacagcatgaggacctcatctgcagaaacacctactatccgctgggtagtgcggttgaggccatcaaagccaactgttctgataatgaattcaccaagctttaaccgcagctatcctccagagtcctgacccgtgggtgtacagtaaggacctt

SEQ ID NO: 674292 - DNA, 176 bp, Homo sapiens
ctcaggtgatagataggccattggtgtgaggagtcagttatatgttgggatattttaggtagtgcgtgttgagcttgaacgctttctttaattggtggctgcttttaggccctaacaatgggtgtaaaattttttactctactctacaaggttttttccttagtgtcccaaagagc

SEQ ID NO: 674293 - DNA, 414 bp, Homo sapiens
agaaaacactaattaactgataattagcaggaaggtgaaagatcatacttagatttacatgttgccttcttgttcgaagaatgcgtcagcatccactaattaatccatcagcaaagaatgctgcctccatctctccatcattagccagtcttcaaaagaagcaagaggacctatccagaccacctttgtggagggtgaccagttgtctgtctccggatgcccatgactctcttggttctagcgtctgaaagcccaagagtatcagttacccctgagtcctgaacaatccagtaaagtttatgaagtagtggcacttggaggacgactcccgagtttgagaagatatgtaccttccaaagctgaccactttccaagctcttgctgaacttctgaatagtgtttttctaaaattga

SEQ ID NO: 674294 - DNA, 104 bp, Homo sapiens
aagctgattcatctcagctccagagccgcctctcttctgcagctggaattcagccggctggagcccacatgctgcatccgaaagaagctggtgatcgttgggga

SEQ ID NO: 674295 - DNA, 928 bp, Homo sapiens
  misc_feature (330)..(330): n is a, c, g, or t
taatattatgtaacataaaccacttgctactgatttgggcatattacagactacaattactagttgctttgaatgcattggcactcttaattattgcaaaggagaattgaaaagtagtcttgtggtcctagttaatttagctttgggcaaactaagtggcttttcttctgtcctcttctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgntctgttcaactaatagagaacctacattttgccttcttaatatcgactttcttttgtaccaggtttttctttctttcttttttgccttaggagcttagctcaaagttcagctaacctttgacactactagtgtcattggagtaacagtaatctttgacactactagtgtcatttagggagcttagctcaaagttcagctaacctttgacactgctagtgcgttcaagaaagggtagggacatgaagtacccttaatgcagggtcagcaaacttttcctgtaaaaggccagataggaagtattttggcttatgggctgtttgcttttgctactactactgtgggaatgaccatggtcatggctgtgttccagcacaacttgatttaccaagacaagctgtgggctgtatttggtcctcaggctgtgggcttgtagcccctgctctaatggatcgtgttggcggcaatggcaaagattcccttgttgagaacatgcggatgaataacctattggcggggatgcagaaggaaaaagtctgtaggaataagtggtgtttccctttgaaaattctgggttgttacattgtttggccgggtgtc

SEQ ID NO: 674296 - DNA, 429 bp, Homo sapiens
  misc_feature (190)..(190): n is a, c, g, or t
  misc_feature (215)..(215): n is a, c, g, or t
  misc_feature (294)..(294): n is a, c, g, or t
  misc_feature (309)..(309): n is a, c, g, or t
  misc_feature (311)..(311): n is a, c, g, or t
  misc_feature (318)..(318): n is a, c, g, or t
  misc_feature (416)..(416): n is a, c, g, or t
ggcctgaggaggcctcggttggatgcgaaggagctgcagcatccaggggacaagatgccaactggcaagcagctagctgacattggctataagaccttctctacctccatgatgcttctcactgtgtatggggggtactctgcagtgtccgagtctaccactatttccagtggcgcaggcccagcgccangccgcagaagaacagaagacctcanggatcatgtagaactggggggctttttctcctgagcagagaaagaagcatgctgtggagagactcaactgccaccattncagtcaacagactanancgttganggtttcaaacctgttggagaatgcccaggttctctggtctgccattgacattaaggagcttttgaatcgtaatagcattgaggtgaggacactacagncttttgccggtct

SEQ ID NO: 674297 - DNA, 401 bp, Homo sapiens
gataaatttttttgagatggaatctagctctgtcgcccagcctgaagtgcagtcgatgtgtttcatgcgcgtcgcgtgtgaagagaccaccaaacaggctttgtgtgagcaacatggctgtttatttcacctgggtgcaggcgggctgagtccgaaaagagagtcagcaaagggtggtggcttatcattagtgcttacaggtttcgggatagggggtgaagagccatgtattgcaggcaggggtggatctcacaaagtacattctcaagggtggggagaattacaaagaaccttcttaagggttggggagattacaacgtaccttcttaagggtgggggagattaccaagtacattgaagagttagggtggggccgaaacaaatcacaactggtggaatgt

SEQ ID NO: 674298 - DNA, 947 bp, Homo sapiens
agctggtccaagctacatgcataccaaatgtgctcttatatattattatgcactcgtgtcctttttaattcaaatagcactgttgttagcttgtattatagtagctttgctgtaagaatgtcactagcttagtctttataatcgtactatgacacttcttaagtcatgctttcaacattgtatttaacaaatcatttcgtattaggttgccattaacacaggtgtcactttcctttcgcaaatagggcacacggcgattatccactttcatggaattctgacacatatgaaatgtagcatagtgtcatctaaaggcgagaaaatagttcggacttggtacttgatgacaatactaagtaatggttctctggagaggattatgtttagatgttgcacagatggcgagtggctaccctgttgtacttcaaattatcattcaagtcagcagtgctaagggaaaatttcacacaaatattacaagcataataacatggaaatgtgtgcctttcagtatacaaactcttgcttggtggccatactgggtaatcagaccatttgaattgcctgagagcatgtataatgttctgtggagtgcccacatatggtaaaacaaactcttttaatgtgcaattaatattctagagtaaaatgtctgttatgtgagggggccctttcctgttgggcttacctactatctctaaactgttcacatttctactggttagttaaaatgccttcataatgtcctttttgactgttgcctcttttaaaaggcaacgccatctgctaggtcttacgattacctcagcactgagcctggggtactcactaacatgtgggctgaagagatactagatccggttaggaaacacacaatctaaaagaaatagcctgcataagaaccacacatttactgcttcgggcataaaggggctctacaaaggaca

SEQ ID NO: 674299 - DNA, 625 bp, Homo sapiens
ttacacggctttgtcttgtgaggccccgctgcggagatgatatttatcccttggtctgaccccgtcatggtgggttgagaattgtcaaccgccccgttagtggtcatggggttcccatgtgggcagcaacaatcctttgtggcaacaggcagcccagtctcttcatacgctggcgaggttatgaggtgaaacaaacggcttgcacccacagaagtgtttatatagtgggacatgtacctccttgctcactcggaattaatcatgcccgcacttgttcagaagcgaagaaccacattcagggggtctgggtaaatatgaggccacggtatttccacagtggaggcgttcaaaatcgttcgttttgctgccactattcacatagagcgcccttgcgggtatgagaacgctaccacctttaaaagtcttcttcctccggccccactcaggagaaagatgagtgaacaagcattcaactgatctcataatgctaattcgaagcggtgcacatcctccgtggtaggggttgaaaacccgaagacccgttgtaggaaataaagtttgtttaaaactttccccttttttttgtgggtccaactaaaaaaaaagggaagaaaccacaacaaaa

SEQ ID NO: 674300 - DNA, 352 bp, Homo sapiens
attgagatataattcacataccttacaattcacttattttaagggtacaatttagtggttttagtgtattcacaaagttgtgtaaccgtgaccacagtcaattttagaacatttcgttaccccaaaaagaaaccctgtacccttgagcagtcacctctcattttctcccagtgcccaccccatccccgagcccctggcaaccactaatctatttctctctctgtagatttgcttattctggtcatttcatataaatggaattctacaatattcggtcttcttgggactggcttcccaaatatgatttgctatatggacgtgagaaaatgcttctcatcttgagaactcttat

SEQ ID NO: 674301 - DNA, 277 bp, Homo sapiens
caagccagttaatagactcaaagaacatgatgtgtggttaaattagaagatgggtgacctgtcagatatgggggaaggagggatagggaggattttcgatgacttccattttctggtctagtgagtgattttaattaactgtctttttgtttcagagagacaagagatcggttttggtggggaatctcccttatagtaagtttgtttaaacaaagtacagttaatattactaaataaataacaaggaaataagaactgagtctgtattaactgcttg

SEQ ID NO: 674302 - DNA, 256 bp, Homo sapiens
tctcaacgctctatacttccttcttcctttttctccttctttcctatcttctattctttttcttcttcctcttcttatactttctatctccttctatcagtaccttattcatctttcttctttcctcctcttacttcttcttagtactatcctcttctttccttcttccttctttcttcttcttttactttattctttcttctttccttcttattccatctcttcttctccttcttcttaggtgttgcaggggcat

SEQ ID NO: 674303 - DNA, 515 bp, Homo sapiens
  misc_feature (163)..(164): n is a, c, g, or t
  misc_feature (232)..(232): n is a, c, g, or t
ggctgtattgggggaaggcatcctgctcgtgtaaccttttttttggcacgccgtgggcagaaagggtccctcccccggcctgaaatcccaaaaaaaatttataaaaatggccaggggtccctatccagggcggccaagtgttcaaaaaaaaagccccccctgnntaatacccattttacaaaaacaacaaccccttgggggggtttttcccctatggggaaaggacccaaanctttttccttcttaaaaggtgtgggggtggaaacaaaaaaaggggggtccccccccccaaatcccttttggggcaaaaaaaaaggcggggtttggaaaaaaattacccttagtttttttccacccccccccaagttgggcctgggcgctttccaacccagggggaaaaaaaaaccttttttgggccccttaaaaaaaaccccatttccaaagaaaaaaggggtttaatcccgggaccaatttttccggtggggggggttccaaaaaaagtttttttcccctga

SEQ ID NO: 674304 - DNA, 265 bp, Homo sapiens
catgcaagcggactttgtattgtttattcatcaaagacacttgtgttatagacttcaggtgaactctgtattaatgcagtcgtgtgtgtgcaaacacctggttcctgatcgtagggtgctgagctggcgctatggctcggttgtgaaatacagcgtagtctgcccttacgctcagtgtagaaacccacgtctgttaggtcggtcttcgtccatctgcttttctcttacatacactacgagcagccacaaaactgtcacctcgagg

SEQ ID NO: 674305 - DNA, 736 bp, Homo sapiens
  misc_feature (71)..(71): n is a, c, g, or t
  misc_feature (80)..(80): n is a, c, g, or t
  misc_feature (84)..(84): n is a, c, g, or t
  misc_feature (86)..(86): n is a, c, g, or t
  misc_feature (88)..(88): n is a, c, g, or t
  misc_feature (91)..(95): n is a, c, g, or t
  misc_feature (102)..(103): n is a, c, g, or t
  misc_feature (159)..(159): n is a, c, g, or t
  misc_feature (231)..(231): n is a, c, g, or t
  misc_feature (236)..(236): n is a, c, g, or t
  misc_feature (244)..(244): n is a, c, g, or t
  misc_feature (249)..(249): n is a, c, g, or t
  misc_feature (272)..(272): n is a, c, g, or t
  misc_feature (276)..(276): n is a, c, g, or t
  misc_feature (286)..(286): n is a, c, g, or t
  misc_feature (288)..(288): n is a, c, g, or t
gccaggaggaagctgctgagccatgggcgcctacgcgcgggcttcgggggtctgcgctcgcggctgcctgnactcagcangccntngnccnnnnnccgcgcnntgcggccaccgctcccgcctctctgctttttccttttgttgctggcggctgccggngctcgggccgggggatacgagacatgccccacagtgcagccgaacatgctgaacgtgcacctgctgcctcanacacntgatgacntgggntggctcaaaaccgtggaccagtncttntatgggatantnggcagagatgatactaccaagcgacgcgctggtgctagcaacgtatcactcgctaggacctccggtccatctcttgcctttgcttggcagaatcccagcccgtcgcttcatttacgtggagattgccttcttctcccgttggtggcaccagcagacaaatgccacacaggaagtcgtgcgagaccttgtgcgccaggggcgcctggagtacgccaatggtggctgggtgatgaacgatgaggcagacagccactacggtgccatcgtggaccagatgacacttgggctgcgctttctggcaggacacatttggccaatgatggcgcgaccccgtgtggcctggcacatttgaccccattcggccactctcggagaggcaaggctcgctgtttgcgcaagatgggcttcgaccggctatcttctttgggcgccttgattatcaagcata

SEQ ID NO: 674306 - DNA, 280 bp, Homo sapiens
cccccttaaattggacccttgcctttcttagaattggaaggcccttttgaggaaaatgagggggctttggagagtaaggcagcccagttggacgggttggaggccaggatgggcagggtgtttcaagccttcaatttgcgggtgcagttttacaacccctgccagtgacccctgcccaaggcctaccccggtttctagcattgccccaaatgaatgtttgcttatgcattgaagggtttttggccgggcagggcccccaataaaccggtgtgaaccccca

SEQ ID NO: 674307 - DNA, 856 bp, Homo sapiens
gaggtggccgtgtgtacttggactcgtgcttggtgccccgatgtggatgctgcatctgtgtgggaacttcactcgggctgccaacctgctcacctacctgctggtgtgccagttgctgtggacccctgtggcctggctgctgctcaatggctgatgtatcttgcttgtgctgtgctgcatgcctgtgtgcaatgaattacaatcatgctgccatgtggagctccagctgggaagggaccatgctccagcagaatgatcatgtgcccctgtgtggcctgtcaacctgtcttgacttgcatcacccaatgtgtctctactgtcctggcatgtgagttgcatgaaatgcatccacctgtgggatggtctccacctggtgaaccttacttgtggtcatccttgaagtctgacactaccatgtgcctgtctccttgccttcagtttcaccatgggcggacaatgcaagccacttcaatctcatggtgtggcaactggacctgcctgtggtgcttggttttggggtgcctcttgcatgctgttgcttgctttgcctgaacccccttcccattgcagtttcctgtgctgcccatgtgcaagcgtcttgtgtctcatccacaacagccttcaccacgaattacaacgtgaagccttggcactttggcgggcttctcgtgggtgggcccacgcttggggcccctgacgtttggcacacaccttccattctcggtgggaaccatgaagtggtgaaagctccttgggcagggacaccatccgatcggacaggctgttgctctctggaccctaatttagctgttgtcactcattggagtgacccatgacctgcttagcgcacttttcc

SEQ ID NO: 674308 - DNA, 446 bp, Homo sapiens
  misc_feature (169)..(169): n is a, c, g, or t
  misc_feature (199)..(199): n is a, c, g, or t
  misc_feature (209)..(209): n is a, c, g, or t
  misc_feature (236)..(236): n is a, c, g, or t
cctgcaaatcctgtaagtttgagtttcccttttcagcccctggtggcggcggggtgtaacacctttccgaggaaaatccgctgccgaccctgcctgagggcgggagccttaggaccgggtggaggcggtggggacccaaccgcgggccgggagggctccccggaattanccgccccacccaccccaagggtggagccgntgcaccctgntgtcccttttcaggccttggcaatgangatcccccaaaaagcccgtttgcaccccagacccagggcctcaggcctccaggttttgggatccgggagtccattccggcccagcacccccagcatccccgtgtatggcccccctgcacctccttgttttatccccgaagatccgtccccctggcccctcagtgtccatgttttgaggttaataaatgggcatttggttttttcctttga

SEQ ID NO: 674309 - DNA, 283 bp, Homo sapiens
acccaagtagtgccttacaggttacggcacaaaccagatcataatacataaataagtagagacaaggtatcaccacgttggccaggctggtcttgaacttctggcctcaagtgatctgcccgcctcggcctcccaaagtgctgggattagaggtgtgagccaccgcgcccagccaggatctcattcttttttatggctgaagagtatccattgtgtgtaagtaccacattttctttgcctggtcatctgctgatggacacaggttgggtactacgctttggca

SEQ ID NO: 674310 - DNA, 133 bp, Homo sapiens
cgaggcctgggagcaggtagaggaagaaggactgaggcaggcgctccaggaggaggttgagctggcggaacatgccctccaaagccttgcaccactgacaccaggccatacttgtactggcggaagctatgga

SEQ ID NO: 674311 - DNA, 117 bp, Homo sapiens
gtcgtctgaattatctgcctgcatcatactagtcctcattgccctcccatccctacgcatgctttacataacacgacgagttctagtgatcgccatcgccttagcatcgaaatcaat

SEQ ID NO: 674312 - DNA, 533 bp, Homo sapiens
ccaagctaggagagacccggaccacggagacagagaccccggcatcgcgacccccgaggacctcctctcctcgccctgtggcacccactagtcctgggcactcagtcgcggagagccgccgagccccgcgcgcccagcccgggggagcccaccttcctccccgctggcccgccctgggccactgcctcccccggggcatgcgggatgagccccagccgggaatccggtgaatcgcggacgccctgtgcggaccactgttatccgggtctgtgggcatcgcgggacgtgggcttgggcggcctttgcgtgatccgtctttcgcgctgccttcgctgctcacgcgtgttctgcacttggctgctgcaatatgcccggggcttgtggctggcgcgggcccgcggggacctggggtcccgggatcccgccttagctcggtggaacccgcgggattccctggcgggagtcgtggcgcgctgtgagcagttctcgctgctgctgtgctgcgcggcagactcggtgcgctggcgccgcac

SEQ ID NO: 674313 - DNA, 354 bp, Homo sapiens
gtatccccgcgcacgacgctgcggccgtggtggctgcggccgttgcaggcctgatgagtggtcgggagctgtgtgtgtctccctgggtcggggggtggcctcctgtctcccgggcggtcaggccaggctccacttctggcaggactacagcctctccctccttgggcccctctccagcccgcaggctgcaggtcgaggcagctgtagcctccaggccggtgagttctggagcacttgcgaatagccgtcaggagctgcgtgtccttccaagtggagcgggtctgctgtgacgaggtgatatcttgcaacgcacctgcacctgagccggagaagttgtcagagtcatcccccgag

SEQ ID NO: 674314 - DNA, 191 bp, Homo sapiens
  misc_feature (140)..(140): n is a, c, g, or t
  misc_feature (163)..(163): n is a, c, g, or t
agttttctttttttttgtgtattatgcgcttgtgtttaattttagaattgtctattactgtgggtgggctgttgatatttcatcaagataagcatatctttcctgaggttccagggtagactagaggaaagagccacaanaacaaaacacaacaaaaccaaancacagaatcatctttaacccaacttttt

SEQ ID NO: 674315 - DNA, 160 bp, Homo sapiens
ttattttctttaacaattacttagtaaaattattattactcttgttcctaatttgattgatttataaaatttatacttattattctttattaaccgctaaaaaacattttaaaacatgtcattccaaaaatagccaggtgtcaaaaacataatttctaat

SEQ ID NO: 674316 - DNA, 578 bp, Homo sapiens
taggatcccaaacagtaactggtagctttcatgtggtgttaagcgcaggcacacaaagggcaagaatcgtggatctgggcagcctcggcctagatttcagaggacatatggaaaagtctgttggtccaggcagaagcctgttacaggggtggagcccttacaaagaacctctactagggcagtatagaggggaaatgtggggtgggaggctccaacagggtcaccgctggggcactgcctaagggaactatacgaagtgggccactgccctccaggcctaaggatgatagatctaccagcagcttgtattctgcaccgggaaaagccacaggcactcaactgcagcccatgagcgcagccttggattctttacccggcaaagccataggggcaggactgctcaaggccgggggagcccaccccttgtaccagtgtagcctggatgtggaacatgatgtcgaagattattttggaactttaagatttagggacttccctactgggttttggagctgtgtggatcctgtagaccctttcttttggccaatttccccctttttgggatgggaacatttacc

SEQ ID NO: 674317 - DNA, 227 bp, Homo sapiens
  misc_feature (78)..(78): n is a, c, g, or t
  misc_feature (220)..(220): n is a, c, g, or t
gttggaggtgtgagagctggactgacttctgcttacttctttgtgtcatctgggcttcatttaacagtttatcactgntggaactcagggtttaagcttttcttgggagatctttcctttatcactgtctggagggcagattcagatgcactggcagccctgtgggctgcgtcctcggccgctttgatggcattgaggatgtctctcgtaggcggtggcnggcatcc

SEQ ID NO: 674318 - DNA, 548 bp, Homo sapiens
  misc_feature (12)..(12): n is a, c, g, or t
  misc_feature (61)..(61): n is a, c, g, or t
  misc_feature (134)..(134): n is a, c, g, or t
  misc_feature (294)..(294): n is a, c, g, or t
  misc_feature (300)..(300): n is a, c, g, or t
  misc_feature (302)..(302): n is a, c, g, or t
gaaccatattangggattttgatatatcgcagggatataattatggactgggggttattangatttggtgcatgttgttgtcaatataataatatggtttctaatttcctccaatggacaagtgaagttctccnagacttcattttcctgtcttgtcttcacagagtctcatggtttgggtcctaaagtgtcctctcctattcttccatgttccctgattttaggcaattagctgctgctgctacataataataataataataataataataataataataataataatattcntccctntncgaattcggcacgagtctggctcctagcaccatgaagatcaagatcattgctcctcctgagcgcaagtactctgtgtggatcggtggctccatcctggcctcactgtccaccttccagcagatgtggatcagcaagcaggagtacgatgagtccggcccctccatcgtgcaccgcaagtgcttctaggcggactgttactgagctgcgttttacaccctttctttgacaaaacctaacttgcgcag

SEQ ID NO: 674319 - DNA, 947 bp, Homo sapiens
gatgtggtctcctgactcccagttcgctgtttctagtgttagatgactgtctagtggtgcgtctgcgacagcgttggggcgaaactactcgtttcggaggcgatgttgtccctctcccccacgagataactctgtcgcgggccaatattgctggggtgcggcccacttgtcgtctccccctacaaaatgggcccccacaggtgtagtatgtcgcccctcgcttgccgcccaagctcttcgcggctggacacaatttggggcccaccctcgtgggaaaaccagttgtgcgcggaaccccacataagtctgtgcccgggttcgcatcatcctttatttgccgtacttacatggctgtttattttggcggctcaaacaggatttgaatcatcgtgcgtcggcgtatagccccccccgcttcagttgggcggccgcatccccccccaacggtgccacaaatgcgggcgcaggcaaacatctgcgggtccccccaataggagtgtgctgttaaacagccggtctccgcagaattgtgcggtccccctgttggaccacggaagatccctctccccattgcgtaacacgcccccccccctgttgtcttcatgcgagaacatgggcggcatccgtcgtctccacaatccccaacccacgggggggtgcaatacccaaccgtcttctgctaagattacagctgaagccgcaacaccgttgtatggttgttccgccgtaaacgtgggtcaattctttcggcccatgctgttggaacagacggtccactttgcgccgccccccgttcccgccctgtggtgccccgcccactagtagagacaattactagttagaacgatcttggcgtcgcccttgtggacgggcggcaggcacccgcccgcgggcaccctcccccacccggggcccaccgaaaaaaagccccccccccaacataacaa

SEQ ID NO: 674320 - DNA, 460 bp, Homo sapiens
cctgacgcccagttcatcactattggcaacgagcggttccgatgccctgaggctctttcccagccttccttcttgggtatggaatcctgtggcatccatgagactacattcaattccatcatgaagtgtgacgttgacatccgtaaagacctctatgccaacacagtgctgtctggtgtaccaccatgtacccaggcattgctgacaggatgcagaaggagattactgctctggctcctagcaccatgaagatcaagatcattgctcctcctgagcgcaagtactctgtgtggatcggtggctccatcctggcctcactgtccaccttccagcagatgtggatcagcaagcaggagtacgatgagtccggcccctccatcgtgcaccgcaagtgcttctaggcggactgttactgagctgcgttttacaccctttctttgacaaaacctaacttgcgcag

SEQ ID NO: 674321 - DNA, 88 bp, Homo sapiens
ggatttgctggtgcagtacaactaggcttaatagggaaaacttttcttaatgcaagtgtatacatacacaaacatgtttttaaaaaaa

SEQ ID NO: 674322 - DNA, 139 bp, Homo sapiens
atacgactccgatatgcgacacctcaatgcagaccaagcctgagtttgatcaagtgctccatggcacggatgccagcataaagaacaagctgcctggtcctcatcacttatcctatggagaccatcgttgcctaatagc

SEQ ID NO: 674323 - DNA, 131 bp, Homo sapiens
ggtgctcttgtggatccccgcgcgtaccacgttgcggtacgacgtcgtgcggctgtgctggtgatgtcctgtaggcctgctccttcaggttctggttgggggcacgtggaagcgccggatgcctcctcgct

SEQ ID NO: 674324 - DNA, 114 bp, Homo sapiens
ggggggcaccacctacgtagtagtcttgtgtacgggctgtagacgcgcaccggggtggagtttgcctccagcagtgctgacattccatgctagggcatcatccttggtctccga

SEQ ID NO: 674325 - DNA, 370 bp, Homo sapiens
gattttttttgacaataataaagtaggtgcattaaaggagaggacacactagtggctcagaagagcaaatgcaagaaatagctaaaaaatgatccaggaattaatctagcaaaaatatgtaagatctttatgaaaaaattaatctttattaaaggacataaaagaagaactataagagattgatatactcatggttgggaggactttattatcaactattctcaacctcatcaaattaatttggaaaaacaatacaagttcaaatgaagtcacttcatgatttttttcacacagctcccctcccctcttcccgaataacaccatttatttgtgttgatcaatgatggaataataaaagatttggtaaacc

SEQ ID NO: 674326 - DNA, 1026 bp, Homo sapiens
  misc_feature (915)..(915): n is a, c, g, or t
  misc_feature (917)..(918): n is a, c, g, or t
  misc_feature (924)..(924): n is a, c, g, or t
actccccttgcgcccacaccctttactccccagcccagagagacgctgcttttaccaggaaagactattgaaagatgttttattttatttttctctgacctttccatccttgaaaaaatggggaaaaaagaaaaaaaaagacaaaatcgaccataaaagaccaaaaaaaaaaaaaaaattcagaaaacccccacctaatccacagaaagtaatgtctttcccctccccttggaattttggtttggttttgggaaataatatttttttaaaagttggccttattggtggagcgggaatctgaaatacccaaatgcctgttttcctcggtgggagtcaacccgaagagctcccaccttctctggatgtgcctggggctgggactgggctagaatctttctctgggactgttggcatgtacggtgcctccatcctggaggcaagagagttggggagtgggctcgaaatcagagccgtgcccaagatatccctgctggttgcatcgtttggaagctggacgtcctggtgtctggtacactggcttgccactggttggtgtcctcgctctggcttggctggtggcctcacgccaggccccggtccttgccgatgacaccctttcatcctaccctgggaaccccaaaggccaagtgggttcaaactggtgggagaacagagtgggcctgcatctgggaacacacttggtcctcagtttaccatctcctcaaccccagagtggaacggtgaacacctgcagctgaggctgggaaacgtttctggtgttggccctgaaaaatcttggagacctcagggaggctctgtctctcttaaaaggtggcgaaaagatgccattctctccctaggtctggtggagtctcccattttggattacccttctggaagccatctatttctctnannctccanttgacccgctgggaacacggggatggcgggcgggcattgggggctggggggaatcttggcgattggtgagccttgtggggcaaggttttgtggccttggttc

SEQ ID NO: 674327 - DNA, 338 bp, Homo sapiens
  misc_feature (328)..(328): n is a, c, g, or t
ctagaggccccatctcagaaataaaaaaagaaatgatcttgggtttcggtgagaggacctgggtggaggcctcggcccggagggaggttgcagggcaggaaggttccagtggacaactggatttggggctgaagtcttaggggcacttggctatagagaagggcccaggcactgagggaggccaccgggagtgatgggcatagtgctgggaggtgtttgtcggggatctggggaggctgaccgtgcctgagcggtggggctggcaggcatcaggaaaagaggtcggtgctgagggggtttgtgggtgaggcctctagcggcacccggngtaccgagct

SEQ ID NO: 674328 - DNA, 196 bp, Homo sapiens
  misc_feature (133)..(133): n is a, c, g, or t
  misc_feature (145)..(145): n is a, c, g, or t
  misc_feature (166)..(166): n is a, c, g, or t
actccccttgcgcccacaccctttactccccagcccagagagacgctgcttttaccaggaaagactattgaaagatgttttattttatttttctctgacctttccatccttgaaaaaagggtggctccctgangaatgttgacanactcgcccatatttgaccaantttttttttccgaatctgaatacccccacc

SEQ ID NO: 674329 - DNA, 193 bp, Homo sapiens
ttgctgatgtctggtttaacttgacccgtggagttctgaggcatttatcgtagtgggaacaagggtgcttttccttcctccccttcttttcctatctcttctttttttgtcttggttttcttctccctctctcttgtcccttctctttccttctttccttttcttgtctcatgccaaaataagagcactccct

SEQ ID NO: 674330 - DNA, 351 bp, Homo sapiens
cggcacgaggtggaaacaaatgtccctcggtgaggtgctggattacttaagtttaataaatccaaactgtggagcagtgaaaaacgatgatggagaagttatgagttcggaacgactgctctgatgcgtagtgaggtgttggggggcagggtgggaacaggttgcatctacattagcctagttttcaaaaaaacaaaaaacaaatagtgtgttttcccaggcaacggtgtaagaaaattcacaccgccatggtcagcagggcgtctctgtgcagtgatgttataggtggcctagtttcattttacttttttgttgtgctaattttgtatgctaggtatgtatttttcagga

SEQ ID NO: 674331 - DNA, 150 bp, Homo sapiens
tacggcggccatgctgaggtgaccagccaaactcggcgcaggatgaacgtagctcaccaggagtagcctaggattaatgataatacggccctggaagactgctatgtctctgcagtctaaggtgacgaccacacagggctcatggccaag

SEQ ID NO: 674332 - DNA, 238 bp, Homo sapiens
  misc_feature (20)..(20): n is a, c, g, or t
  misc_feature (22)..(22): n is a, c, g, or t
  misc_feature (35)..(35): n is a, c, g, or t
  misc_feature (42)..(42): n is a, c, g, or t
  misc_feature (45)..(45): n is a, c, g, or t
  misc_feature (50)..(50): n is a, c, g, or t
  misc_feature (65)..(66): n is a, c, g, or t
  misc_feature (84)..(84): n is a, c, g, or t
  misc_feature (124)..(124): n is a, c, g, or t
  misc_feature (136)..(136): n is a, c, g, or t
  misc_feature (138)..(138): n is a, c, g, or t
  misc_feature (146)..(146): n is a, c, g, or t
  misc_feature (149)..(149): n is a, c, g, or t
  misc_feature (159)..(159): n is a, c, g, or t
  misc_feature (169)..(169): n is a, c, g, or t
ttgtctagactgggtttaantnccccctaaaaaanagatatnggngaatngggagaagtctcttnngtttggaaaaaaaaaaanggaatcttcagcctagatcactttcttatccggactgggntattaaatatangncacattcnggngtttattggngcgagactgntggcgcaaacggtacgctgagctgccccattacggcgggatggacggagtagggggttccgcttccatg

SEQ ID NO: 674333 - DNA, 725 bp, Homo sapiens
tgctgtttcacgtgaatcagcaaagcttgcatgtttctactacagactgtcctcgatcttcccagccttgcagtttcacggcatctaagcacgattggttagcttctgacgatctaatccttacagccatgctgtgtgcatctcgttacttgtcgacgtccagacactcctgatctgcagcatcagcctcatgagctgagtcagttctcgttggcgatgctgtgtataacatgatagtcagtctcagtcgtgtcaacgctgtgtacatgggcattacctctcagttgcagcaagtcgcagatacgtccatcatgtgttaaacgcgacgatctttctatcagctttccctacacctccatctaactgcttatgaccaagtgtcatcatagttggttattatcctacatctatgtcctgctgtaattgagccaggttcacatttagatcccttaataacctgtcgcagaatcactacgtatgaggctcttccaagtcttgatgtgtgaagtctacatgggtttagtccgtaagcagccccctcgcagggccccagtgtcttcagttcccctttggagcagctcatccatctctcaggtaggggtccttggtcaggcagcttcctctgtggcgctcaggtgggtcctgagtgggcacgctcctttagaagtcaggcaggccagtcagagggaagacacaggctgagctcgcgacctcctctcggagag

SEQ ID NO: 674334 - DNA, 444 bp, Homo sapiens
cagtgtaggaaaagcatgaagataccaggggaaaaaacgtgtgctgcaaacgcccgtttcactgccctccaaaaaaactgccaaaggagagtggtgaaaaaccaaaggtcaaagacacactcagggtggcttcataacttcccaatgtccccatctcctggttagaaccaatgtttatgtattaactgaggacacacacacacccagagaaagtccaaaaaaaaaaaaaaaaaaaccacatagcaatgcccagaaaactaccccaaacatgttcctttcaaagctgccaactgaggagccctccctgatcagtcggaggcagatcagacctgtttcctttaattgcaacttccacccttctagaatttctactcctctgcaggtccaggccacagagacattaatccctattcaagtgaaacttcaaggtttttccttctatta

SEQ ID NO: 674335 - DNA, 527 bp, Homo sapiens
gcacgagccgatattatcaagaaatcattggaaagtttgcaaaaacgttggctccagtttttctttttcttttttgacgcttgagaagtagtggagagtgaagatgacgattgctctgttagttggttgaagttgggaccatattctccactagacttgccacatgatactagttgaggagagttgtccttcggattaatcgaataaatttcccacttgtgttcagtaattagagcaaatttggtgcaatcgggagaaatgctttggttgatggataatttggatttcgtccctaggaatttggggtgtgtgttgaactgaaatttttttctgtacatggggaaacagttggcaaaaaagtactccttttcttcgtccagatcatgtgcactatttgtttggtagtttgctgtggatggtattgtaacgtccgtagacatcaaagaggagttgttatctatcggcacagttcttgtgttcgaggcattatccaggattttccagttcgcgtggtcgtcatagttggg

SEQ ID NO: 674336 - DNA, 99 bp, Homo sapiens
atctatgtcctgggaaatgggtactgaaggagacgagaatttcatgttggacgaaggcttcaccactgttatggacctgctcctggagtatgaagtcat

SEQ ID NO: 674337 - DNA, 346 bp, Homo sapiens
  misc_feature (10)..(10): n is a, c, g, or t
  misc_feature (314)..(314): n is a, c, g, or t
ggaccttcgntgtgggctcgagaaggagaagatcctgcggaaggatatgtttttgctgactccaaagtaagtgacagcaaacttctaaagtgggctgtgaggtagggaggggacacaagcgttttgaggctcgctgtgtgccagggagtgtatcattagctcactcagttcccagaacaacccatttcacacctgggaaaggtgaacttagagaagttgaggaccacgttccaggttggcctggatttgagccatcactgtctcaggagtagggaggcttcccactttgcccagctgcctcccagcctcgagcnacatccctgagtgtttcacatctacacagtca

SEQ ID NO: 674338 - DNA, 322 bp, Homo sapiens
  misc_feature (269)..(269): n is a, c, g, or t
gcagtcttgtcctcctgggctcaagtgatcctaccacctcagcctcctgagtagctgggactgcaggcatgtaccaccatgcccagctaatttttaaaatttttttgtggagatggggtctcactattttgcccaggctagtcatgaattcctaggctcaagcaatcctcctgcctcggcctcccaaactgctgggtttataggcatgagccaccgcacctgggcccattctaaatatttcttatgcttgggacagatttgtaattatncaagggatcgtctaggataatgctggttggaacaaccttctgtctctttcagt

SEQ ID NO: 674339 - DNA, 287 bp, Homo sapiens
cgtgtttatctcaagagtctagtatcccaatgtaaaacacaactcacaacagtcctcatcctaattacctccaaacactgatatgagaaatggataagtcacagccataaaacagaatgaaatcatgtcctttgcagcaacatggatagagctggaagccataatcctaagcgaattaatgcaggaacagaaaagcaaatgtggccgggactggatgactcatgcctgtactctcagcactttgggatcacaggcatacgggggatcctctacgacgtcgaccctgc

SEQ ID NO: 674340 - DNA, 216 bp, Homo sapiens
agtgatccccaactaggaagactctgaggacgcaggcaatctgttgaggctcaggtatatcttatttgcttagtagatcttgctgtctttcctttcaaagagcacacagtcacataaggcatagtattcatctgtcttgtttacctctctaatttagaaatctgttgtccgtataactggaccaattcatcacaactatcatttgccctcaatgaa

SEQ ID NO: 674341 - DNA, 622 bp, Homo sapiens
tccccacagccccgagcttttggcaagcccttggggagaagcagttgggagctggttgggttgggtaattctgggccaacagctgacgcaaggggttttgcaggcttatgttgtcctggccagtttctggggctaaagaaagagagaacctcttcggggatggttgaaagacacttgggcgccaacgccaaacagtcccgggactgtcttggatgccttcgagagtggtgcgacgccttcttgtgatgctctctgggaagctctcaatccccagccctcatccagagtttgcagccgagtagggactcctcccctgtcctctacgaaggaaaagattgctattgttggactcccctccgaaggactccggggtcttttgggaggtttctccccccccccattccaacttttttttggattctcgctcttgcaagcctcccccgtcctttttcccctgccaggtccctggggacagttaccagctttcctgaatggatttccggccccatccctccccccccccctccctttccatccgtttgaaaccctttggccccttttttggcagaaccgtccctgtccctgtaaagttttttagatccataaagtccgtggctttcca

SEQ ID NO: 674342 - DNA, 336 bp, Homo sapiens
gctcgacggtcaacctgtgcaatacggcggcggccgctggagcatccggggctggtgttcaaatgtggcgatgtgcgcagtggcgcgaggaactggaagtgatgatcgccttgcatgcctgcgatatcgccaccgactatgcgatccacaccggtatccgctccggcgcggcgatcatcatgtgctcgccgtgctgccacaagcagatccgcttgcagatccagagtccggtgttgctcaagccgatgctgcaatatggcctgcacctggggcagcaggcggagatggtcaccgacagcttgcgcgcactgttcctggaagcctgcgcatacggtc

SEQ ID NO: 674343 - DNA, 109 bp, Homo sapiens
tgggtggatgtgcgggcttgatatacgatgtgggacggctgcagcagagactccctcaggtaccacatgatgactgcgagggaagggagtgaccatgttcagagagggc

SEQ ID NO: 674344 - DNA, 461 bp, Homo sapiens
  misc_feature (1)..(1): n is a, c, g, or t
  misc_feature (182)..(182): n is a, c, g, or t
  misc_feature (195)..(195): n is a, c, g, or t
  misc_feature (207)..(208): n is a, c, g, or t
  misc_feature (219)..(219): n is a, c, g, or t
  misc_feature (232)..(232): n is a, c, g, or t
  misc_feature (314)..(314): n is a, c, g, or t
  misc_feature (458)..(458): n is a, c, g, or t
nagccagtggcatcgtccgcattgccctgtgcccacaagcaacagtccacagcccttggtggcttctgttccttgtcccctcggcttctcttcgcagccatcaggactaggtttgtgcaggaaggtgatgcccactggaactctcctcacacctggcagcttcatggatgttgtatctgaantactagggaccanaggctgcaaaanntttctggttcntaaggtgtccttnaggaagaaacagaagcacaaagactcaagccaagaagttctctttaattccctttgatcctcccccaaggtgagggcttagncagctgtagaaccccaggaaagaacggaaatcccaagggcaaatcctggttttaagaagaacccccccaacttccaaaattttaattcccttttttcctttttccttttcccccttaaaggaatggttttttccaagggggggnccc

SEQ ID NO: 674345 - DNA, 403 bp, Homo sapiens
tagaatatgtccatcatacttactgggtggagcatcccaaatcccaaaatccaaaatccagaagactccggcaaaagctaaaaactaaaaattccgggcaggtggggggggttcataggggtaatcccagcacttggggaggctgaggggagcagatcacttgatgttagcagttggagaccagccgggccaacagggtgaaaccccgtctctactaaaaatacaaaagatagcggggtgtaggggcatgtgcctgtagtctcagctactggggaggctgaggcaggagaatcacttgaacccaggatgtgggactgacccaggatgttggagccaggatgtgggactgacccaggatgtgggactgacccagggtgttggactgacccaggatgttggacgg

SEQ ID NO: 674346 - DNA, 409 bp, Homo sapiens
cgtcgacgtgatatgtgaagcatcagttccaggtagtaggctatgtgaagcatcagttccaggtagtaggctatgtgaagcatcagttccaggtagtaggctatgtgatatgtgaagcatcagttccaggtagtagggtatgtgatatgtgaagcatcagttccaggtagtagggtatgtgatatgtgaagcatcagttccaggtagtagggtatgtgatatgtgaagcatcagttccaggtagtagggtatgtgatatgtgaagcatcagttccaggtagtagggtatgtgatatgtgaagcatcagttccgggtagtagggtatgtgatatgtgaagcatcagttccaggtagtagggtatgtgatatgtgaagcatcagttccaggtagtagtgtatgtggtcgac

SEQ ID NO: 674347 - DNA, 119 bp, Homo sapiens
cgtctaccttctgcctggcgtatcatcaactgatgagcaggaggaagagcaagcaggccctgagggactataagaaggttcagatccagctggagaatctggagagcagaaggtcgacg

SEQ ID NO: 674348 - DNA, 944 bp, Homo sapiens
aaggtgcaggcagaaattggagatgttagtattatagtcaaataatgctggtgtcagtctataccatccagcattttgtttgctacacaagcatcctccagattgcaaacagcacttttgcaagttcaatgtacttgcacatttctggactacaaaggccatttcttcctgcaatgcacgaagcaataacccatggccatattgtcactgtggcttcggcagctggacatgtcatcggtcccctatcttactggcttactgttcaagcaagttagctagctgttggatttcataaaaactttgacagatgaactggcatgccttacaaatccctggagtcaaaacaacatgtctgtgtcctacatttcgtaacacactggcttcatcaaaaatccaagtacaagtttcgggacccactctggaacctgaggcacgtggtaaacaggctgatgccatggcgattctgacctgagccagcacagctgcattattactaccatcgttctaatagccttaattaaacaacattgggaacaggatccattcctgagcgtatcctggcagatataacaacggaacaaatcagtgtaacagctgtcgaacggccagatcaatgggaaatataaccactgtcacagccgcaacatcagccacctaaagtgtcacctgaacacctgcatataacccaagggatcaaggctcgcatgagtcaatccctacaattagatggccccaagaaaccttttaccaacgggttataggaacacattcaccaggaatttgacgaccctatagttatatggccccaatatacacactaaccacaactcacatatatgtgatggcgtctatgaggcacatcccctcaagttacactacccaagctggatctcatatgaggccaaacacgccggcattcccactcttggtccttaaccccagca

SEQ ID NO: 674349 - DNA, 490 bp, Homo sapiens
gaaggtttctttccttctctttcagcacttgcttggcttttctcccaaaggttcaaatccagacattgaacatacagaaagaggaactaaatacggacctgtaccacatgaaacgttctctcagatactttgaaggtgggaatctgggcaccctgtcatccttcaacctggcactttgacaggtcttcagggggagtcctttgggccccatctcaactctctcattacagaaaagtccaaggatctggctgtccgcctgcaacattcattgcagcgtaaaggagagttagagagtgttctctctaatgtcatggccacacagaagaggaggcaaaccaggtgagtgcaaccacctgtcccatcccctgggagcctggctttgcagatggaggagtgagcctaaaggccctctgcaggatggagtgtctgcccagaggcagcatggccatttcttgctacttttttgtatggtttttagtggcagcctggg

SEQ ID NO: 674350 - DNA, 1420 bp, Homo sapiens
  misc_feature (525)..(525): n is a, c, g, or t
tgggctctaaagggggtaaagggggtgctatagggtaaatacgggccctatttcaaagattttaaggggaattaattctaggacgagtgggcattgaaacgtggggttggcctccacagattttcagagcattgtgaccgtagttataccccgcggtcggtgtagcgggtgaaaggtggttgggttttagagcgtctcggggaaattgtgcattcgtggttttataagcccttaagtggtggggacagccctcagtaagtgtgcaagaaggttctgtgggtgagtggtaattatatatacgaaagtggggggctttaaactgggggagaatacataacctcgcagtggtgtccacacgtctcagagggagtctcgccgaggtctcgccgcgggggtctctatgaggaaatctagagtggggcggacaaaagttatgtgtgtaggaagtttgaaaagaaatattagactcgcggcgcggaaagactgcggggtgtatacctcgagtagggtgtctcagtatacccnatgtggggggtggccccaaatgtgtgattttgtgaagtgggatagagggggcagggaactccggtgtgaaaccctctcgctgcggggtctagtgtgtacaggggggagtggcgataagggaagtgggcaagagggcgcgaaagtgaggggaccataggaatgtaagtggcggcgggccagagaatatagttctcagacagcggggtttcacataaatcttcgcgtggaaggcgttcgtgggagaaatgtgtcgaggataatagaaggtaaagaaatagggggggggaggaagggtgtttttaggggacacagacgggcggcaataaccacgcggaccttcagggagaaacgaccaaggacatcacacgcggcacacacacgtggatctcacactcaggacagggggagcgggtgagactcccactctggcaacaccggcggggggcgggagaacacgccggtggggcggtcccgaccagaaatatcccccgcgcgaggatatatccgcgggaaccggggtaccccaagaccgcgctatttgtgggtacacaacaccactttggcttgccctaaatatagggggtggtaccccccataaaaaatttagaggcggaccttaaagtggcggccgaaatacacggcgtgggttcccccgtcgggtgtgtgaacaccacgcgggcggtagactacccgcggcgcccccccgggggcgcgcccataagagggggctaaaaaagattccagggagaaggggctgtagaacagctcggcggcccccgggcggggcctccccatactgcggggcggcgtcaaacacacacacgaggcgggggaggggggggctaccacgagcgggaaaccatacaggaggggcacacaaaaaacaagcccggta

SEQ ID NO: 674351 - DNA, 338 bp, Homo sapiens
tgtaggtaaagaagagagatcagactgtcctgtgttatgtagaagggaagacataaagactccattgaaaaagacctgtagttaaacaattgcttgctgagatgttgttcatttgttgccttgcctcatccactttgccccagcccctttgacccaacttggagctcagaaaacctgtgttgtataaaatcgaggtttaggggatctagggctgtgcaggatgtgctttgttaaccaaatgtttacaagcagtatacttggtaaaagtcattgccattctctagtttcaataaaccaggggcactatgcaccgtggaaagccaaaaaaaagtcgacgc

SEQ ID NO: 674352 - DNA, 478 bp, Homo sapiens
  misc_feature (419)..(419): n is a, c, g, or t
gcgttttttgtgatgaaacctgacgtgggttgtcatgcttccaatctccgtctctgaatgattcagctgtagaactgagctgacaacagacagcttaacaggaaaggaaaaatatatgacacaggcataaacatgggaaccagctgagcaatgacactgctagaaggtccggatggctgatgcttagagagcaccctctactgaggggagagggatactagactggagatgtcgtccatcatagaggggcagcaaatgatttttcggggaaatgaacgaggccaaggaacaaacaattggcctgagacaaagttcctgtgaggtcactagggacgaggtgacaaactgccggaaggtgaagggcagaactgcactgcgtttcatgatgcagagaaagccccagagactcttagaactgncctccaagagaatcactgaaaagtgtgtctgggccgggtaatattgaatgacatcattc

SEQ ID NO: 674353 - DNA, 838 bp, Homo sapiens
ccgcggccaggggcccccctcgcccgccccgtcaggttgttatgctgaatcggcaccgcttacctgtcttcaagactggtcaggtactacaatgccggcttgccttggattaccgttctaaattgtttgggtcgggtccggcccttgcacaagcctcctgcgacacactccctggcaattggccatgctctcaccgtgtaccaccttgtggtttatgcttaaatggaccgtgttcctgctggtaaaaggaggaaaactgagaggtttcctcagaccgcgggcccctccttttggagacggcacggaggcctgaggcgatccgtagctcagacgtcccggagagacgcctggcccgagagtccaagtgctggagattttcccagaagccgcctgtgtctctcctctgtcctcccccgaggcaccccctgccctcacggggggttgaaatccctctccccccggaggccctgctgctttgcttggtggtagggcaggagagccacaccacaccagtcatggtctaaaacacccacatagcacatttgctcttaggtcaccatgtaaaattttagatttcttaaaaccggtgggccaatccattttgaatacatgttctgtgaccctgactgctagttctgaggaccactggtggctgtgctatgtgtggcccatcctcccaagtcccgctccccgtaactgctctgtttagacacggacagacgctcaccccccggggaagtcctcaccctgtccccgcccggtttcccttcgcaaatgtgtataactcatgataggtcagaaagtgtatcccctaccataaagttctggcctttaacta

SEQ ID NO: 674354 - DNA, 1174 bp, Homo sapiens
  misc_feature (1174)..(1174): n is a, c, g, or t
gggccggtgagggcccaggctggtcagggtcccgttttgcacacgcaggggtctccctttctgctggagtcccctgtgtcctcagctcattcccaagaagggtttgctggtccctccttttctcctcccgtcccatgaggtccacctggagccagaccccttgtgctctgacttctgctggcagatgcagcatggtgcggcacctggggccttgggtcgcgagtgagccgggtgtctcctgcgcccgtatgcgcaatggcctcccgtacggcccctgggagttcaaccccagtgtctcgtggaatcttgagtgccgtcaatactccggggcgagaatgtcgcggctcaatgagtctcagccatagcgacgctaacctccagatgcacgcatcgacgggaccaaggggtatagcataggccgaactatactgttgcccaagcattgcttggccccggttgggtgtgtcgaccgaagtgcccccactcgttcaaatgttcaccttgtgctcaggacctcaggataagggccctcgggtcatcagaggggccccgatggcaaagaagcatccccttattcaatcgcgaaggaatatcacgggaaaatttcagcgcaatggtaaacaacattctcgttatccggggacgatcacacctttgtaaaaggtgcgctaaggaccgtaggagtagtatcgcacagtcatgacaacgagagagacctgtggggaaggactagaaaaggtgaggacgacgaggatggagaggtgcgaccagacatggcgttgtaaaactagttgacttcaccaaaagaatcctttgacacaccgcttatgcctccccatttatagagggccgcgtggtgcattccggaacgaacatagaggggtagtttcgggcatctacagaattgggcgaaaaggcaatattgtgaaccataaggcaccctgtcgcaaattttatgccgttgctgaaatcaattcggagcaagcaacgcgaaaaaattcccttggcccaaattcagttacctgtcgatatcccgaaggagaaagggggtgtggatcacgagacgaaagaatgatactgcaccacaaaggtcggtatcgagggatacttaggctggacatttgggacaaacgccccaaagaatcgtattggtaatcactgttaaaacccccan

SEQ ID NO: 674355 - DNA, 502 bp, Homo sapiens
aagaccaggtaaggaagtagacgtggacagatctcaactacactagcaagctccgcctacctgggttcacaccatatctacctgcctcagcctcctgagtaagctgggactacaggcgcctgcaacaacgcccggctaaatatattgtataataagtagagacggggtttcactagtggtctcaatctcctgacttcatggtccgcctgcctcagtctcccaaagtactgggattacaggtgtagagccaccgagcccagacccgtatataagattttttatttgaaaaattgccaattctaaaaagtgtattactaaattcagatttatgaatttctattatctataaagctatctataaccttactgcaaattggtaaagcagactatagtagaaccaaaattataaacatttacttttgctccctaacagactgccacagaactgggcaactatacatgagtatacatatgtaaatggtaattcagttatttgcaccag

SEQ ID NO: 674356 - DNA, 694 bp, Homo sapiens
gggcatggtgacgggcgcctgtagtcccagctactcgggaggctgaggcaggagaatggcttgaacctgggaggcggagcttgcagtgagccgagatcacagcactacactcagcctgggtgacagagctagactctgtctcaaaaaaaaaaaaaaaagatcagcccaggcaagtgtagttgagaccccggttctctacaaaaaattacagaagttagtcacatgtggtgggtgttagtgccgtggtggttcccagcttacagtgggagacttgaagcggagcattggcctgtgagcccgtggaggttcagggctgcagtgaaccatgtgatcaagccacgtgcacttccagcctggggttgacaacgagggaacgaccttggttcccgcccaaaagagaaaaacatttagtttcagtcaacacccacgttcgttcccttaccatggtgtacgctgggggacccttacacacggtgaaattggcctctgagccagttggcctcatgtaaaactgagattgaccatatttaagtaggggccatcgaaataactagtggtgggttacctgggccggtttaagtaattggggtaagaacgggtttacccgacccaaaagaagtgggcctagggagagccttcataggaagaaagggattgagtctctgggttcaaaggtgaccaaatgagggaataa

SEQ ID NO: 674357 - DNA, 133 bp, Homo sapiens
tgagatgacctctgaaaagtccacaaattgagcttcatacattattgtgtccaaaagggattactagatcgtggaattcgcttctcttaatgtttaggtgaggaacgatgaacagggagcagagggtctggga

SEQ ID NO: 674358 - DNA, 865 bp, Homo sapiens
aaaaactaataaaggggcccataaaagggtacgaggctgggtttgaatcggagagggctgcgtcctgctgcagcaaccggagctggagtccggatcccgaactgcaccctcgccatggactcgtgccctcagcgatcctgcataacggcagtgccggaggcaggcgtgcccaccaacagcactacgcggcctgccttccactgccccgagggcatcgctgctgtgcctacggacaggcctccatgcgtcataggctgcatgccttgcccagttcccattattcccccccaactacaggatttttttatccggggaggacctgccctgctgctccggatactggctttgctgccctgcgggccaaaggaagttgcttcatggacaattgccttgaaaccaatccagccaaggccgggggatgccggcgccgtgcattcccccatgtcgagttccggccaaggcctttgcacaccacgtcttttggagtggcttcttaacgcgtcgttttttgtccaacaaaattaagtttcagttcccagtggggaaggttcaccgattcaagacccttcgcgtgcttgtcccagatgggtagtttctcttttctgattgccttgggggaaagttccttgggggccccgtggtcccccaaggcagcgccattcaaggtcgcgcgctttcaagtgacactagagcttgttatttccaagggcccaagagcattttcccccagagcactccgaagcaaggttttagccccaaggggtcccttgggcccgttcggttttccgaaccaccccaagggtgccattattcccttggggggggcgcgcaagtgagaacccaaagggggaaccacggtaacgca

SEQ ID NO: 674359 - DNA, 808 bp, Homo sapiens
tgtggtgacgggcgcctatagtcccagctactcgagaggctgaggctggagaatggcgtgaatgcgggaggcggagcttgcagtgagctgagaccgtgccactgcactcagcctgggcgacagagcaagactcgtctaaaaaaaaaaaaaagggaaaaaatttacttgcgggagaaaaatggtttaggaggattttcaaattgggtggttaacacagttggtcatcccattggtggtctttggtaaggaaggtctggcaatcaattttggttaacagattcattaacactctttatgattaaaggatgggattcattccatctaatcagcagaaatttgagtggttacctggccctttaaattgggtcaaaataagggctggtggagggaaggattggactttctatgtgtttggacacactgtgtgtccaaaattcgtgtggtcttaaaaaatcgtgggagatatgggaataagggattctctcctaatttttgctgaataatcccataaactaaggagtgcaagtggaggaaaaaacaaggatttccaatactggggcgtacaggcaaacttatgttccacaagggggaataacggagggaggttgacttaaagtagaaagactgggtgtcaaccttgagtgttctctaataatttggattatggcccaatttggtaaggggggaagttaagggctatggcggaatgggggggaaggagggagaatcaatgcaggtggggcaagtttaagggggaatatattaggagggggactgcccttgagggggggttgggggaaacggaact

SEQ ID NO: 674360 - DNA, 427 bp, Homo sapiens
gcggagtgttacctttttcccccgcctttgaaggaagtggcttaaacgagtgtgttacccttacgtgcttggcacccggtttcaaccccaaaggaggtgttggtttcttggttgcaggggttccaggaatttccccccaaaaagtcctttttttgggtattccggcgggagcccaaccagggcccccccccttttttttttaccagaattttgggggtggcacccaggggttggaaaaagggggacccttttttttggttggtgggccccagggcccttccgttggcttttccccaaaagacctttgcccgtttggggggttaacccccccatgtcaatttttttttttttttggggggggggggggggcctttttttttagccgcccccttgttccccccctttatttaatttcttgtttccccca

SEQ ID NO: 674361 - DNA, 207 bp, Homo sapiens
cgattgatcgccacactcagtacaatatcttaaatgccaagacttctggaaacagaaagtcagaatcacaggtcctcacttggcaatgaagtatgtggacacttcccactgagagtttctatctttactactttttatctactttcccatcatgtgctcagaaaggaccttagttcttaggtggtggaaagaagtagaaccttatta

SEQ ID NO: 674362 - DNA, 154 bp, Homo sapiens
tggaaagggagtttggctctggtggcccaggtgggtctaaaattcgggggttcacacttgccattcatctcagtttcccagagggtggggatacacgggtgtgagataccaggctgggcctcaaggaggctcacggggcaggggggctcacagg

SEQ ID NO: 674363 - DNA, 264 bp, Homo sapiens
ccccccccccgggggggggggtgttttttttttaaaacccccctcccaccgccggggggggtttcccttttttttttttcccccggggggggtttttttccccccggggggggccccctttttccccgggggggggttttttgggggcggggggttttttcgccttttttttgggggggttttttctttgggggggggccccccccccccccccttttttttttttggggggtttttaagggggggggggcccttttggggcca

SEQ ID NO: 674364 - DNA, 228 bp, Homo sapiens
gagacgttttcacactcaccagaactgttctgagcgggcatctattgatgatctgagtcacctggactcaatcgatcagccagtgtgcacactctgtagtattatccgcatgctgtgcccagcacaatataattgccactgtcgtgatggacaccagtttgggccaacatagacatagtactctagggcagatttcctcaaagctgggcatttgttagcgcgtgctgt

SEQ ID NO: 674365 - DNA, 280 bp, Homo sapiens
gtgggctgggtgcggtaccttatgctattgggaggccaaaacaggaaaattgcttgaggccaaaatttgcagccgccaaaatttgcaacagtttgcaaacaaggctttaaaaaaatttaaaaaaacacctcaattctacaaaaaaaatttaaaaattagccagaattactggcacacttttgcagtcccagctgctcaaaaggctcagtgaaaggatccctcaaccccagaatttggaggctgcagtgaattataatcaccctactgcctaaatctcgaa

SEQ ID NO: 674366 - DNA, 427 bp, Homo sapiens
  misc_feature (105)..(105): n is a, c, g, or t
  misc_feature (114)..(114): n is a, c, g, or t
  misc_feature (129)..(129): n is a, c, g, or t
  misc_feature (141)..(141): n is a, c, g, or t
  misc_feature (146)..(146): n is a, c, g, or t
  misc_feature (186)..(186): n is a, c, g, or t
  misc_feature (206)..(206): n is a, c, g, or t
  misc_feature (209)..(209): n is a, c, g, or t
gcatgaggtttcaaaaataaaaattgagtcccctctccccgtacacacacactggggcacttcaggaggtcagttttccccccttcctcgatggggctttaaagntttgggganaaaagctgctccccnctcatgccccanagggnctgtgaaaaggcttcctgtgacctccgatgggggcccctnattggccaagggccctgtgnatnttttgtgggaggcagcatggccccgtggaaagggcagtaaacgtggagccggcccctttggtttggattccccttaaaaccagttgaggggtttcaagcccttaacctctgtaagcctgttttttttttgaaatcccagtaataaagggtcgtaaaatggttgggaaaaaccaaaggtgacttatgcaaaagctttataaactgtaaagttcctgcca

SEQ ID NO: 674367 - DNA, 935 bp, Homo sapiens
gatatgttggagaaactcttttattagccctgtctgagacgcccccttcgctgccgcgtggggataggcgcctcctgtactcggccgctgggcctcgggaccacccgagtagcacggtccgggggggtcccctcaaaaactggccggcccgagttggggggccggggacccaccactttctgcggcgacgcgtgttggcagatgcatcctcggggaaacacgtcttattgtggtaggcacgacaccgggaagtcgtccagcagaggctgtagcactccccggggtcgagtcttgcgatgtccgcccggcgacagaaacaccaggttgcccgcggcccctacagcccacaagacaacacacccagccaggggggcgtggccccccttagagggactccaccgcagggtcctaataggccctatcctggagagacaattcctcgcgcggcaaagaaaactcgcccaagccaaggggcagcacacagtggtacgaccgcccacggtcctgaaaggctgtgggacgagacacaacgacgtcggggcgacggcgcaagaggggctgttagcagacccccgcgaaggagttctcgacggacgacgacaacttgggaaaccccccgcgagccgcaggcgcacaagcccaccagaggggccaacaggacattctgcgggccaaaccctccggcaggccctacacagccaagtacggacattccaccaggaacacccaacatagggccaagattcgggggcaacaccgtcagatagcacgtcagcgccgcgtggagtgccaagtcagggcaggagatcacacccgctgtcaagagcaggggagggggagagcgcgaaagagatcgccacggcaagaacacataagagaaggacgggtagccaatgttcgagaaaatggggggaggaagcgccaaaaatgacgca

SEQ ID NO: 674368 - DNA, 175 bp, Homo sapiens
  misc_feature (13)..(13): n is a, c, g, or t
aagtacgtacggnccacacgcacggagaaggttacctatcctctgtggtcaatctattatccatccacctatcgtctcttatctgtcaatcagtctgtcgatgacccgtctatcatctctatggctatgctgtgtctctaccatctctccatctccccttctccggtggcgtggt

SEQ ID NO: 674369 - DNA, 1164 bp, Homo sapiens
tcaattggcagaagcaggaagcaagggtctggtgggggcaaagcaggaagcggcagaagcaggaagcagaaggagcggcagaaacaggagaaggagcggcagaaacaggagaaggagcgggagaaggagcggcagaagcaggagaaagagcgagagaagcaggaaaaggagcgagagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgga

SEQ ID NO: 674370 - DNA, 393 bp, Homo sapiens
  misc_feature (381)..(381): n is a, c, g, or t
gtttcactttcctgctcttgttgagggatcctgcatttcattgtctttgcctataccagatacaaccccaatagtcaggatcctcagccccagatgctcactacagtcaagtggctgatggctccctttagctgaattacactagaaactctaccagattaaataagagttcttttggggcttcctatatgcagtcatacttgagaacagtcagtctagacttctagcttgagaatatttgagaatactaagctgcaacagagactcatctcttccaagctatggagtgtagagaatgagttgataaacctgacttggcatactcctctccaggaatccaggttttgtgacacagaactacattttcctctcaaagtcaantggtcccccagc

SEQ ID NO: 674371 - DNA, 682 bp, Homo sapiens
  misc_feature (150)..(150): n is a, c, g, or t
  misc_feature (155)..(155): n is a, c, g, or t
tcccccagttcgcggcgcaccagtaaggcagcatccagtaagcggcagcggtccgcctgctggggtgtatgttgtgttggcctggggtgggggtgctcgctttgtcttctgtcctttggttctccttccataatgctcctgtacccagtncttcngacccaggctcagagagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgga

SEQ ID NO: 674372 - DNA, 320 bp, Homo sapiens
  misc_feature (8)..(8): n is a, c, g, or t
  misc_feature (47)..(47): n is a, c, g, or t
aattaccngggaaggaccaggattatttcattattccggtgataacntttgagaaatcatttaccgtaacggaacttaggacaatgatttacaaggatgttccagagaatttacataagatggcagagcataatctcttgcttcatttgagaaaactagagaaagatgggaagatattctacacaacaactcctgtcaagaaatggaaagccgtcctttagttacagatcagtgaagttctgtcttgttttgcttttagaagatggtattttcttttagctatagattatatatttatagaaaatattaaatgcacaact

SEQ ID NO: 674373 - DNA, 1249 bp, Homo sapiens
  misc_feature (97)..(97): n is a, c, g, or t
  misc_feature (143)..(144): n is a, c, g, or t
  misc_feature (153)..(153): n is a, c, g, or t
  misc_feature (157)..(158): n is a, c, g, or t
  misc_feature (161)..(162): n is a, c, g, or t
  misc_feature (165)..(165): n is a, c, g, or t
  misc_feature (221)..(221): n is a, c, g, or t
  misc_feature (615)..(615): n is a, c, g, or t
gtgaactctctgaactcccttattacctaaagcttgtctggctcccaggaagcagccttatagagagagaggagtatggtattgggaagaagatgtnactgaactattgactgaaagtaaatttagataagatacagcttttnnccttatggncatnngtnnagncaaagtcatcataaactaggtatgcatgctatccgtggatacgacgcttagctctnaaaagatttttatgtaaactgttgaatatttgaaatagtccacttcaccttaatgggtcttgtctatcttcattagtcttcaaagaaaaaccatttgctaccaaagtaaatcagtattttgaatgtgcttctcttgttttggtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaccatggtatgaagatggaaaataagaagatgcactttctgtaacttggtctaaggatttaaattactaacttatgaactccaattntgaatggaacttaactatcggctttcttacgggtaaaattatatggtttattttaaatgcgtacatattgaccaatggcctctgaaaaagcacattttagatactgaaattgacggaaagaaaatgcatcttcaaacatttttgggaatctcaccacatatacttggttagattgggtattggtagggtgtggagggatctcgtatggtatatgaactttttttaaatgtgacagttaaacacatctttaaaagcatagtcacagacaaaagcatacagtataaaaattccttgaaaatcctacaatatatatttggaggcagttcagactgttaatggtggtagctgcttgctgaaggtcttaagtgggtaataaactccaagagaaggcaggcctgtgtaatattcctaaacacttggttcactagcatttaagtttaagaatagcccagtacgacaggcacggttttgactcttagtcttcatgattatatatccgaactgaattactacctagcgggcaacttcattttgcattccggggtaaaacacccttagtttttgcccagaataccagcgcggggaaaacgaggttttacacattgtcccaaaaaagtgtggcgccataaagggg

SEQ ID NO: 674374 - DNA, 962 bp, Homo sapiens
  misc_feature (74)..(74): n is a, c, g, or t
  misc_feature (128)..(128): n is a, c, g, or t
  misc_feature (145)..(145): n is a, c, g, or t
  misc_feature (176)..(176): n is a, c, g, or t
aaaattccccaacggattccttcagcctttattaacatttttcccattggtgccttgccgacttgtggccccgntcctttgtagtattggatggatggaccatttgaaaatgaatggtccttgtatantcaggataaaagaaaanaaaacccaaaaaaagcggtctgaatttaaanagtgtttataataaaaattttaaaaatgaccctcatagcacgcaaaacaggatggggagtttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcatttgtaaactaaaaaaaaaaaaaagggtgggaatcagtgagcataataggtacaacctaacacattattatgtttattaacttggagacccagaaataaattcttttcttttctggattctgggctcttaaaaatacaaaaaaaaaaattgtttggtttggggtaatttcggggttgggtcacatgggggggctttttaaatggtcagggattatgatctggcggtattttctccaatatgtttcccaggtgtctgtgaccaagatgactggcgcagaggagtcgaacaagtaggctggtccttctacttggctcaaaaattcagttaaggccaaaagcgaagatcaagcccatgttgatgtctcgtgctcacctggttatccagagagtgtgacctcatgcagtccccttgggagaacacttcaacatccgggcacaatacttcctcccctttaacacttcttaaacatttccaaaaaaggtttagccccaggggcaaccttttaatggctaatcgggaacgggtatggagg

SEQ ID NO: 674375 - DNA, 455 bp, Homo sapiens
atcaacgtgtacttagcttggggaactgcagccccgcaggcgcttaacaacactagggtgtctgggatggcctgggctaatgtgagatcggcatggttgagatcagcattgtgatgaccagtgttctctggatatttgcaccctccttgcgctaaggacactcgtcgcgcaaggcatttggagctgagctagtcgtacatgatattaccggaaaacttgtgtgtgattccctatcattcataggattcgtggacaggaatactccatctctcagcacttactcacctcataatgctggatgtttcccaaaaatgaatgaactcattctagtataagcaatacaatatattttaacactggtaccgatgcgtcacatctgatagctcgcttcatgatatgcccggattggaaaggctggttagtccctgatttgctcataagtctgcatgcagctg

SEQ ID NO: 674376 - DNA, 158 bp, Homo sapiens
tgtgctgcggtactctaaggattccttattcgtgttgcacgccctgtaattcccgctacttgtggaggctgaggcacgagaatctgcttaacccgggaggcagaggctgcaatgagctgagactgtgccactatagggcgaccgcgagactctgtctc

SEQ ID NO: 674377 - DNA, 508 bp, Homo sapiens
caggtatttcacgtagacgatggggtatcaccgtgttggccaggctggccgcgaactcctgacctcaggcaattcacccgcctcggctcccaaagtgctgggattacagtgcatgagccaccgtgtccagcccaaaactgtgctttttaaaaacagtatttggttaattttccagaccttacctctgttttaaaagtgtgtcatgttggattacaccctgggattcccttctcatctgtgggctttggccatgctttccaaaattacacaggagaatcattccactggaaatataacaatccagtcctcaaaattgaaagtggacaggttgagggacttccctttttggcttcactcagattacggccgcctgtgcagtggccatggtcaacatatatgcatatttgcactatctgcttcatgagcaaatctgtgtccacagtttctgatgacatatggcattggtgtgtcacattgtactgtccctagtctgtggcatcgatacaca

SEQ ID NO: 674378 - DNA, 408 bp, Homo sapiens
tttggcacaaggcaagcccccccctgtcccttgcaaggtgacaggccccttcgggtttgtgttggtaagccttatccctgcacccagggggactgggattgtttccgcacctgtgcctaaaaaaatggtcataaagggtgggatcgaagaatggtacccctcaggccgggggtgcactgcccccctggggaaatttgccaaggcccccttttatgccatttttaaaacctacaggtacctgacccccgacctttggaaggagactgtatttcccaagtttccctatcaggagtttactgacccccttgtcaaaaccccccccaaagtttccgtgcaacggaatcagggtccaacggtgggttcaacaaagggtttttatacaaaaaaaataaagtgaattaagggtta

SEQ ID NO: 674379 - DNA, 132 bp, Homo sapiens
acgtctaagaccccccgacaagccagacgcgactgctaccctacacgacaccacgctacacacacgacgcaccacccacgtcctacgtgtacgcacgacgagcgtacgtcgggacacgacttctactactgg

SEQ ID NO: 674380 - DNA, 121 bp, Homo sapiens
cgtgtgctcgctttatttttcatgtgcaaactgttcttgtctaaagctttcagaagaacgtgtcagacaccctgcagagacgatgggtcatgactgtgccctccgggctcctgtggtgggg

SEQ ID NO: 674381 - DNA, 350 bp, Homo sapiens
gcagactggaacacctgaccttggtctgagaaaacatggccccaggggcagtctgcagccctggagagtccaaagagcttggtgtggcacagatggtctggggtaacaatctggctctgagggatgtggaggtgacctgtgcacccagtctctggaggctctcaggggctacggagatgtggagtggcgcagatggtctggccccaggtcttggcgccccagaatgtggagctctgtggcgctccatgtgaagacagagagcattgtgtggggggtgtgacacagtgcccagagccccgctgaagacaatagtagtttgtctcctggcctggaggacagacacccttgga

SEQ ID NO: 674382 - DNA, 286 bp, Homo sapiens
ctctagactctccctctgggctctattcaggttgcaggcagcagcctcggtcgggccctttccagcactgtgcccggctcttggtggcaccaggttcttcttggctctgccctgttgctctacaatggctgggctcgctgcttggatggcggcagcatgggctcaacttctcggatgggctcccctccagtgccctcgaatccaggcccagccagctccccaggggggggggggtcactcagggatttcttctggggggctttgccagcaatccttgtcgtccacc

SEQ ID NO: 674383 - DNA, 100 bp, Homo sapiens
tgttaagaaaaaaaaatgaactaaacaaataaatttctccaacaccaggggccatggccctgaatgaaataaaggggccatccccttttcttcagaacca

SEQ ID NO: 674384 - DNA, 348 bp, Homo sapiens
actattttgggcttcggctaccgtctggccctaaacgtttaccagcatggccttaattgcttcctaggccaagtgacccgcttcgtggtcgacttcattctgcatcaatgcatttcccggtggatttcaaaaaggggtggctgggttgcaacccttaaattgggcaattgtcccatcctgaacgtgctggtggttttgggttttgttttattggcacaacctagggttttgggggtcaggggggaaaaattttttattcaaccaaattcagggggggggggcagatggagcccataggcccccccctttcctttgagtttttggaaataaactgtgcaatcccctcca

SEQ ID NO: 674385 - DNA, 1559 bp, Homo sapiens
taagaagcccactgtaaaataatatttagcagtcaaatggttatatacttgctgtaagtacctagtaagtagctatagtttagaggtagtaggtatactcatctacctatgagagtgcataacgactatacctaagacaggctttgtttaacaaaagatacaagataacctaagactataagtaaccacagggaatatgacctacagagatggtaataggagtcatgcgagatcacagagagatcacatcacaataatataagtacaaataagatggataacacgaagaaccacagaacgacgagacatgacatacaatacagagaatgagagcacagaaataccaaagagcagacaacaagataccaaaaacacagaagtaagaacatggaagagacaacgtaggagacagcacaaagataaccctaagagagtatcaaggaactcacggtaggaactactaagcacaacggaacacaaaataccccacaacaggacagataacagccaaggcgtcaaccaggacaaagtcaagtaaaaagaacaatagaaccacagacacatgaccaagaagacgacacacactactaacaagacaacaaaaaaacacagacatgatacaaagaaccaacacaaaacaagaaacaactaaagcaatgaaccactcacaaaacgaggaaacaacaacgacagggacacatgtatcacgaaggagtacatacccatactatgaaacagacaaatagatcacaaaaagacagagaacaatcaaatcacacacacacgacacacacgaaaaacaagaagcacgaaagagcgaccattaaaacacaacaagagacaaaaccgaaacaaaagagaacaaggagacaatataggcaagagcacgcacaaacacaaccaacaaaccaaacacacacacaggggatggacaaacaacatacaacaagacaaaaaaacacaagtcacacaaacaacaaggacacacaaagaacacagacaaagacacaacgaaacgacgtcagcacaacctggaaacaatacactgaaccaaacagaacaccacaaaaaagtacacaaaaaaacaaaggaccaaaaacagaaccacaaagaggacaaaacaaaagaggacaaggaagatagaaaaacaaaatacaaagaagacaacagacacacacacgaagaggtgagagaaaacaaacaccaagcaacaagggataataagcaagcaaagcgacaagcaagaccaaagagaccaacagaaagcacctagagcaaccagaacacgaacgagaagagaagaagaaacgaacgagacagagaaacagatcatgcagctgactaagagcaatgaacaacaagagaaaaaccgaagacaagatgctagcaaacagacaagagaaaaccgacaagaagaggcagcaacaacaagaaaagacaagcaagatcaaaaacaaaaaagacaagaccacaaaacaaaagaacaaaaaaaagacagaaaacagaaaacaagcaaaaaagacaacgacacagagacaagatatacaaacaagaaaaga

SEQ ID NO: 674386 - DNA, 320 bp, Homo sapiens
  misc_feature (179)..(179): n is a, c, g, or t
ctttttttggggaattccaaccaaaaaaacccttttatgttttaaggcccaaatttggggcccccaggttctggttcaaaacccctccggggccccccttaaaaaaaccccggtttggggggaaaatgatccccccccaacccgttttttaaggccccggggatggaacctttttattnccggttccccgggctacctgggttttgcccctaataatttttgcaggggaaattccccctttcctgggccaaactcccggtaaaaaccgccaattttttaaccattttttttgtttattttttaaaaaaaaaaccttccca

SEQ ID NO: 674387 - DNA, 191 bp, Homo sapiens
cagagtggcatagagcactctcaccccaaacggccaagttccaaaagaccaaggatgccttagcatgtgactcctgaagggaaggcaaaggcagaggaagttggctgagttcaacggccatgagactatatccctggccactgaaaagctttcctgacaataaaaatgttttgaggctttaaaaagaaaat

SEQ ID NO: 674388 - DNA, 390 bp, Homo sapiens
agtggtagatagaggagccagatggaggatctctgacctctcacggtcagtgtgagtttagaagtcatatggctaaattggttatctcaccaggagccatccgacagcagttggcggctttcttagaaggcttctatgagatcattccaaagcgcctcattatccatcttacactgagcaggagttagagctgcttatatcaggactgcccaccattgacatcgatgatctgaaatccaacactgaataccacaagtaccagtccaactctattcaggtgagctgctgctggaatccctcctcatatggtcctcttaccctaggcaacgctagtaagtgtgataccaaataaaccagtagtactcttagaggaagttgcatgtcgaagac

SEQ ID NO: 674389 - DNA, 250 bp, Homo sapiens
gtctctgtgattctagaggatccctccagcgatgttgtcagcacttccaaccagaaatggcacatatgctactgtggtcggggttgtagccaattttcttaatgtaagtgctgacttccttaacaatttcctacatatgtctatctggcctggtaggagatgagtccatgagcatacctgtgagtcctcttcgtccaggaaatccgacttgatgggtcccttcatgtccggggtaccgtaggctcgtaag

SEQ ID NO: 674390 - DNA, 1813 bp, Homo sapiens
  misc_feature (1431)..(1431): n is a, c, g, or t
taatcgcccggtgtgcaataaagacacaacacaatagaccatagactacaaatagaaataataacaaaaaaatcactcaacacagtcagccatacaacaataatgcaacccacacaacaagttacataaaaatcatcacataacaccagaaaaatccacataaacaactgaaaacaaacactcacaccacgctaataaacagaaacaaaactactacaaaatcgactaagaccttccaccaactaccgatacaccaacacccacgcacatacatcatttcaatacgtaaacacaactataattaaagaacaaacaaaaccacaaatactaatacacaaaagcacacagacacaacatacaacgacaaacacaagaatacaaatacacatactaacacatcccatcgaaaacaacctaaacaactaacacaacatcctcacacacacactcacaaatccgcactaccaactaaacacaatggcgtaactacaacttaaactgagcgaaaagacacacacgtcaaacataacactgacggcaaacatacaggcacactcaccacaatggcaacgtgaaataacagccaaagcggaccacaaaaagtgcacgccacacacgaacaacacaacacatataacatatcaaccgacatgagaaacatcgaaagcacacagaactgagtacacaccagcgagagcaaaacacccataggtgagaagcagcagccgtatacagcaactaaatcagcagcaggaaagaaaccactacaaacgacacggactcgatgattcccaaagaatatgagccatgagccacagtggtgacatgacgacacatcaaccaggaccggccagactagaaaccagatgcatacacaacacaactaagacgagagtgagaagcaacacttgaaatgaaacgaagaatgacggcgacaagaaatgaaggcgagagaatcaacaagacataggagaaccaacgaccaagcacagcaaacacagcactagcatgtgcacgacgatagacatgagaaaaaggagaacacgtacgagtcgccagacacggaaagcaggcagacgagtaaggcgcagcgcgagctgaggctaggatctacgagcgcgtagcatgaagacgaacgcatgcagaacacaacgtagacaccacgactcgggaatgacagcaggagagagcgccagggccacgagaacggacagtcacaaacacagtaacaggatgacacaagagagcgtagcgataactacaagacggcaactctgtagccgaccacagactagacagcgtaacaggtaggatactaggtcagacgagaggcacgatactcacgacaagacggacagacggcgtgagacgcacgtataaacgacgcgatagcacagtcctacacagccgcacgcacacgctactacgcanctgcagaagagagtacaacgatgaggacgtgcagtagacagaaggaagaactacagagagagcgagaagagaagacataggcgaagagtaaggggacgacaattgacgacagaaagaaggagatgcagaagctagaatgactagcagcgcaacagcgaacagcgagcgagaagggacacggaagctcagagatagaaggaacgcggaagcaagtaacaccgtagcaaacgaagcgacgccaaactagcagacgaaccgaagcaacgacggaagaagagcgcgagaaagcaacaagagaagtaaacgacggagaaacacgcgacgaagaagaacatgaagcgaaatacgagaagtgcgaagagagacagaacaatacagacag

SEQ ID NO: 674391 - DNA, 204 bp, Homo sapiens
ctgtctggagtgcaatgtgatcaatcttagcatcacgttgaagccgtttaattcctgtgcctgaatagatccctccacctgagcctcctttatagccattcatgtgccagcctgcctagctattcttttttttgtttttttttttactttttgtagagaagggatctagctattttgcccagtgcttcaggggtaccgagctcg

SEQ ID NO: 674392 - DNA, 618 bp, Homo sapiens
tagtggttttgattgcatcccctaattagggatattaagcatttttttcttatgtttcttttgaaaagtgttcatgtccttggcccattttttaatggggttcttttttgcttactaagttccttatagattctggttattaaacctttgtcagatgcacagtttgcagatgttttctcccattctgtaggctgtttactctgttgacagttccattttctgtgcaggagttctttagtttaattaagggttatttggcaatttttggttttgttgcagttgcttttggagtcttcatcatgaagtctttgccagggctgatgctccaaatgggatttcctagggtttcttctagtattttcatagttttaggttttacatttaagtctttaatccactttgagttgattttcatatatggggaaagataggggttcagggtcattcttctgcctatgggtatccagttatcccagcaccatttattggatagggagttctttccccattgcttgttattgtcgatttggtcaacgatcagatggtgtcaggtatgtggctttatttctgagttctctaatctgctccattagtccatgtgtctggttttgtaccagt

SEQ ID NO: 674393 - DNA, 917 bp, Homo sapiens
  misc_feature (17)..(17): n is a, c, g, or t
  misc_feature (41)..(42): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (73)..(73): n is a, c, g, or t
  misc_feature (79)..(79): n is a, c, g, or t
  misc_feature (86)..(86): n is a, c, g, or t
  misc_feature (104)..(104): n is a, c, g, or t
  misc_feature (122)..(122): n is a, c, g, or t
  misc_feature (149)..(149): n is a, c, g, or t
  misc_feature (153)..(153): n is a, c, g, or t
  misc_feature (171)..(171): n is a, c, g, or t
  misc_feature (193)..(193): n is a, c, g, or t
  misc_feature (199)..(199): n is a, c, g, or t
  misc_feature (207)..(207): n is a, c, g, or t
  misc_feature (222)..(222): n is a, c, g, or t
  misc_feature (225)..(225): n is a, c, g, or t
  misc_feature (231)..(231): n is a, c, g, or t
  misc_feature (234)..(234): n is a, c, g, or t
  misc_feature (248)..(248): n is a, c, g, or t
  misc_feature (250)..(251): n is a, c, g, or t
  misc_feature (285)..(285): n is a, c, g, or t
  misc_feature (294)..(294): n is a, c, g, or t
  misc_feature (348)..(348): n is a, c, g, or t
  misc_feature (359)..(359): n is a, c, g, or t
  misc_feature (371)..(371): n is a, c, g, or t
  misc_feature (378)..(378): n is a, c, g, or t
  misc_feature (395)..(395): n is a, c, g, or t
  misc_feature (401)..(404): n is a, c, g, or t
  misc_feature (417)..(417): n is a, c, g, or t
  misc_feature (419)..(419): n is a, c, g, or t
  misc_feature (429)..(429): n is a, c, g, or t
  misc_feature (446)..(446): n is a, c, g, or t
  misc_feature (449)..(449): n is a, c, g, or t
  misc_feature (455)..(455): n is a, c, g, or t
  misc_feature (457)..(458): n is a, c, g, or t
  misc_feature (467)..(467): n is a, c, g, or t
  misc_feature (496)..(497): n is a, c, g, or t
  misc_feature (503)..(503): n is a, c, g, or t
  misc_feature (530)..(530): n is a, c, g, or t
  misc_feature (534)..(534): n is a, c, g, or t
  misc_feature (536)..(536): n is a, c, g, or t
  misc_feature (556)..(556): n is a, c, g, or t
  misc_feature (781)..(781): n is a, c, g, or t
  misc_feature (797)..(797): n is a, c, g, or t
  misc_feature (876)..(876): n is a, c, g, or t
ccgcccggtccgctgtngcagcgctcatccgcgccgggagnncttggctgngtngcncggcagccgcgggagnatttcntgaagangtagtcatgcagcacgtnagcagctcccagagcagncagcgccatgtccagtggcctggggcntgcnccggcgcgggcgaggagnagccagcgtgctcccagccgtncctgcncctcacantgccatcccccagcnacnaactanagnagctgatggtccananncagagtcccacgcagcccagtccggggccggggnaggccttgnagaatgtgcgtgcaggtgcccctggccctgggctgggcctctgcagcagcagcnctaaagggganttcgtggatgcnagcgtgntggtgaggaagataagnttgagnnnntccagtggtgganantttgtgtttnaggatgggtaagggctnacncagatngnncagggagcncaggttcagctccagcacccgcggtacgnncataanagtccgagagcggagaccctcccagcnccananacagtaagggggcacacatncacacacctggggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcangggggtttgggatgangtcccacccccgcccaccagcccttccaggactgccgtgccccaggcctttccagcctcccactcacgtctgtgggganacgggaatgaagaaggttccaagaagtagaggagattcccc

SEQ ID NO: 674394 - DNA, 129 bp, Homo sapiens
aatttcggggggggtttaaaaggggttggggggcttttaaaaaagtttttttttgggggggggtcccctttttaacccccggggttttccggggggtttttttttaaaaaaaaaaggggccccctttta

SEQ ID NO: 674395 - DNA, 235 bp, Homo sapiens
atgacatgtgagatgattgcctactctgcatccaccatgattgaaagctccctgaggcctcctcagaagccgagcagaagctgtcatgcttcttgatacagcttgcagaaccatgagccaattaaacctcttttcttcttaaattacccagactcaggcatttctttgtaacagtgcgagaacggactaatacataagggatatggtattcagtgtgcttgacactgcactgcca

SEQ ID NO: 674396 - DNA, 1545 bp, Homo sapiens
  misc_feature (408)..(408): n is a, c, g, or t
  misc_feature (558)..(558): n is a, c, g, or t
  misc_feature (614)..(614): n is a, c, g, or t
tcatggttaaaaactctttacttgatgtacatgttttaataaaacaaataaccaaaaaaatatcacacaaatccataagtttatttaaaaacacttaggattttaaaaaaactatgtcttataaaatatcacacacgttaaaggcagttgggaaatcgctatttggtcactatttctacaacgtccataaatatttcccttggaaatataacaatatggttcaatcttcatattcttataaaatatcaccactggtgcactattttaacaaactggtgcctaatattataaggccaccatcttccacatatgggcatctggtgggggtttgggatacccgtggatggacaatatgggtatctctaataacatattctccaaggggggagaaagggtggtgaattatgnggtatgtgtggatgttataaacactttattaaatatatctatgtttagaaatataaatattaatattcttgagaacgctatcacgatatttctatcacaaatatttcttattatcaccaacgtgtcaccacgcaacatctgggtcacacnaagacccccagagttttaatatcactatttttaataatacacgagattgtcacccnagggggtttaaggcaaaaccccgtagtatagagggaaggcgaaggaggcaatataatcaacgtatttcttcgcggatattttattttaaacgctattaaaagacattttcctggaggaatgagcttagaaaggaaaacacaaaaatatttggaacaaaaaacaaaaacaaaaagtttcacataaagagaggaggacttttttcaattcacctagtggggggaggtagggaaagaagctttttattagtaacaaatttaacacaaacaggttgtgggcattattaatattaccaacaccaacacgctattggggcaaaccccccccgcttataagaaattctacagtgaactattttgtggaggaacctcgtataaaaagtcctataagaggaaaaatggtgcgtcgtacaaagaagcacaccccagcacagcagtggtgactagtgcgcaagctagcagacacttaacaggcggcgaaagaggggcagctacactctgtatactccacaacgagcacaattatagggaggggggagtccaccccccaattaaagagagaaggagtgcgcgagcaccacacaccattaacaccccaagcgatgacctgtgagaacaaaccaggggggggcgcgacaaacaaaaaggagagaacaacagaaagactagataaaaggaggaggaacatcagaaggcaggctagacagaagaaagaataaaaactaaacaggaccaaccaagacaggaacagaacaagagagaatatatgtgccccaacagaagagacataagtatagcccgcggcagaaagtaacagatactaccaccgccacaatgagaagacgagcgggaaccactcatcatagaggaagacaaggacgaacgacgcactgaccacaatagtcaagaagacagaatagtagcaagagcagac

SEQ ID NO: 674397 - DNA, 200 bp, Homo sapiens
cccaccgagggtgacacagtacctttactttctgcagatgtctaggcaggaggagggcttctgcctgttttgcaaagtcccaggccagaggccaagggatgaggcctgactcggctccttccgtccataataagccaagggcatcagaggttggccagggcggggtcttccttgttcgtttttggcgagcctaagtggca

SEQ ID NO: 674398 - DNA, 1541 bp, Homo sapiens
  misc_feature (1155)..(1155): n is a, c, g, or t
ttgtcgatgtagtacggtcagtcatacgctctactgtcgtgcagcgactgttggtggtgcttcgtgttttgtccctccaccctacgaactaatgttggcttgtttgcggctttcgactgctgtgggctgcataaggtggttgcactgccggtcccagtagtgtattattttctccgccgctgtgttgtgatcaactgttggcgccgcctcgttgcgggatctttcccagtatgcgtctttctgccagccgctgttggtggcgccccatttttggtggggcctctggttagctgtgcctgttcccccccttgggtgtgacaccacccctgtttaattagttgatattccccaccggcctttcttggggaggaggcacgcgggggctttcctccgcctccccccccgtgtgagttaggtgatttgtgtcgttgcgccgccgcacagggcgcttttcgcccgcatggttggcgcgcgcgtggttgcgacctgttcgttgttctgtgtgggttcccctccacgtgtccccgcaaagtttcagattacccgccccgaattttctggggggaattgtggttctgcctcccccttaatatccccgtcccgagcccccgggttgatatttgggccccccacaacctgtggttacccctgggggaacttgccgtcaacactctcttggtgtggagaagtcacggttcccatatgcgcccgcggtaccacctcggatgacaccgtttcccttgagcccgcgtgaatttggggcccccaggtgtttaattgacttggcttaccccccggggtgggagagacacgtggttaaacaaaggcccacgatatgaatagccctggaaaatttttcctggccacggaatttttgttgtggtggcccctctcctgtgtacctcgcgaaggaatttaatcgtttcgcgtatacacacacagaggcttataccacacgcgaaggggttttgtctcgaaaggccacccactcgtggccgctcaaatgttcacattgtcttcgaatgaggttttcacgagacacacgtgggctgtaaaactcgttttgttgcgctagactgtctttcacaatggagaagcgagattgttccctctaagattcttttcccacccacttcaccacacactgagaatttngagaagagtgataaaaagagaagctccacgttggcctcactaaccacacactgcactgttcttgtcctgtgtctatattatatcgggcgaacacactcacgaccgctttctgaggtataagagataatatttctccacatggcacatataagtttagaatatatatacctgagtattggtttaaaatcactggtattgacacatgccatgttataatcacgagttaaagcaacggaccaccacttttgtgtactcgccttcttcttataatcgctgagaatgtaacctgttaatgtataaagtccacatttaggttttatatgtttctaaagaactatttgctgcaactcccagattttcagtaaaatagtattactagtacccca

SEQ ID NO: 674399 - DNA, 442 bp, Homo sapiens
  misc_feature (81)..(81): n is a, c, g, or t
  misc_feature (115)..(116): n is a, c, g, or t
cgactccaccgtgagctctcgagagtgcctgcctgcctttcgccgggggcaggcgggcggcggggcaagaggaggcgccgngcgctggcccaattctcgactcggggtaagatgnntccgctccgaactcgccggcgcgaccacacgcacagcctctcccttcccagcctccgtgctcgggcccggagggtcgcggaggctgttggcggcgcggagccagcccggcgcgacctcaggcggcgcagcgggagcgagtgcgggtctccgagctgcccgcccgcagacaaagctgacaacatggctacctccgctcctccgctcaaacaagttcctcgcaagttgagcccggcaggcgcctgggctgcggcggaaagccgcgcgcgcctcggcggccgtcgtccatcaacttcaagtttccctccgcagagcagcccgcggccgc

SEQ ID NO: 674400 - DNA, 724 bp, Homo sapiens
ggctgcaggaattcggcacgaggagagagagagagagagagagagagagcgactttctcctggggcgctggcgtctgttttatgtgcccccgtcctttaaaatattttctttaggctttcctgctgtaagtcccgctttcctatctacctcttataaaaaggggtcactctttggcacgttgtttttttaagcacacatgcgtattgggaccttaactgtattcccgattttttacaaccctatgtggttacattagtccccagatccccaaccctttatttttaatgtttctttaaacaaaaatttacagttctgtaatgtatcacctttaatttcacttgggctcatatatccagggcatgctaggttatattttggaaagtcctgcatccattattccatttgagtgccaactaaccgtctttggttttgggcccttttaatgcccttttcccggtaatttacatttggacaccggacgattttttttcctcaatttgaaaaaacttttagatcttttccccatttttaactacttttatcctgtgcaaataggttttattttccttcttctaccgggggcacaaaaggcctcccctggtatacaatctttcctatattccaatctttcggtatttcgaggcgttctcggctataggctctcactctttttctctccaccttttcatcattccaccaccttatacgttgccctcttccccg

SEQ ID NO: 674401 - DNA, 499 bp, Homo sapiens
  misc_feature (44)..(44): n is a, c, g, or t
  misc_feature (51)..(51): n is a, c, g, or t
  misc_feature (58)..(59): n is a, c, g, or t
tagggcgggacagaaagtaaagggactccgccaatcctaccccngccctgnttacaannaacattaaccttttagagataaccggttttaaagggccccgcttcccaaggccccattttttaacggcccgggggcccttaccggggaggggggaaaaacccttttcccttattagggccccctttaaaagggccccccggggggaacctttttttttttttaacccaaaaaataccccccccccgaaagagggggttttccccccggggggagaaccttttgggggtgtttttttttttttttagcgaggggtttttaaaaaccccgggggggggaaaaaacaccctgttttttatttattttgggggggggggggggcggggggacaacccccccccggggggggggtgtttttttttccagaggagccttttttttttttttgcccccccccccccccccggtttttttttttataagaaccccccttttttttttt

SEQ ID NO: 674402 - DNA, 806 bp, Homo sapiens
  misc_feature (44)..(44): n is a, c, g, or t
  misc_feature (63)..(63): n is a, c, g, or t
  misc_feature (72)..(72): n is a, c, g, or t
  misc_feature (74)..(74): n is a, c, g, or t
  misc_feature (88)..(88): n is a, c, g, or t
  misc_feature (91)..(91): n is a, c, g, or t
  misc_feature (98)..(98): n is a, c, g, or t
  misc_feature (105)..(105): n is a, c, g, or t
  misc_feature (113)..(113): n is a, c, g, or t
  misc_feature (115)..(115): n is a, c, g, or t
  misc_feature (118)..(119): n is a, c, g, or t
  misc_feature (135)..(136): n is a, c, g, or t
  misc_feature (164)..(164): n is a, c, g, or t
  misc_feature (180)..(180): n is a, c, g, or t
  misc_feature (183)..(183): n is a, c, g, or t
  misc_feature (245)..(245): n is a, c, g, or t
  misc_feature (265)..(265): n is a, c, g, or t
  misc_feature (267)..(267): n is a, c, g, or t
  misc_feature (290)..(290): n is a, c, g, or t
  misc_feature (325)..(325): n is a, c, g, or t
  misc_feature (361)..(361): n is a, c, g, or t
  misc_feature (363)..(363): n is a, c, g, or t
  misc_feature (369)..(369): n is a, c, g, or t
  misc_feature (382)..(382): n is a, c, g, or t
  misc_feature (386)..(386): n is a, c, g, or t
  misc_feature (389)..(389): n is a, c, g, or t
  misc_feature (396)..(396): n is a, c, g, or t
  misc_feature (404)..(404): n is a, c, g, or t
  misc_feature (424)..(424): n is a, c, g, or t
  misc_feature (455)..(455): n is a, c, g, or t
  misc_feature (465)..(466): n is a, c, g, or t
  misc_feature (468)..(470): n is a, c, g, or t
  misc_feature (476)..(476): n is a, c, g, or t
  misc_feature (496)..(496): n is a, c, g, or t
  misc_feature (519)..(519): n is a, c, g, or t
  misc_feature (650)..(650): n is a, c, g, or t
  misc_feature (745)..(745): n is a, c, g, or t
  misc_feature (772)..(772): n is a, c, g, or t
agaagagtacagctcacccccagcagtggagggggtaaatctcngggacaaggtggggcagtngggatagcncntccgaccctatggngtntaccttnaagtagnaaggctgncnatnntgtgtagaaaggtctnnacttctgcctgagttttgccaaacccantggtctatagggatgnggnaaaagaatgacctaccgcagtgtgattatcagtgttttttaaaataaagagcacagttttgnctttaaaataattcacatcnanggtatttgggagaacatggagcnggcataacattggcgtaggaagcgggggcgcaggnccacccacggggccctcgtgtggggacgggtgcctnancccctnagtccctcgaggntctngcnacgggtngctgcctntgtgtcttttttctcgtctntctcaccccgagaagggagttgaacaatgtntttgttgttnngnnnaagtgngtggtaatggcgtgtgcgantggtagctgtgcttcagcggtgntctacaggctgatgggggcagggctgctcctggctttctgtgggcagggcttgcctccagggaccccgagtgcttgcacgcgctcggtgacagtggctggcaggtctaagtgctgctgctggatgcacatncctttggtagacttttttttttttaagaaataaataaaaacaatttttgggttggcacctgaggtaataagttaagaataagcaccaaaatggcncttcctggcacgcgcgggctcacaggntcttcatgcacacatggcagcggctgatgtgtgt

SEQ ID NO: 674403 - DNA, 1094 bp, Homo sapiens
ggatcaggctcatagaacttggcatgtggagaaggctgtatcaagaatcgtaatgtcttcgagagagaacgagagagaagattcgtctggtcattcagcccaactgcaaggaacatgctcgggggctcctcctcaacaatcaccaggtactcgagcaacacgtgggatcctcgaggtacaggcagccgagctccgttccagaagagatccttacaaccaggtacaaaaaaatagacatgaatctcacgagatctctctgggacgaagtccgagctgacgatcgctttggcctgtagcaacgagggtaaacgagaccatttgcggttccgtcgtgggcgtgggccacgtgttgccagtgagtcgtgtaggaactgcttggagtgtcacctttacccacatgctggtgctcgtctcatgatgttccatcggtggtccatgtgtactcaggggggccctggaagtggtggttcggatgatgatgttgacatgaaaactctataggatacagaggcaatgagatcgtgacatggagaaatcgctctaatgtgattgaagataggaagagcgagagaattgtggatgagagtatgggtctactctgggatgatattaacctggtgcgatgtaattgatagtctatgacgtggtggtattatagaatcagaaacagtgcatcatggaggactgaaatggagtactctatcccttacgaggggggatgcatggcaggggagtggattaagccatgacccggcctgattgtagaacactccttgaaatgctgtctagagacagacatgggcttggacagccacaacgaaggaggtggggggcgtgctgaacaaaaagacgtcaccctgtgcatgaagaccatgaactgaccagatgggaagcggagagagcacattgaagaggaccccctggggcgggacatggaagacaaagggggctctttcagagcacaaaatgggaaacgagacatcactgatcgaaagattaacatactctctgaccaatctcctagcaaggacagacaaacagataaatcaggagacgagacaaacagacaggaaaaaacacgagaagtgccaagg

SEQ ID NO: 674404 - DNA, 208 bp, Homo sapiens
atattgaaggatgtcaagttcctcatttcccatacaaaggaatggtggaggattcatctttcttggaatctttggctaaggtggttggaagggggacttttggcatcttttcagggagggcctataattggggccctctaactaaaaaggtctcctatgccccttaggataggatgagattttttttttgacctgtaccacacatgtg

SEQ ID NO: 674405 - DNA, 214 bp, Homo sapiens
ccctgcagctgggggcaaggcagctctctctttccctcaccatgacgtacggtcctctgccgctgctgcgtgccttccagaggcttcgatccacccccatgaggctgtcttactctttcagtgaccacaactgtaccttcattagccataaggctgctctcaccaaggtagaagctggcagcatacaccctctctgtcacaacggcacgtggca

SEQ ID NO: 674406 - DNA, 930 bp, Homo sapiens
  misc_feature (705)..(705): n is a, c, g, or t
taggacttagtgttgcgaagatttataggaaacaaatattttatatagaagaaatcccggtatttttaacatcacaagaaatgggtaaattactagatgagagtgttgttttttttcctaagattccagagggaaacataattccataataagaattaaaatgtggatcccgatatttaatttaataatttgaatcggtattggattttaaacattctaaagtcctgggtcccaggaagtagagatcatggaacataatttatagacagtaaagggcaatcatcgtatatatgggatggaaagaaaaatacagcatacacggcttcaaaagtaaaggtttcttaagggatatatagtatatacgtggcatgaagtaaatacaaaggtgggtatcctgtgcctgtatggattttcctcctcaagtcttccttggccctacctagtgtgtactagagaacattttctacaaatttcaatcgcaaaagaggaaaaattacacataaagccaagggccaggacagggaagtgggacagtcgggagtggctactcatttcgggtaagggttataataacatacaaatcatatggtctactatatccgtaaaaataagcgatacctcttaggtgaattataaacccttctggtgtaaagtcaattggccatagcaaagtgagtttggtgttgttcacaagttcggaatatnggcggcccacaagtgaggccagattgcatagaatatagaatggtctaaatgccaccaacatcagaagggaccttcctcgggggggctaacaaccaaacttgtaagcaacggaagacatcgggaagccaccacatgagttgtataccaccccataacacctgacacagttgaatgaactgaaaccacctaataacatatcaatcctaccgacacacagcacaagtt

SEQ ID NO: 674407 - DNA, 132 bp, Homo sapiens
gggatgcaaagcttacagccagtggcaacaatgattaatgagacaaacacagtaagtacagcatggagtaggctaggatacggaagtataaaggtgctgcagtgcccaggtacagtaaacacccaacctggc

SEQ ID NO: 674408 - DNA, 228 bp, Homo sapiens
gagagcagcacggtggctgtggctgtgcggtggcagttgctgccgcagcagccacagctgcagcagctgccgcttgcgtgaatgtcagtggagggtcttgcagcatgtgatgtgggatggcccatggccccccgtggcctgcctgcataccctggtggtgaatgccgggggccccatgggtagcccccgctggctgtacactgccttgctgcacgacagcccaaaact

SEQ ID NO: 674409 - DNA, 174 bp, Homo sapiens
ctcgataaggccaatggtgagggaggtgaagtgagaggtatggttctgagtagtcctcctatttttcgaatatcgtgtcattgtgtaaggttggtggatgatggacccggagcacattagatagtatggctttgaagaaggcgtgagtacagatgtgcaggaatgctaggtgtg

SEQ ID NO: 674410 - DNA, 269 bp, Homo sapiens
tgtacaaaaagaaaatagatatatacagaatgcagaagtatcatggagttaacaccaagaatcagtcatggaccatatactacattaatagaattatagacgttgaactttctgatataaaaattggactgagttttgaacttttggtaagaaataaaagccgattaagcactggccgacccgcggctggtacccaatgcccgagtcactgtggcagcattcgcactggtgtggggagtcctttcaactcaaggaggctgggtttctgg

SEQ ID NO: 674411 - DNA, 204 bp, Homo sapiens
tgatctacgatccttatgcgcgcaggcatgattgagaagctggttaaggagggcgcgcctggagccctggtggacccgcgcagcgtgcagcgatccaccagcttcggggtcccaatgccaacagcatcaagcagatgctgctgcacgtggtgtcagagccaagaactcgcggctacgaagcactgtcgacatccgagaacttct

SEQ ID NO: 674412 - DNA, 162 bp, Homo sapiens
ttatcagcactggctattgacaaggttattttgtaacatttgtcttactttttacttgttataagctttgcctcaggttggctaatcttcattttatgctgccattattgttgctgcttattcaaatttcttgtaatttcagtagagtgtgaacgactttca

SEQ ID NO: 674413 - DNA, 377 bp, Homo sapiens
tgtgtgttcagaaagcggtctgggcttaagtttgggcttggtgtctgctccttgacactcaggatcaggcagagcgacctagagactgccttcacggcgcgtccatgtctaggtgtgccccgggtcacggctggggatgtgggggccatttttccctgagcacaggctgggagggagtggcgggatgagcaggatgggatggtgctgtccctcgaggtttggtatatttgctcctagagcagtccaggaggcatgtgtgggtctagacgcatcactcaattctgtccctgctcttgatagcgccattcgcgaaagatttcccaaagttactacgccttggatggcccatgagcgtaccccaaaacaaattgcccttg

SEQ ID NO: 674414 - DNA, 728 bp, Homo sapiens
atcatccagcgccatcggcctggcgcttcagccaacgcgggagtggatgggccccttcttcttcgcagacatgcgttcggcctgctgccctgggctctaggctgcggccggacggcccagtctggatgggttctggggctgtgagtgccctgggggtggtgctgctgctgccctgtgggtcctggcctctcactctgctcccctctcgtccgcagccgcagggccgtaggcagccatggctgcccagcctggaatggcatggtcttgaagccccacttccacaaggactggcagctggctgcgtggccactgtggttcaaccatgccgtgccctgtaatgatcctgcagactgtaatgtgccctggcaatgccaatggctgctgcctgcatacgcccctgccgcccctgcgtcgggtcccatcctggcccatctgtgctgctgccccacggttcggtaccacactgaatggtgcgctgccggccgcggcttcagcctggatggagctcagggtgtgccggcattcacaagaaggtggcccggaccatcggcatttctgtgtgatcctgaggaggcggaacaagtccacggagtccctgcagaccaaccgtgcagctggctgaaggagtacctgctccaaactcatcctcttcccaggaagccctcggcccccaagaaggagacagttctgctgaagaactgaaactggcaccaactgaacggacggca

SEQ ID NO: 674415 - DNA, 332 bp, Homo sapiens
  misc_feature (56)..(56): n is a, c, g, or t
  misc_feature (100)..(100): n is a, c, g, or t
  misc_feature (109)..(109): n is a, c, g, or t
  misc_feature (115)..(115): n is a, c, g, or t
  misc_feature (155)..(155): n is a, c, g, or t
  misc_feature (181)..(181): n is a, c, g, or t
  misc_feature (185)..(185): n is a, c, g, or t
  misc_feature (228)..(228): n is a, c, g, or t
  misc_feature (235)..(235): n is a, c, g, or t
  misc_feature (243)..(244): n is a, c, g, or t
  misc_feature (250)..(250): n is a, c, g, or t
  misc_feature (271)..(271): n is a, c, g, or t
  misc_feature (284)..(284): n is a, c, g, or t
  misc_feature (289)..(289): n is a, c, g, or t
tctgtatcaaaagtagaggctgtgaattggttatggtactcttgcctgagtgtggnctcagaatccaacccatataccacactctagcagcagcaaaatncatcagagntggctncaagcggaactaacgggcctgtgtgtggcctgtgagaganccctattccacatctatattagagcnctgnacagtgtgagctctatacccagcctcgagggacaggtataggnaagagangtgtgttnncagggnaatctcattttatacacaatncatatcggttaanaacantatttactctatgtcacatcacggtctaagcccttattgagtt

SEQ ID NO: 674416 - DNA, 1070 bp, Homo sapiens
ggagaactagtctcgagttttattatgtttattggcggccccaggtcattgaaatgggacactttattgaggctccagggccacgtgggcctgggcaggatggctgcccttcaaggaaaagaacaaccttattggaccttcttcttgggacgcaggttgttggtgtgaccacacttcttcttgcggcagttgacagcacagagggtagaaggcgagcatagcacttgctggagatcatcttgtcgcagtagtatttctggagcaacgctggctggagaaggaagggctcagattaatgccacctcgaaggcgcaaaaccatggtgcagggtgagactcttcctggatgtggtagtcgtgacaagaagatgtgcggcatcctccagctgttagccggcaaatatcaaacgctgctggtcaggtgggataccctcctgtatcttgaaatttgggcttatgacattctcaatggtgtcacggggctcgacctcaagggtgaatggttttgccagtgagggatctacacaaaggatcgtgcaatgttggcagtccgaagagacctgtcgccgaattagatcttcaagattatatatattaatattgtataaatataattattaaaaagtataaaagaaaatagggaaaattttatgaaagagggaatatgaaaaaaaacaaccacaaaagacggcgtaagaaagacgcaggagagcaacctccagagaaaaagaggtgcaacacaagtgagcacacgacacatcaaaagagaaacacggcccgataaaaaagacgcggcgcatcaacaaaaaacacccccaaggggtggacccagtgagacacagaaaaacaccccgataggtgtatgacaccagataagaaagaaaagaaaacaagaagacagacaacagcactgataggaggagagataaaacacagggagtaataaacagataaatgaggtgggatacacaccccatgttaaggaagaaaaaatttattacacacgagaagacacgataaataacaagaagccgatgaaaatgtgttggggtgatagaaaaaaggacaaac

SEQ ID NO: 674417 - DNA, 299 bp, Homo sapiens
acgcgagcgccataccaactatatgacattccggaaaagccaaaattatggagacagtaaaaagagcagtgttttccagagggaggaatgtataggcaaatttttagtgcagtgaaatgaatctatgtaatactatagtggtggatccatgtcattatacatttgtccaaacacgtaggatgtaaccaccaatagtgaaccctaatgtaaactatggggtttgggtatcagaatgcatcaatataggtttatcagttgtaacaaatgtaccactctggtatggtccctcggcgtgtgca

SEQ ID NO: 674418 - DNA, 331 bp, Homo sapiens
cacctccagcccggtttcacccatggtccagtttcccagcagcagcaacatccccacgcagccccccagcaagtcttttggcaagccggaggacgcagcccccaagaccaggggacagggccagaaggaattgttgaaacagcctgccagcagggcctcagtgcccgagttggtcccctgccattccgggacctttttggagtacacttgggagtccccccccgagatcacctgcagctggccaccccacaggcccccgtgcctgcagcactattggtgcctgaaacccctggcctgttaggaggttccaataaagctaacccggaccaga

SEQ ID NO: 674419 - DNA, 295 bp, Homo sapiens
gatagaacgatcagagagagagaaagacccgagagagcaagctgcagacttaaatgtccctgtctgacagctttgaagagagtggtggttctcccagcatgcagtttaagatctgagaacagacagactgcctcctcaagtgggtccctgactgccaggtagcctaactgggaggcacctcccagtaggggcagactgacaccccatatggccaggtgcccctctgagacgaagcttccagaggaagaaccaggcagcaatatttgctgttctgcaatatttgcttgtaccgctg

SEQ ID NO: 674420 - DNA, 808 bp, Homo sapiens
tggagacagagtcttactctatcctccaggcgggagtgcggtggcgcgaggtcttggtcacgggaagctcgtggctccggggttcacgcgattctcatgcctcaggctcccgagtagctggagtaacgggtgcccttccaccacacccagctaatttgggtatgtgtagtacaagacggggtcgcgccatgttggccaggctggtcttgaactcctgacctcaggtgatcctcccgcctcggcctcccaaagggttgggattacaggtatgagccaccatgcccaggctaaaataaaattattagattactcttaaatatatccaggggcgataaatactacatacagccaaaagtgagtgagatacctagtggctatctggttaaacaatcacgggaaaaagctcttcttaggcaggcagaaattgtgattatgtcatccctttctactcttggaccatatatttgaatatgcctcagaatttcagccgaaggtaatatatcttaggcttcacgagtatgttaatatagcggggcacagtggctcacacctgtaataccgcagtgcttagggagcgcaaaaggctagccagatcacttgagcccagggttggaagaacaagctggcaagcatgtcggaaccccatctctactgaatatacaacaaagttcaggcaaggtgtggtggcatacacctacagtgcccagcaaccaggagccgagggggaggacactggggcaggacgcgaggtccaggacaccggtccgacctggacttgagcggggagacagaacttctcaaatcagcg

SEQ ID NO: 674421 - DNA, 138 bp, Homo sapiens
tgcgcttatccgtacaggtagtgtcgacgcatccgcccaacttgtgctccagctgttggaaggccctgtcggcctgtgcattcacagtgtccagttccagctggatggcctccagtagggtccatgcggacgagcctc

SEQ ID NO: 674422 - DNA, 192 bp, Homo sapiens
atgctgttctagaggatcccactgtctgagcagtatgtgagctctcaggaaagggaggaaaaagatgttgataaataaggagtgcaatttcttgaggcaggtgacgaggtagggaggcttactatttttaatgccctcagaccccagtactctgataatcagatggagaccagtgtccaagtcttgcaatca

SEQ ID NO: 674423 - DNA, 159 bp, Homo sapiens
gctgaaaacgtatatcgttgagtatccttaatcttgaacatcaaaatcagagactgcttgtgagtgctgagcatgacaccaatgaatgtggagacattcgacatctgatgtcatgtgacaggtcacagtcaaaactttgttttgggtcgggcatggtgg

SEQ ID NO: 674424 - DNA, 309 bp, Homo sapiens
  misc_feature (31)..(31): n is a, c, g, or t
  misc_feature (263)..(263): n is a, c, g, or t
  misc_feature (284)..(284): n is a, c, g, or t
  misc_feature (305)..(305): n is a, c, g, or t
ttactttcattactgcctcagccacttgtgnaagcatttttccggtgttgtggtattgttacattttatggacaatgtttttgtgacgatggacaaacctgagccccaacacttgaaaacaaaattatgttttcagggctgggcgcggtggctcgcgtgttaatcccagcactttgggaggcccacgtgggtgaatgacaaggtcaggagattgagaccatcctgcctaaccgtggtgaaacccagttctctacccaaaaatncaaaagatttggcccggggcntattggctcacacctgtgatnccaa

SEQ ID NO: 674425 - DNA, 448 bp, Homo sapiens
ctgacctatcagggatggggaactttgtgaccaaccactcacctaggctgcgtcaatgaccggaaggagcagctcaggcagctgttccgatcccttcaagcgcagaggaaagcccctagctgacccccagtcagaagaaatgaggccctggcaggtgccgccctggcctctggcagcgcgattccagcacagcgcacctttttccagtcttcacctttttccagcatggcagctgtttcactggacaggaccagcttgtacttggaccagactccctggactccccactccagccctgtgcatctttgaaccaggaacagccaatctttggaactgggtgggcttatccttgactgattggcaactgggcccaaagaggccaagcagcaagttccactgctcagagagcacgtctaataccacatctaataaagcacaggcttagagc

SEQ ID NO: 674426 - DNA, 104 bp, Homo sapiens
ggcgaatcacttataaatggcgccaaagcaggaccctacgcctaaattccaggagggcctagcgagctcctatctctcatgggcctatgctctatgaagcaaag

SEQ ID NO: 674427 - DNA, 282 bp, Homo sapiens
ccatatttactgatcttttagaaaaatgtttcaaaccaggctgggtgcggtggctcacgcctgtaatcccagcactttgggaggctaaggcgggtggatcacgaagtcaggagatcgagaccatcctggctaacttggtgaaacctgtctctactaaaaatacaaaaaaattagctgggtgtggtggcgtgtgcctgtagtcccagctacttgggaggctgaggtaggaggatcatagtttcaaagtgtggcacttactggttctccactcactccctcctg

SEQ ID NO: 674428 - DNA, 296 bp, Homo sapiens
attcttgtgttaactgccccttggcctgaaaaaactcattgtaagcctgaaaaaaaaaatctttccccctgttttttttgcctgttgtaagaatccaatgaaataatgtatgtgaaagccccttgtaaactgtaacccatcaatgtaaaatgttaagggggggtggtatttccttaattacttctttgtttagaatggaatttcctatgccctactgtagctaggaaatgctgaaaacaactgtgtttttttattaatcaataactgcaaaattaaaggcccttcaatggataaga

SEQ ID NO: 674429 - DNA, 430 bp, Homo sapiens
tgtcgtatagaatgatgtgagcggatacggttttggatgatttgagaagctaaatggaagatacaaggtccgaataaaaggaggagaaaaatgggtattaaatgtctaagaatagggaggacctaggacatctgattagagagtgccttaggagattcagcatagtcctgccagcaaagattatttacttcaagagttaagagtggcagtttggggatagcaccaggagatatcagctgtgatggcttggagaaacagtgtaaaccggcagtgtaaacaagagcagggcatgtatgagtagttgagaacggtgaataggagtatgactagacagaagatagtagggatgacaagtttgtgggggcacagtctaagtcggtctggtgtcccaaaaaacttgtcaagcccaaatttcatcctcatctgttac

SEQ ID NO: 674430 - DNA, 277 bp, Homo sapiens
  misc_feature (109)..(109): n is a, c, g, or t
gggggggggcccccccccccgggtttttttcccccggttaacccccggggccccccaagggggggggcggggggggaaccccttttttttagggggggggggggccccntttttttaaccccccaaactttggggcccaatcccccgtccaaaaaaccaaaaggggggggttttttttttttcccccccccggggcccttaaaggggaaatggggggttttttttttttttcccccgggggggccccccccccttttttttgttttttgggggggga

SEQ ID NO: 674431 - DNA, 684 bp, Homo sapiens
  misc_feature (10)..(12): n is a, c, g, or t
  misc_feature (19)..(19): n is a, c, g, or t
  misc_feature (55)..(55): n is a, c, g, or t
  misc_feature (103)..(103): n is a, c, g, or t
  misc_feature (116)..(116): n is a, c, g, or t
  misc_feature (680)..(680): n is a, c, g, or t
cgagggattnnncagcctnccccttgagccctcgttccgacgtcgttcccctgcngcttttccgcacgcgctgcgcttcgcatggcgttcaccgagaaaggantcgttcgtatgtncgtatccagacctccctctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccataaaaaaaaaacaaaaaaaaaaaaaaaaaaaaaaaaaaaaaaaaaaaaaaaaaaagnaaga

SEQ ID NO: 674432 - DNA, 210 bp, Homo sapiens
gcggccgcctactactactactgcttgaattcaagcttctaacgatgtacggggacatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 674433 - DNA, 339 bp, Homo sapiens
tctagaggatcccttgcaggagagagaactgcttgaacctgggaggcagaggttgagtgagccgaggtcatgcactgtactccaggctgcgcgaagagcaagattagtttaaaaaaaaaaaaattcctaggcttggttaaattgtagtttctaccaaggagacagagagtaaacagggaatatcttatacagtatgataagtactttaaagaaagagaagccaggaacagagctagagagaggctggggttgccaccattttgtggaacgaggtcaaggacaggtgtctctgaagagtttgtgggaagtggatgtgaccctgtttgggaagaacagccc

SEQ ID NO: 674434 - DNA, 1356 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaaaaaaaaagtcgacgcggccgcgaatttagtagtagta

SEQ ID NO: 674435 - DNA, 790 bp, Homo sapiens
cgtaccccctggaatcttacctaagcacacgcttcccatatgctaagagatgtcgccaccatcaagcccccacccaagactggcctgactctcagcacaacaccagagctctaagaaaggaagctttcagaccatttaaacattccatggccttttgaagagacgttactctctaagaagcaatctgcctagtggttggcccttctataaacccctggatgcttctgcacatggccttgcatgacatacccatgacatcccttaagcacccccatggacactcagcaccatgtcaagcggaagatggagaaccgtgattaccgggatgcacaggagatttgctgctgatgtacggcttatgttctcaccactgctataagtaccatccccccagatcacagatgttgtggccaatggccaccgaaagctaccaggatgtatttgagttcccgttatgcccagatgcccagatggacccactagaacccgggccctttacccagtcatcgtacatgcccatgccccctggcttggcccaaatctgtcttccagagatcctcccagtgaggaaagtagccagtgagagctcctctgaggaagaggaggaggaaaatgaggaggacgaggaggaaaaagagagtgaagctcagactccgaggaagaaagggctcatcgcttacgccagaactaccgggcccagcttcggcccgtaccatgaccactggctgctctgtccccgggtcccattatcccagccccagaggaaaagagagtacaacaataaaaaaaa

SEQ ID NO: 674436 - DNA, 1281 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccataagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 674437 - DNA, 360 bp, Homo sapiens
gtttttttgggttggggttttggttttgtttttgttttttactgagaaaggaagggccaagggattaggtgggaaccgggccctgggggcgccccaaattaaagcagagactcccctcctgggggccaagccccaacaagggggccggtccggcccaagcttttttttttttttttttttaatttttataattggggcccctgggggggttacgggggccatgagaaccccctttaccccccgacgctggggccccagggttggcccaactctggggtccctgactggtttgcctttcatacggggaatatgcctttgggctgggctggtcatggaataaacccctctctctttttttta

SEQ ID NO: 674438 - DNA, 307 bp, Homo sapiens
gttgaactcgctgaggacgtttgtcagtggagtgtgtagaagccgggatggtagacttcaaagtcttctgagagagtcccctgcgtctggccctgcgtccctagtgtgaattccagcacagcagtgaggtggaggacgtggagggcaacgctgagagaccagatcccatccgtagcccaggacgagggcccagcaagactcagaaccagagtccagctggcgcccaggatcgatgggtgcagtaacattcagaatcagagcccagccggcgcccaggacgagggcccagcaacactcagaaccagag

SEQ ID NO: 674439 - DNA, 2026 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcggtaagctatgggaaaggtcgcgggcccgggtggggcagcggggccttccgggcccggagacgtgttccgggaagttgccaagcgctccgggccttcgtaagctcgggcaggggaaacttgaccagggtcgcagggcagcgggatcaaggcctgggccccggggtcggaccctgagcgcgaccggaaggagcaggcggtaggtcagcccttgggcgggcccggcgtctcagtggcgcatttactaatggctcctgggcctcctcgggccacacccgcccctcccgtcaccattgcgtcacgtccgttacgtcaccacccgttgtcacggatccggagggaaaggcggtgccagccctaagtggcaagcgggtgcaccaatgggggtgggaggcttagccccgcctcgggagctcgggttccggcgggttgcatcagctgggtgcggcacgagtggcagcccggactcccccgacatgtgatcggcttcccagggagggcgggaggcccgggcgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 674440 - DNA, 1832 bp, Homo sapiens
  misc_feature (1269)..(1269): n is a, c, g, or t
atgcgctctcacgcaagtggatggctgtcaacgtccctgtaaaactccgctcgtgaattcattcatgctaagtaacgttgtggtcacagcatacagaacccgaataacagctgacagcacggtacaagtaacgtggcaacggaaattcgtcctgctatcagcacctacggagaaaaaagccgtgagtgatgaactgacgaccgagaaggcacagaagatgctggtactcagtgcttgagcgactacagaattctaatagaccggcacattgtgcaccgagaacgaaatatacggactactcaatttacacataacacatactagaatgcacattatacgttgcccatgacacgatgtgtacggtaagacaacacatcttaaacgctgtgctacgtaacatcaattatagagaacccaccacctggactggaggcattactgtatagtacaaccaagccatttgacccacacagccctatattgctccgtgcacaacacattgattctgacagacgtcagcacattacacagcatagggatagacaaacaaagtggagtcccttcaacgtgatggatatatccatcaatcgcagtcttcacgcacatatgtaattggttattcacaacgtgccttatctccccagcgacttcatcacatatgttaataaaggaaaacctactacgtgcctcacagtagaagctttctgatcctgcacatcgcaccttctctataccagcgatgtaccaaatacacacatatgaacacatgcacacaccaacatcgtcgctacgacatcccgcataggacctactcctagacaattgacattaccagacactatgggctagttactggaagacatcgctaataacacctaactaccaacgacagacccacccacccaccgaaacaagacgactaccacctctagacactaacaacaactcacaccatcgccaataactaatactcactacaagtaataagatacgctcaacccatcacacaatacagccaacgcacaccttgcctactcgactcggcacagaacaactaccctaaacgacgcgttacgcgacacacctggacttacacgcatacaaactgtgggaccattgaacaccagaataccacaccacactacacataccacacacaccaacacaatcatcaactctaacacaataacaaacaaacaacacaacattactcaaacacttcatcccactaactcatatatacacaactggaaacacactatcgatganacaacacaaccaaccaacactaccaatcctccatcgctactctcgttgacaatccatcacacaacttatacccaccaccatacacacaacattctaacaatatctcaaaaacaccaacccctacacaacaccacatgcaataaacacaccaacatccactaagaaacacacaagaccaatcatacaaacacaactacacacaaaacacacaacaataaccctactcaaatttaacaaactcacacatcatcacaactataataacatcacatcataaaattataactaatgatccacacacacccacactacctaacaacaaaacaatacaccaacttaaatacatctaacaaaacacctaccaaatactacactcacaataaccaaattaacaaaacacctcatcaaaccaacagtacaataacaccaaccaacgtcaatcccaaccacaaatatatctaaaacacaaataaaatcacacaaaaattacatactcacacactaactctaacaccaaacacaatattccactaacctcacccacatacaatacattcaaatat

SEQ ID NO: 674441 - DNA, 123 bp, Homo sapiens
tgctccgcgactgcagtgaatgcctacattggggcgggcaccctgtgcacctgctagcaccctgtcacagttgtccagcttagctgcctctgcgactgcagtgaatgcctacattggggctgg

SEQ ID NO: 674442 - DNA, 1229 bp, Homo sapiens
agcgggccccagtcactgagccgccgccgaggattcagcagcctcaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 674443 - DNA, 1268 bp, Homo sapiens
gcagccgtccggcttggacgcccaccctcacgcgagtacgatccccctgccgctctccgcacgcgcgcgcttcgaggcgttttcaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 674444 - DNA, 1444 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaataaaaaaaaaagggggggctaagatcccggggcaactacggccggttttcaaggccaaggaggaaaaaagggcgcggaaaggaggaacggattggttgggaactccggggcggacccaaccggaa

SEQ ID NO: 674445 - DNA, 778 bp, Homo sapiens
tgttggggggggaaaaaaaaaaacccaaaacttggccccaaagaacagcccccctccgggggggattaaaccggcggtgaggggccccaaaacacccacattccaaaccacggggggggggagcccctttcaaaactaaggtggggtgttggggcggcgcgaagcgtagtaggggagaggcttctatcgaatggtagaaaatactaaaagagcactatgttctaacacaactaccaccttataagaaaaaaatgaagaggaacacggcgcatctgggccagtcctcttgtggaccacaggcgacactaaacacacttgtgcacgttcaagcaagatagggactagcgggccgtggtgtggtgcgactccaaacgagtggtaccacataaatgatggaggaaaaacacagggcgagggagagcatcccccgagggccaagcagatgggagaaccaaacggaagacaacaaatagagacaaaaaccgcacaacccactaaacagccggaagaacgaattgagccccgagagaaatggacgacgagcaccaactcactcgtggaggggtcgggaaagagggagaaatccatgcggatgcccccaggggaagagaggatacgagcgacacacagcggcgcatagcaaccccccggggcggaaggaacgaaaccacccgtcgtgaagaaaaaaaacagcagcagaagcacaacaagcgcgcgagcgacacacccaccgagcgggcgccgaagagacccacgatagtataaccgagacaggaca

SEQ ID NO: 674446 - DNA, 1206 bp, Homo sapiens
tcgtgccgaattcggcacgagcaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 674447 - DNA, 1734 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaatacctgacttgcagattatttatatatagtcgatcttgtgcatataaaggaaccatagaaatgggcagtggaggattcgtccacacccacagcttctcaacgggcctgaattggccaagaaaaacctttatgagcttgtccctctctggtcaacgtggttttttgtcgttgtgtttttggagacaggttgtgcccttgttgcccaggctggagtgcagtggcacaatctcggctcactgaaaactccacctcaggttcaagcaatgtgtcgtgcctcagctccctagtagctgggatttacgcgcaccatgcccagctaacttttgtattttaagtagagacaggggttctccatgttgggcacggctggtcttgaacaaccctggcctccagtgaatctgcctgtctgggctcc

SEQ ID NO: 674448 - DNA, 105 bp, Homo sapiens
cggcacgaggggagcggccgcaaatgtttttttaagggtggatggcaccctggaaccgggaagggtggccttttccctagagggaataaattgggttattttcta

SEQ ID NO: 674449 - DNA, 313 bp, Homo sapiens
catgttactgcaagaacctccagctggcactataacatgtaacatggtccaatctatatgcatgtacacactgaataagaaggatcaatatggcaaactctggtgccagctggcacaagcatctactctctctctggaaccaaagaaccaaaagaatactagcactttccagcaaatccggctttgcttaactacgagtcttcactgttctgttctccttgcagccgggaatcccgtggctactcctagaggggctctgttatttagtctcttccccctggttacagttcgctgtgaagctctgggatggagg

SEQ ID NO: 674450 - DNA, 231 bp, Homo sapiens
tttgacagtgttgaagaaatcttaattaaacagactagatcccagacagagtacaaagacctacatcactgacacatcagagatatactgaaactgtacagtttttaatagaaagaatacctggatttgatttaggtaatatagatttaaattccaattttcttattttttattgtatcctatagatgttaaaaaagataactgatataaactcacaaaatatttctctcg

SEQ ID NO: 674451 - DNA, 313 bp, Homo sapiens
taggatccccctcgcctttacccaaagaaatagaaaacatattcacacaaaaatctgcacatggatgtttatagcagctttactcataattgccaaaacttggaagcaaccaagatgtcctttggtagatgactggataaataaatgttattaagcacttaaaaaaaaaaaaaaaaaaaggccgggggtggggactaagccctttaatccaagcctttttcccagcagcttgttaaaaaaatcatgaggggggggactgtttaaatagaaaacatttttttgtacccaacaacatttgccacttttggaccca

SEQ ID NO: 674452 - DNA, 141 bp, Homo sapiens
  misc_feature (43)..(43): n is a, c, g, or t
gttcgcgcgccatcaccagcaggtcggtcaaggctttacccancgtcagggtggtggcggcctgtttgtcgagaaagttttgtgccgccaactccagatccatcaggtccaacggttcgctgtccgaccaggcgatcagcg

SEQ ID NO: 674453 - DNA, 816 bp, Homo sapiens
gcggagatctcgccgggctggacgtacagctcggtgtctgcagcaccctccgtcttcctctcctaggtcgacgagacccaggtggctagaagttcaccatgtctatgtctcaagatccatgccagggagatcttagagctctcgcgggaatcccactgttgaggtgtgagtctcttcacctcaaagggtctcttcagaagctgctgtgcccagctggtgcttcaatttggtatctatgaggccctagagcgtccgggacactgataagactcgctatatggggaagggtgtctcaaaggctgttgagcgacatcacataaaagcgtagttgcgcctgcgcctggctgagcaacgaaacgtgaacgtcacaagaacaagagaagagttgacaaactgactgattcgagagtggatggaacagacagaagtaaatctaagttcgggtgcgaacgccattctgggggtgtccctgtgccgtctgcaaagctggatgccgtctgagaagggggtcccccttgtaccgccgcatcgctgacttggctggcagctctgaagtcatcctgccagtcccggcgtgcaacgtcatcacagggcggactcatgctggacaacaaagcctggccaggcaggagtgcatgatcctcccagtcggctgcagcaaacgttcagggacggccatgccgcatggagcagaggtataccacagccggaagaatgtcatcaaggcgaactatgggaaaagacgccacaatgggggggcatgaaggcgggttgccccaaaaagtcggaaataagaaagccggcacggtgacgacg

SEQ ID NO: 674454 - DNA, 151 bp, Homo sapiens
ccaacacgtttccccacatttcactggcttcggttggatgctagaggactgagattgggagctccgagcaatgagatttacatgagagtgggactcagagctggtctgtgcaggcctgagacttcaggagacactgtgtgggggataaata

SEQ ID NO: 674455 - DNA, 705 bp, Homo sapiens
agagatgttggagccacccatcaggcatgctctcccccacctctgtccagcccgcctcacggccctggcggcctcgctgtttaccagaagacgtttttctctgtccttacacttctcactgcctctctggacaccgggcttttgctgggctctccagagctgggtcttggctcttccagctggatgaaggactgagtccctcagataatcccctttcctgctttttcctgcctctgtttccctagcacagtgtggatgaatcaaatgacttgcctggctggcgctggtagtcatgggtgccagtcctcccctcttgattgctgggaatgagcagctgagctctttggtgtggacacccgccgcctagagctgaggtgcctctcgcgtatctggtaggctgcccatgctttgcagaatgccccacatgcatgaaggcctgatgtgcaagcgacccttgcgtcctgtactgacccctagtcagcggcagtctggggtagtttcccctgctgaggatgtgacatgggctggagactgtgtctgctttcgtgactccgtcttccagcacatcctgtggtcagcctttcccagagtgatactgcgccctggggtgtcctaaccccttggttgtgcagggactggtatgcttggatgacatggctcagagtcccagtatccacttgaaacctccctctccatctacccgac

SEQ ID NO: 674456 - DNA, 244 bp, Homo sapiens
  misc_feature (45)..(45): n is a, c, g, or t
  misc_feature (51)..(51): n is a, c, g, or t
  misc_feature (96)..(96): n is a, c, g, or t
  misc_feature (200)..(200): n is a, c, g, or t
cgaactgcggcccggaacgcatgaggaagggcccgtcccgccttncccggngcgccatggagccccgggcggttgcagaagccgtggagacgggtnaggaggatgtaattatggaagctctgcggtcatacaaccaggagcactcccagagcttaacgtttgatgatgcccaacaggaggaccggaagagactggcggantgctggtctccgtcctggaacaggcttgccaccctcccaccgtg

SEQ ID NO: 674457 - DNA, 153 bp, Homo sapiens
acatcaagtgaattgcatagagccccctcttccccgaacagctttcccagggaaacagctctaggctgggaggggagaaccaacccctccccctgccccaccacctcccttgggactgagagggcccctaccaacctttgcatctgccttgga

SEQ ID NO: 674458 - DNA, 705 bp, Homo sapiens
gctgtacggtccgggatttaaggatcgagaccgcaaccaatgacagcgagccaagatctgcagagtcacaggcgaccacacacccggcggaccatggccgtggacctcatgggctgctacacccctcgccgcggccgacgaccagctcgccatccagtgaggccgccaccgccggtctccgagtgcctggaacaatcgtgggtctattaggatccacatcctgtccgggctgcggagaggggcgtatacgagccggcaagagataggagtgtattcgtacgcggattcagctctagacggtcgttgttggaactaatgtagtgtctgaatctacacggaaaagcaatagaacatggatgagagaggtgaacagatgaaaggagaacgaaagactagagtacatagaatgcacgaggatgattgaaagacaagaactacacactagttgtgactggagcgagacggtgacaaagaggacagacaagtatggtagatgaggacaggacggaaaagatcaagcgtacacagaacgagaacaaccagcaagcggaccgaagccacaccgaggcacaacaaagggcaaaaaaaacaaaaacgaaacaacggacataaaaacgccaggaccaaaccagcgcaaaagaccgagccaacggacgagacaaacaacgaacaccagggagaccaaatcaacaaccaacggcggaa

SEQ ID NO: 674459 - DNA, 1007 bp, Homo sapiens
ggctcacgcctgtaatcccagcactttaggaggccgaggtggatggatcacaaggtcaggagtttgagaccagcctgaccaacatggtgaaaccccgtctctactaaaaatacaaaaaaaaaaaaattagccgggcatggtggcgcacacctgtaatcccagctactcaggaggctgaggcaggagaattgcttgaatccaggaggcggaggttgcagtgagccgagattgcactactgcactccagcctgagttgaaaaagcaagactgtctcaaaaaaaaaaaaaaaagggaaaaaaaccggttgggggtgggcccaaggggttctcaccccgtgttaatccccagattttaaggaggcccattgcaggaggagtggttttgaacccgggagtttggggactcagcccgggggccaaccaagcgggtggggacctcattcctcttattttacaaaaccatattaaattagagcacctcgaagtcgtggagaaggggccgtggtcccgtcgacccgtggacccgggacaccttaacagcggggggaacctaagagtgccctccttattctccagatattattctccccggaagtgggaatgatcggcgggcttcaggtgtttccggggaaagaggccaggccccgggctgggcctcaagcttcccactccgcggttggaacttgggccatgtggcccgaccccaatttttagacggcgcgcggggtccctcaacgcttaaccccttttccctgggaacgccagggggtggcgggtgggaacctcttgcctggcagcgttcaaaggacgctatttgtgggcgccaggtgcccgaaccgaagtggtgatgggaattggccgcctgttatacgtggacggggagtgtttggcccacaacgctcctccattccgcggaaggcgcggcttcacgggacggcagggagggaacccccccccctcggtaaaaaaaatatgacggcgggaggaacccggggagcacgccacggg

SEQ ID NO: 674460 - DNA, 144 bp, Homo sapiens
tgccacgggtctcaggaagaaccctaaatttatggagaccgtggcggagaaagcgctgcaggaataccgcaaaaagcaccgggaggagtgagatgtggatgtggctttggcacctacggtggcatggataaacaccgggtaccg

SEQ ID NO: 674461 - DNA, 196 bp, Homo sapiens
agtgaccttaggatccccaggcgctgtgaggtatgatcggggttaataaacttgggcctgttcgggacctggttggcccgggtatgtgtcccgggaatgggacagcagtcccagacggaaactacacagaaataccacttagcttttatgatggtcacaaatgtggccaaaatgaccagggtcaacaagcgcctgg

SEQ ID NO: 674462 - DNA, 1379 bp, Homo sapiens
  misc_feature (1375)..(1375): n is a, c, g, or t
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaaaaaaaaaaaacaaaaaaaaaaaaaaaaaaaaaaaaaaaaaaaaaaaaaaaaaaagnaaga

SEQ ID NO: 674463 - DNA, 1515 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcggtaagctatgggaaaggtcgcgggcccgggtggggcagcggggccttccgggcccggagacgtgttccgggaagttgccaagcgctccgggccttcgtaagctcgggcaggggaaacttgaccagggtcgcagggcagcgggatcaaggcctgggccccggggtcggaccctgagcgcgaccggaaggagcaggcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 674464 - DNA, 110 bp, Homo sapiens
cggtcgcggtgagctgagactcgagccattgcattccagcctgggcgaccaagactgaaactctatcccccaaaaaagtacaaattatttctaaaccttgattttattac

SEQ ID NO: 674465 - DNA, 145 bp, Homo sapiens
ctgtatctgtttgaggatctggtgtgcttctcagccgatgtgagggggccgaggagagtatcctgtttcggggagcgcgtgggcgcggggactgggtcaggagaagccccagggggacgtggaaccgagagattttcgggatgga

SEQ ID NO: 674466 - DNA, 1265 bp, Homo sapiens
  misc_feature (10)..(12): n is a, c, g, or t
  misc_feature (19)..(19): n is a, c, g, or t
  misc_feature (55)..(55): n is a, c, g, or t
  misc_feature (103)..(103): n is a, c, g, or t
  misc_feature (116)..(116): n is a, c, g, or t
cgagggattnnncagcctnccccttgagccctcgttccgacgtcgttcccctgcngcttttccgcacgcgctgcgcttcgcatggcgttcaccgagaaaggantcgttcgtatgtncgtatccagacctccctctttcaaactccatctacgacgctatgctgatgctagtgatgacctgtcgtgtggctgagattatcatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 674467 - DNA, 1341 bp, Homo sapiens
ggagagaactagtctggttttttttaatttttatttaaaatattgtgaactttatactggttaaaatccactgtccattaaatgatcactacctaatggtcactaaatttacaaatttaaggaaattatttattagaactacggtgcaaaaacacagataaaaagacgtgaagtttcgcccattctcgtgcctcaggaagctctcttcacctcctaagcttcactagtgtaggtccctatcgtggactctcaacaattctcgtgctcatttataaacgtggttatattccctccattatgtgaatcattccttattggagttccccgagtgtgcgcagaaacttctcccagagagccctttacatcggcctcagaagtagccatctatttggggtatagccatttcgaaacgagcctttcaaagtagattgcccgtgctgtgcacaaacagacggatatgcagtgaccgtgtgtcatacacatattgttcatcctccccgtgagattcttccgcgcgtgtgatccatatatatctaatatggcccgagtgaaggactctcccacgcttctatatatcttgaagcacaaaaatctgctcagtttcatgtgtcgacaaaggcacatgatggatgtggatggcgaacactttctaattattcataagacagaagggggataacaaatagttgcggcctcccctttgtggtacaaaattatcctctctccccaaacatacttatggagaggagtaacaccagtatgagaaaagactaccagggtagcacaatgtggaagcatatcccctatactcaaaggcgcaccgaacatatatattacaaactgtgggctattatccaacagaaccatccgtgtagtcacccccatttctcttataatcttcctgcgcagcggaggtgtactcttatacactagtacaacagagcagattatcattattactcagcttcctgtggtcgccatcttattcttataaaacacaccacgaagttgaattattgtaccgacaacaataatatatctacccaaatgcatttgtatgtgggagcgctttcatacaagtgttcatcccaaccgccgcacggataacaacaggaacgctcgttgggaggcactattttcagcgcaacaacagttcaccgttggtacttagtaggcacctacacacacgaggtgatccccccacgttgtgtttggcccgccggtttattatacacactccgatatgaataaagagcccgtacaaacgaaacacacatgttcggatacaccgataaagaccgccccacaatgattgtggaggcgacatgttcaacagagccc

SEQ ID NO: 674468 - DNA, 433 bp, Homo sapiens
tactgtgatgcctctagctttgttgtttttgcttaggattgtcttggctatgtgtgctcttttttggctccatatgaaatttaaagtagtttttctaattctatgaagaaagtcaatggtagcttaatgaggatagcaatgaatctataaattactttgggtggtatagcactcaggcacagaaatgtccttgtgttagtcaataccattcaggacagagccatgggcagagacttcatcaccagaacacaaaaagcaatggcaacaaaagccaaaattgacaaatgggatctaactaaactaaacagtatctgcagtgcaaaagaaactattatcagagtgaacaggcaactcactgaatgggagaaaattgttgcaatctatccatctgacataagggctaatatgcagaatcttcatagatcaaacttac

SEQ ID NO: 674469 - DNA, 1399 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttgggcagctgttgctgtacaatttctacacctagggcgcgggcccaggtgcagccgccgcagtgcagatcttggaggtagtagcaaatattcaaacgagaactttgaaggccgaagttggagaagggttccatgtgtggaaattgaacgggtaccgagct

SEQ ID NO: 674470 - DNA, 1274 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccaactcttaagtcttttgtaattctggctttctctaataaaaaagccacttagttcagt

SEQ ID NO: 674471 - DNA, 1147 bp, Homo sapiens
  misc_feature (256)..(256): n is a, c, g, or t
  misc_feature (293)..(293): n is a, c, g, or t
tggtttaacaagaatttaataacaaagattaaaccaatctcaaagagtgacccgatggggaacttcaaaaacactcctaagttgtgcaaaagtcaatagcatctaagtggaaaactcgtgacgacaattataagaacgtgtaagatataattcttatcatggagtttcttctatactgtgcatttgtgcaaaccagagagaagtgaccgcgcccgtgtttctcagggattctcttatagccctttgagacagaggnctctctctttaaacgcgtgtggtggatattggcgtgncccattcaagaggtgccgtgtggccttggaattcctgtgtggtggaaagaaactgtgacagaacaatgtgcctatactctcttataacagagctgtggagtataaagtctatataatctcccaaggtgtgaacgccagaggcacagtgtgcgccccaaccctgtgttatgtggcacacgcagaggtgccaaaattcccgagccacaacgagtggagtctcccagcgtgggttatgtggggccatatcgcgaaagtgaaagcttcgtattttacacaggtgttttacacctgtgtttcagaggggggcgtggcagaaggggttctcccatataccagggggtgggctacacatattttcctcccgagctaaagagtgggggaggctacctccatcagtatattcaacgtggagaaagcatttcttccttacagattgccacagaatgtggtaaaaattagcttcgtgggtgacacaccccagagggactttccacgtgtgtgttttccccagtatttcaaagcaagggggtggccctcccaatgaaacctgtggggggataaaccactccatttctctggggggaaccacgcgtggcagcccacttccaattaatttggcccaaccttgttcactataacaggtggcacccgcaggtctttgtaacacacacctgctctgttgtccaattattgagcgcgacaaaatatatttccccacatccgagggggtagaaaaaggaccggtggggaaaaactcctaggttgttggcccccacttggggtcgtggtgcaaaaaaacaggtggcgtcggcacaagatttatgagagagaccccctaatatatctgccacatc

SEQ ID NO: 674472 - DNA, 1465 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaagtaggtcttcagtgagattttgggaaagtcataatggatttgtccacaagggggtgccagctgtgttgtatgtattgttagcggaaggggtgataaatgcgttcatgctcttgctaggcctaattcgttttcctttgtgcttgcagaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 674473 - DNA, 1321 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaactgaattaatagcagaggtggccaatgcatgtgaagtaacaaactggtttttggtttttttttccccttcagttttaatgttatgtgtaatgtatttaaacccttatttaaataaaacttgttttcagaaa

SEQ ID NO: 674474 - DNA, 822 bp, Homo sapiens
  misc_feature (349)..(349): n is a, c, g, or t
  misc_feature (400)..(400): n is a, c, g, or t
cttcaatagtgctctaaattacaccaacctattacttccagaatcaggaagccccctgtccccaacacttgcaggagaacttatattccaacttttgctctgaacttctcaccgaaataccctacctaccacccattgctaacacccttacttagacatttccaaagtaccccccataagctgtttcaaaagacccattccattttttcctacacaatcgtgcatactaaaactttcacaataatcatcttcagatgtacatgatatcctactacatttcacaattttcagtacttcagtccctcatgaacattttatagtcatctcttcggccctgttgtgaaatatntgattccagttcaattcagagtgtatgattccgcttttcacgctgatcaantaaatttatggtgtctcttttctgatcttcaacattaaaaacatcatatgtttctctcattcccatgccaaggactgcatcgcttgtctctctcaagattctgcttcattttcatccaagctctgtagtcatcttctcctctcagtttctgctggtttctcccttccccggcagcttcctgctccatcctcctgtccgtcggggatgacaaccctggtctcgctcaggaccctccatctctggattttcctggctcactgacaggtcagcctgcacctgtgggatatggcccagttactccggctcccccgaacgcctcttccacctacaggtctgtcttccaccacctgctcccggcctggctcctgcgccagcctgtccctctgaggctcctcattcaccatcctgatctcattggtttc

SEQ ID NO: 674475 - DNA, 1322 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaactaaataagacaagcaagatagcacacaaatgaccaatgatgaagtaactaaacatggatttatgagattattttcttccccggtcagtttaatgtaatgtgtaccccatggaccataaaatcataaatggc

SEQ ID NO: 674476 - DNA, 1011 bp, Homo sapiens
  misc_feature (349)..(349): n is a, c, g, or t
  misc_feature (400)..(400): n is a, c, g, or t
  misc_feature (494)..(495): n is a, c, g, or t
  misc_feature (498)..(498): n is a, c, g, or t
  misc_feature (660)..(660): n is a, c, g, or t
  misc_feature (667)..(667): n is a, c, g, or t
  misc_feature (679)..(679): n is a, c, g, or t
cttcaatagtgctctaaattacaccaacctattacttccagaatcaggaagccccctgtccccaacacttgcaggagaacttatattccaacttttgctctgaacttctcaccgaaataccctacctaccacccattgctaacacccttacttagacatttccaaagtaccccccataagctgtttcaaaagacccattccattttttcctacacaatcgtgcatactaaaactttcacaataatcatcttcagatgtacatgatatcctactacatttcacaattttcagtacttcagtccctcatgaacattttatagtcatctcttcggccctgttgtgaaatatntgattccagttcaattcagagtgtatgattccgcttttcacgctgatcaantaaatttatggtgtctcttttctgatcttcaacattaaaaactaaaaaacacataatattctatagagtattaaatgagatactagccctaggnnggncccattttcttatcaacttctagaaactgtcataaagaggactgcatctcccacagcaacactgtaattgggagttgtattcctcatcaaggacaagatggcaacggtgatatgggagggggacagggaagtgctgggtagagaagggcagggtcactggcnagggctncaccctcaggcntgtgcccatggacctaatgagaacaaggactcctgtcttcttgcccaaatgttgcatttttcaagaccacttttgcctgccatgccacccattctgtgccttataaaccctgagacccaacgtgcacacacacaagcggctggaccgtaaaggaacacactggcaaagaaccatcgaaagaccttgcaggccattgatggggaaccgattcgacgccaaggaaatatcggccacgtcagtagggaatcccgcttgttaccaccctcagaggagactaccttccatgctattcccctctgggttccaggcaattgttggctacttccacactc

SEQ ID NO: 674477 - DNA, 128 bp, Homo sapiens
cttgtagtatagtagatgaaaacattctcctccgcataatgccttgtgtcgattaaacactgaactgacatttaacatgcccaatatctacatcaaccaacaagtcatattaccctcatgtcatacat

SEQ ID NO: 674478 - DNA, 808 bp, Homo sapiens
cacactggctcacgtctgtaatcctagcacttgggaagctgaggagagtagatcaactgaggtcagaagttaagagaccagcctggcaacatggtgaaaccccatctctacaaaaaaaaaaaaaatttaggggggcatgatgtggaacgcctgtaatcccagctactcaggaggctgaggcagtagaatcgctggaaccggtgggggagggcatggggagtggcgtgcagcagaggtggcagtgagccgagatggtaccacttcactccagccggggtgaaagtgctagattaacactctttcgaaaatttatcttcctctacgtgatctctaagaactaatattcttacacggggaaattatttacctaaggttcaccaaatcccttcgcttttcccatcacgtccactcttttctataatgggtatacactggttgtgaacaaaccacaatcactggtactgctatttccccgaatggtgctatctaggtatcagacttctatctgctgacatgctgatgtctgcatatgccctttatataagcaagatctctttctgatgggagatcagtgaattggcttcaacgctccatgtgctcctttcaccaatttcagtcctgttcaaataaggaaattaacttccttgggacaagccagtttaaagttctgctgccggcgggtccccgtccacactgggagcggggcaacaggcgggttggaactgccctgtaacgtttctaacaaattggggggggctcacccggggcgaagtacgggggggtggacccgggggcgaaaaaagctctg

SEQ ID NO: 674479 - DNA, 1350 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaactccatccaccctccaccctccaccctccttgctctgtccgcgtggacgcagcccccggttcagacactagcgggtgcgcggggccgcccaggacggcgggagaggacggggccctccctcccctctggtcccccaaagctccccggacgccgcggccgc

SEQ ID NO: 674480 - DNA, 857 bp, Homo sapiens
  misc_feature (349)..(349): n is a, c, g, or t
  misc_feature (400)..(400): n is a, c, g, or t
  misc_feature (494)..(495): n is a, c, g, or t
  misc_feature (498)..(498): n is a, c, g, or t
  misc_feature (660)..(660): n is a, c, g, or t
  misc_feature (667)..(667): n is a, c, g, or t
  misc_feature (679)..(679): n is a, c, g, or t
  misc_feature (776)..(776): n is a, c, g, or t
  misc_feature (780)..(780): n is a, c, g, or t
  misc_feature (789)..(789): n is a, c, g, or t
  misc_feature (803)..(803): n is a, c, g, or t
  misc_feature (825)..(826): n is a, c, g, or t
cttcaatagtgctctaaattacaccaacctattacttccagaatcaggaagccccctgtccccaacacttgcaggagaacttatattccaacttttgctctgaacttctcaccgaaataccctacctaccacccattgctaacacccttacttagacatttccaaagtaccccccataagctgtttcaaaagacccattccattttttcctacacaatcgtgcatactaaaactttcacaataatcatcttcagatgtacatgatatcctactacatttcacaattttcagtacttcagtccctcatgaacattttatagtcatctcttcggccctgttgtgaaatatntgattccagttcaattcagagtgtatgattccgcttttcacgctgatcaantaaatttatggtgtctcttttctgatcttcaacattaaaaactaaaaaacacataatattctatagagtattaaatgagatactagccctaggnnggncccattttcttatcaacttctagaaactgtcataaagaggactgcatctcccacagcaacactgtaattgggagttgtattcctcatcaaggacaagatggcaacggtgatatgggagggggacagggaagtgctgggtagagaagggcagggtcactggcnagggctncaccctcaggcntgtgcccatggacctaatgagaacaaggactcctgtcttcttgcccaaatgttgcatttttcaagaccacttttgggccttgccatggcccaccccnttcntgttggccntattaaaaaacccntggagggacccccaggcggggnnaacaacacacaaggcgggcttggggacgttt

SEQ ID NO: 674481 - DNA, 210 bp, Homo sapiens
  misc_feature (56)..(57): n is a, c, g, or t
gttaacagcgtttttctcgtccccttcaacttctacatttactggcttttagaatnnaaaaaatgtattcttttcagtagtgataaggatcttattctttttatttttataaatatgtatggaaatttttaggttttttttaccagttttgtttacagactcttattttaatatttaaaatatatattttcaattttttacagaaatata

SEQ ID NO: 674482 - DNA, 1171 bp, Homo sapiens
  misc_feature (1138)..(1138): n is a, c, g, or t
  misc_feature (1147)..(1147): n is a, c, g, or t
  misc_feature (1149)..(1149): n is a, c, g, or t
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaaagncatgggggngntactctaggaatcaagctatga

SEQ ID NO: 674483 - DNA, 162 bp, Homo sapiens
cggtcgactctgagatcccccttattttcctttcttgttggcgattgatcggtttcttacatttgcatagtacctatgaagtcctagctcctggtatactttagagatggatggaatttggctactgcctgcactctctgtttgatcactgacctgttggag

SEQ ID NO: 674484 - DNA, 505 bp, Homo sapiens
  misc_feature (17)..(17): n is a, c, g, or t
  misc_feature (38)..(38): n is a, c, g, or t
acctgtaatcttatttngatcaagtgttttaaaccttngatatttgacaaactttccaaaatcaaatgtaaaattctaacttaaatgttttcgacctcaagctaacttttgggcattaaagcccttggaagtccaaatagggcccctggaagtccaaaagaaacatattaggctaatttggtatattaaaatcatacaggaagctgatcaaataaaaaatgttgtttaattttctttgagttgtatttgtataaatctgttattaatatgcatcccaaaattgtatcatattgctaaaatgttgatagatcttgttatatgttattggtaataattgttatcctgttaaattattgtataccacagaaataatgaaatttctttgtcaattgcatcagtaatcatggctcttctaagtcttttgtcattcacagatgattattgttttacttggattcttttcaaaagtggtttgtaattgctacagcctaaaatctgcttgttc

SEQ ID NO: 674485 - DNA, 349 bp, Homo sapiens
ggagaatctattgaatccaggaggacaaagttacagtgaaccatgattgcaccactgcactccagactgcgcaacaaagcgaaactctgtctcataatgcaactgaaggagacaggattagacccgaaacgatcattagggactcggaatgacaaagactgaaggattggtggcaatgagtactggggatacagtatgtggattaaccacagattatgacccagagtgtcagaatatatgtgctttatgcaatctctttgaccaggcactacattgcttgctcagaaggctagtaagcagcaacattgatggtggcctgtagaatgcacataggtttagccatgttggc

SEQ ID NO: 674486 - DNA, 145 bp, Homo sapiens
cacaactgtaatcatggagatggggtctcaccctgtcacccaggcttgcataacggtagtgctatcacagctcactgcagccttgaagtcctgggctaaggatcctcctacctgagcctcctgagtagctaggcatggtctccat

SEQ ID NO: 674487 - DNA, 733 bp, Homo sapiens
aggataaagtgcgtcagtttatgatcttcacgacaagtctagtgaaaaaacagcagtaagtgtctttctcaaaatgaactggaagttagatagttgcaacagataatttctttccaaaatcctgaactttatatacgagagagtgtaaaaggatcgatggagcaggaagaagttatggaacaggcctgtacaaatagatacaaagaccctcaagatgagaataaaatgggaatagatggcgatacacgcagttctgtgagtgaccgtggacactcgagtccacgtccagcattgagtgtgttgattattgcatggaagttcagagcatgcagcacagtgcgagttctccaaagcaggagttcatggatggcatgacagaagttaggatgtgacagcatagaaggaagctaaagggccagataccgaagatggaacaagagttgatagaaccagtgacgatttaacggatgtttgatccagtttactttgaatttggcaaagaatcccaggacaaaaatggattagatctagaagatggccattgctagtggaacttagtgcttaatggaagatcgaagattctggagacgttgagtggaatacaatttttgtgggaacatcataaacgatcaatagcaaaagacagttgggaatcttcttttagacttcagtacgatgatgggatgacatgtgttaattatgatgaagaaggagatggctgttttgttgatgc

SEQ ID NO: 674488 - DNA, 1699 bp, Homo sapiens
  misc_feature (1336)..(1336): n is a, c, g, or t
tcggatctatctgtacctcgggggtaatggtcagtaggttctggcgtgacgtgtgttgcttcagctacggtctgttgctgctgacgatatgatagccgtgtgctgtgtgtcagagtgacttccagctgtctctgacgcttgaggaggtagagcgctgcggtgggcgtggccgaaatccagactgttgtgtgtttgtccgcaccacgataggcgtggttgtgtgtctgaaggtgtcagcgacactgtgtgttcctgcgctgttggtgttgagtccaagcaggtgtgttatgtcatcttcttcgttttgatacttccccccttcggtgttgtggtcgtgtggggagaataggtgggggacacgctggcggtttggtgttcgcaggtgtggtgcttggtggtggcgtcgtggaggcgtggggtgtggtggtgaggttcccgcctctcctgttgtgtgctggggtgtgtggtagtgtgtcgtgtggtgtctgtgggcggcgctgttgggtgtgtgagtgggtgactctctggtgtggcgattgattatctatctatctgcttgccctgagccgttgtgcttgtgtggtgtcgccagcagctcagagtggttgctgcgcaactggaaggggggggcggagccacgacttcgccattggtctggttgtttcatcgccgtgtgcagctgacccctcggggatgtgggtcgcggtcacaccagggtggctctgtctgcgtcttgctggctgggtggcactacactaggtgtggttgttggttgccgcgagggctgggggcctggcagggtgtgtggagggggcgctacagaatgtggtggtgtttggtgtgtgggagtcctgggggtgcggaggggggtttgacgcgggtgtgtgttgtggcggggggcccccccgcgtggtatggttcgctccccctcggtgttctgtctcgtttgcccttcgtgtgcgcagcccccttgaggccctttgagcatgtgtgagaacaccccacggggagatatagtgtgcccccccaatgtctcacgtgatatgtctgtgtcgtttggtacatagtggagaatgatattatgtatgtgtggctcgggagaaaaggcgcgttgcccccccaagcgccaaaaacatcttgtgcgcgtctgtgagagtgaagcccgagattgtgatctctttggcccgcgcgcgggcgttgtttgtcacagcacacacctgcgtcgcccaacagagggggtgcgcactgtctgcacagccacgccttgtgtgtgtgcccttgtcactttgtcgccctgccccacgcgccccacagccccctctgggactctctgggnctctcgcagagacacacctcgggggccacacagagagcccccctcgtctcgtttgagtttcggtggctctcccctcggggcgctctccccgcggtgtggaagtgataaccccacaggcttttcgcccccctctccgcggagacccctcggggtgaacctcccgcgggcccccctcgctgccacgccttcccccgttcccccaccactgcacttctgcacacttctgggtgttcttggttttttattttttgtaaatgtccaatttgtataaacttttaaccccccccattaataaccttccaactggaaatagccgaaattaaataactccgtttcccaccccaaaacaaaaaaaaaaataaa

SEQ ID NO: 674489 - DNA, 441 bp, Homo sapiens
actttcacttaaatgttgtgattcaacataacattgccatagctattattaacactttacatagaaattgaaagtccagagaatttaggtaacttgggtaggtcactctccaagtaggcagcactccaaatccacactccttttaataaaaataggtaataggcagggtgtggtggctgcaatcccagcactttgggaggctgaagtgggaagactgcttgagcccaggaattcaagactagcctgggcaacacagtgagacccccatctctacataaagtaaaaaattagctggacagagggcatgtgcctatagtcccaaatattaatacttgggaggctgaggtatgaagattgcttgaacccaggaggtcaaggttgcaatgagccatgatcgtgccactgcatgccagcctgggggacacggtgagaccctgcctc

SEQ ID NO: 674490 - DNA, 152 bp, Homo sapiens
tccctgagcctaagcttgagctgagcaggcaccctggctggagttcccctcctccacagctagctaggcacctgcagggatgggagtgagagggttcttggttctagtctcccctacttccagggaatcggcgccaactcttcagcatcagc

SEQ ID NO: 674491 - DNA, 2022 bp, Homo sapiens
attgtttaagccaagaaagctctttggtttgcttttattctaggcttaatgtttatgtaacctaaacattccccaatcttgtttcctacaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaaatgactaaaaatagtgttttgtc

SEQ ID NO: 674492 - DNA, 130 bp, Homo sapiens
gcggaccacatgatagccacgtcgacatcagtcactcacttcagaaaacaggagcattaggaggaatttgggtgctaatttaggtgcccccgccctctactttatttatttattattattttatttggtt

SEQ ID NO: 674493 - DNA, 940 bp, Homo sapiens
  misc_feature (82)..(82): n is a, c, g, or t
  misc_feature (182)..(182): n is a, c, g, or t
ctggctgtttgtctcttcctcccttctgttgtttttacctcccttcctccgcgtagtggttttttttctctcgtgttttccncacttgtgctgtgtctcccccgagttagctcttctcctttggaggctcgctgtgttgtattgcgctgcctttctgctgttttgctcccctcctcgtgttntttttttgtgcacagctctttttgttttttggggagcacgacgccgccaccccccgttgttgttgtttttgtgctcgaacaactatcttgttgtgggtcactcgtcgttttctaggctgttgtgttctctcctatcgttggccccttcatttttttctgctccacaccctcggggttttcttcttgtatccaccaaatattttttgtgccgaaatttatttcgctcactacaggtggtgggtcacatccttccgtttgatgatgactttattaggcgcttcttcttcctctccctctttaagtttcctctctttgtttttgtggtgagacgccatccttcttcttctcatcatgcttgttctcctctccttctaatatattttttctgcctcttaaactatctgttgtggctgggtagtctctccccccctgctgccgtgcatcttcctcttccctaccagggctcgatgtttgttttttctaactcgtttagtgcatcgttcttacgtgggttgtcctctctttttgtaatagtttttcactttgtgtcgttacctgctgtcctcctgctttatttgatgtttttcttttttcttccgagagatttctctcttcccccaacttgtggggtgtttttttcgcaccgccattgactccccagggaccccccccatctcacccccctgggtcccaaaaaagtaaaaacccccccccccccgaaaaaaaaccgggccaaaaaaagggggggttttttttta

SEQ ID NO: 674494 - DNA, 513 bp, Homo sapiens
tgtgttcagaggatccccaaagatctttgagcatcacccttacagatgaaataaagatactggccataataacaaaagaatgcaaacgtctaggtaccaaggacttccttttgggggggtcgtcctgtcagatcttcctctaaggggtcatttccagaatccacaaagtcctaacataagaccccagcaatttttcaaattaattccccaaacaacaaagctaagcaagtaaatggaaccacaaaccgacccaagactaagttcttgtttcccttcaagatactcaaaagtaggagagtggcccagaagtacagagtcagtccaaactcccaacacacccaatgcaaaaaccaaaaaggtattgaaactaaaaaggtctgctacctggcgattcattcactaaaaatatgcttagaatctaagcatatgctccaaatctacgtcccaagagttggaggctgccacgaacatacgaagaagtgtgcgaaggtgatgctcaaagatcttgggggt

SEQ ID NO: 674495 - DNA, 143 bp, Homo sapiens
ggagttgttttaatgcaggttataatatccacagtacgttggtatgtggcataacttattaggggtgtactggtatgtttttttcaggagagggggccaatctgaacaaggcccaggtactttccatgcctcctctcctaggc

SEQ ID NO: 674496 - DNA, 545 bp, Homo sapiens
tgtgttcagaggatccccaaagatctttgagcatcacccttacagatgaaataaagatactggccataataacaaaagaatgcaaacgtctaggtaccaaggacttccttttgggggggtcgtcctgtcagatcttcctctaaggggtcatttccagaatccacaaagtcctaacataagaccccagcaatttttcaaattaattccccaaacaacaaagctaagcaagtaaatggaaccacaaaccgacccaagactaagttcttgtttcccttcaagatactcaaaagtaggagagtggcccagaagtacagagtcagtccaaactcccaacacacccaatgcaaaaaccaaaaaggtattgaaactaaaaaggtctgctacctggcgattcattcactaaaaatatgcttagaatctaagcatatgctccaaatctacgtcccaagagttggaggctgccacgaacatttggtgcccttataacctccccttctttctctctcgtttttttgtttttttttttttttttggtaaaagggcct

SEQ ID NO: 674497 - DNA, 531 bp, Homo sapiens
atgcatcgtgatggactccgcgtgacggggctatcacactgtgccatctacgatgggtatgccctcccccatgcatcctgcgtctggcacctgactggccggtgacgtgactagagtaccttatgaagatcctcaccgagcgcgtgaacggcttcaccatcatggccgagcgggcaatcgtgcgtaacatcaaggagaagctgtggaacgttgccctggagttcgagccaagagatgttcacggttgttaccagctcctccctagagaagagctacgagctgcctaagggcgaggtcatcaccattggcaatgagcgtttccgcagctctaaggcactcttccaagccttccttccttggcgtggagtcctgtggcatccaggaaattaccttcaagtccatcatggagtgtgacggtggaacttccgcaaggaacctgtacgcaaacccagtgctgtctgccggacccaccattgtaccctggcattgcctaccggatgcagaacgggatcactgcaattgcgccagcgg

SEQ ID NO: 674498 - DNA, 490 bp, Homo sapiens
tccccccgtttttcccgggtgcccctttttttagttggccccctttccccttggtttttcccgttaagccaaaaaaacccgtttctttttcccccaattttaaaaaattttttccccggggggttttttttgggccgtttccctttgggtttttcccccccttggaaaagggggttttttttttggggggggggttttttttttttttttttaactggggccccccccgttttaaaggtttttttttttcccccccccttttccccccggtgggttttccatttgggggggggggcccccaacctttttttttttttaaaaaataaatttcccccttttggggggttcttttttttttttgggggtttccccccgcccccctgtttgttccccccccccctttgggggccctttttccccccccgcccttttttttccccggggaaatttttttagggcttaaaatgggaaaaattttttttttccctta

SEQ ID NO: 674499 - DNA, 585 bp, Homo sapiens
ggattttcttttttttcacacgagggaggcgtgagaggcattgtttggcaaactgcatcattagacgtgggagtacctgacaagtagacggttgtagctcacttccgaatggtccaatcaatagaagctgtatttgccacagaggaggtctcattccgagatttcccgtattttcagggtacacccaagaccaaacctaggccaaaatccatttcactataatattcatgggggtaaatttaacttttttcccacaacactttttgggccaatccggaatgccccgaggttattgggaataccccgaggcataccccacatgaaacatcctatcatttgtagggtcattcatttttctaacagcagtaaaattaataattttcatgatttgagaagccttcgttttgaagggaaaagtcctaatagtagaagaaccccccataaacctggggtgattaaatggatgcccccccccctaccacacatttgaagaacccgtatacataaaatttagacaaaaaaggaaggaatcgaaccccccaaaggtggtttcaagccaaccccagggcctccatgattttttca

SEQ ID NO: 674500 - DNA, 141 bp, Homo sapiens
agtagtggaagactaaaaggaatccatagttccggataggttatattctgagttattattctgagttatctacaaacatttttgagatatgtctttacactcgtgattgtagtttccagcagcccacgcacatcttccaat

SEQ ID NO: 674501 - DNA, 1058 bp, Homo sapiens
  misc_feature (494)..(494): n is a, c, g, or t
  misc_feature (1058)..(1058): n is a, c, g, or t
tgaggcttaggcaacggggacggggaaccgtggttagatgcacgcgagcggcggcatgccagtcgcctcccaggtcccactactttggcgcttcctgactgcgctgctgactactaagacaatgtgattctccaccgtgagaccgctccagctcccgaagcagccgttgccaattgagaagcttcagagcattgcggaggatatctgcaggactggtcccctggggcagctaagatgagtactgagagcgctgcatatgcatgagtagggggatatcatacacgattctgcccctggtcataagaagatgttctccgggctgtagctcctagctcgtaactgtatgtccgtacgagcagaacgctgtcttcgtatctgactgctctcaattcttagaacaacgaggattgactgtctgttgtagtgcactctgtgattcgatgacggaggcgtggcaaaagtgcgtgctaagcaggactctgacggttcacgantaacctgatgggaccgtacacagatcccctggatactctaacgtctctgccactgtgcccacatattatagaacgcgtattacaccaaaagtttgctcgaggaagtgttcaggaggtaggctacctacttgtgtaccacctaatacagcacatcctctgggtaagtggcgtgggcgcatacatatgccttaaccttaaacaactatagtcttgtgcgctaaatatccgaggcgaagcacacactcgcaaagtctctcgtctaataactttgagggggacccgcgaacccctgtgggaccctttaaacaatgtggcgacacagtacatggttacacccattttccccaaggaatttggcggagacacttgtatcccacctaaggtggtttggcaatagacttaacctattcgttgggttagccaattgtgggcgtggtttgccctctttaagggagagatagtattcggaggaaaaccaccttataagaaagagaggggcaactaagagcccccctggaagaagttgatttcacaacattgtgccgggttgtggaccgccccatn

SEQ ID NO: 674502 - DNA, 292 bp, Homo sapiens
tgtccctctccttttttgtctttgctatgcgcaggcgcttatccaccggtcaatgcgtggttgtcccacagtatttccatccggctgatggcaatctttgggacgctttgttgtgtgggttaataaaaataaaattctagcgttcaatttcacagattgttttgtcacaacctctcacaatctgttttctataccacgtgttgacgctccttttcgacaaaaaccatcctgattcaccacgggtctttattctcacgggattctaataaacaatttgggttatacggagttt

SEQ ID NO: 674503 - DNA, 590 bp, Homo sapiens
tgttcactgcccgcctgttaacatgcaaattgtctgttaccatcaagcccagatccctgggattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 674504 - DNA, 354 bp, Homo sapiens
aggaccttatatgctgtctcagggatgtcaggactccttgataccaaaatccacagatgtcaatgtcctgatatgaaatgcatagtatttggcttattaaccaaaaacattcctcctgtatactttatatctctatattacttataacacctaattaatgatgtaaaagctatgcaagtagttgttatactgtattattagggaataatgacaagggaaaagagtctatacatgttcagtacagatgcagctctttttcaaatattttccactggtggttgattgcatccatggatgtggaactcacagatatggagggctgattgtacttcttccttgcttgaggtttttgta

SEQ ID NO: 674505 - DNA, 845 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagttcagagccaggcctaagttcagagccaggcctaagttcagagccagggggtacc

SEQ ID NO: 674506 - DNA, 813 bp, Homo sapiens
  misc_feature (202)..(202): n is a, c, g, or t
  misc_feature (229)..(229): n is a, c, g, or t
gaagtgtcctgaaaaccaacgttttagattgtaaatgaacgggtttaacagtacagttacacatagacattgagaagactgaaggcggaaatgataactcctaagaacctagtttcgttactgtcactatggcacttgggcagcatgctcgctacttaacgttgcaagctgctacagctagctagcatgacctgatggatcnagtttgagatttgtgtcccttgtcaanaagtttaactgctgatagaacggttggccatcacattgctgatgttctggacatcgccttagtctaggatatgtctgcgtcgatacagacctttgtcggcaagccagatgtgcctatcacctcgctagcggtaagagggcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 674507 - DNA, 712 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccataaaaaaagtcgacgcggccgcgaatttagtagtagta

SEQ ID NO: 674508 - DNA, 176 bp, Homo sapiens
cccagactccaggctgggtgacagagtgagaccctgtctcttaaaaaaaagtgctgggattacaggcattgagcaccgcgcccggcctcatgtagacttttaattgaactttttgtccccgtttacattatatgtgaaataaaggtgaaatcaaatgaacgatttgttgatttgaa

SEQ ID NO: 674509 - DNA, 641 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacccctttcaacgacctttcagctcgtacgcactctgaccctagtcgggcacgcctcaagctcgatct

SEQ ID NO: 674510 - DNA, 326 bp, Homo sapiens
  misc_feature (292)..(292): n is a, c, g, or t
ggcagcacatagacgacccgtgtcttcattaaggcacagacacatgtccgctaacagtcagtcactgggcacacgagcaggacgaccccatttcttcattagagcacagacatgcgtgaaactgaaaagcctggaagaatctatgagaacactaaccaccaggccaggtgcagtggctcacgcctgtcatcccagcactttggcaggccgaggcgtgtggatcacctgaggtcaggagtttgagaccagcctggctaacgatggtgaaatcccacctctactatgaattacnaaaattagctcggcgtgcgggacacatggcgaaa

SEQ ID NO: 674511 - DNA, 1382 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcggtaagctatgggaaaggtcgcgggcccgggtggggcagcggggccttccgggcccggagacgtgttccgggaagttgccaagcgctccgggccttcgtaagctcgggcaggggaaacttgaccagggtcgcagggcagcgggatcaaggcctgggccccggggtcggaccctgagcgcgaccggaaggagcaggcggtaggtcagcccttgggcgggcccggcgtctcagtggcgcatttactaatggctcctgggcctcctcgggccacacccgcccctcccgtcaccattgcgtcacgtccgttacgtcaccacccgttgtcacggatccggagggaaaggcggtgccagccctaagtggcaagcgggtgcaccaatgggggtgggaggcttagccccgcctcgggagctcgggttccggcgggttgcatcagctgggtgcggcacgagtggcagcccggactcccccgacatgtgatcggcttcccagggagggcgggaggcccgggcgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 674512 - DNA, 697 bp, Homo sapiens
  misc_feature (612)..(613): n is a, c, g, or t
  misc_feature (619)..(619): n is a, c, g, or t
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagttgagttcagtcactacttgatttgtgcctctctgctggcaaatctcagatcctgtctgttagcttctgctggggacataaaagttggctttgtaaggctgagcaaaacctcagttgggttttaaagtacatagacttatttctgttttataggannaagcanaagggacttgtctacctttggtttactgtttctgtggatctacttcacagatgcaaatttgaatagcatatagatgca

SEQ ID NO: 674513 - DNA, 708 bp, Homo sapiens
  misc_feature (12)..(12): n is a, c, g, or t
  misc_feature (63)..(63): n is a, c, g, or t
  misc_feature (71)..(71): n is a, c, g, or t
  misc_feature (158)..(158): n is a, c, g, or t
  misc_feature (207)..(207): n is a, c, g, or t
  misc_feature (214)..(214): n is a, c, g, or t
  misc_feature (307)..(307): n is a, c, g, or t
  misc_feature (316)..(316): n is a, c, g, or t
  misc_feature (349)..(349): n is a, c, g, or t
  misc_feature (373)..(373): n is a, c, g, or t
  misc_feature (422)..(422): n is a, c, g, or t
  misc_feature (496)..(496): n is a, c, g, or t
  misc_feature (525)..(525): n is a, c, g, or t
  misc_feature (562)..(562): n is a, c, g, or t
  misc_feature (585)..(585): n is a, c, g, or t
  misc_feature (622)..(622): n is a, c, g, or t
  misc_feature (704)..(704): n is a, c, g, or t
ccatgtactggnagatggcatcgtagtgaagctccaccacctgattttctcttggcagttgcnccaaagcncggctccgtgctctgtcccggctcagcaaatgtcccacccttccagtctgtgggggcagcaccaccatcacacggtcaccctctgcnttgggaaccagggtctccagcatgtctttccttaggccttccaggactngggtttnatttgttcgacatatacaggtatttggggttaggacatctttaattattattttggtgttgtaatattggcgtcctttgtacatgttgttcanaaaccgganacggaggtttctgtggaaccagtggtgacttcnggggggtggtttcttactcttggntgtaggcttattgtgttggtctggaaggtgtttccgcttcctctctganttgtcctgctggatgtagagttcttgattccagagggtcttccgtgatgaggcagttccgttctgttgcctganatccaaggtgttcttgtcaaactcctgcngggagacaggccgcagttagtactcactaacagtcancacccggctccccacagccagangaaccatggcccgaacattgtcaggatcaaggccttncaccttcccatagaggcctcggtgagggggagagagaaccaccacagctcctccaggcaccagcccttgaggctgatcttcnttat

SEQ ID NO: 674514 - DNA, 692 bp, Homo sapiens
  misc_feature (265)..(265): n is a, c, g, or t
  misc_feature (381)..(381): n is a, c, g, or t
ggggttttttccaacggtccggggggggccccccggcagcccacaaaagttatccccctgaaggccttgtggaggatgggcccccccccctcctacggtccatttaaatggttcctggtcgaccagttcccctttgggagaagcctgggccaccacaccagttcattttaccagaaccccgcctttcgcttgttgaaccgggggggggtctccacctattgaaccttcaccttctgggggaagttaataaagtcaaagtactcancatcccccatcatgtttagaagacgcaggtgcccgcgttgttggaggccggcttccgaaggaagaacattccgtatgaaggtaatggcgttggtccccccgcccgactgccgttantaccctttcccacaaatgatcacgcccttggtgaccaaaggttgagcccccacccgggccgggccacacccatgccctcctcggtgctttcttggccggaagtccagggtttcgccccacccctgggttgatcccacttgtgtgtccccaaaagctttcccggtttttttgtgaggggtccccccaccccagggctgatcccagttgtgtgtccccaccagctttcccagtttttttgtaagggtccctgctgccccctgcagggtccctaaggtaaagtaaaccccggcgttgggtttggccagtcggca

SEQ ID NO: 674515 - DNA, 1550 bp, Homo sapiens
  misc_feature (1465)..(1466): n is a, c, g, or t
  misc_feature (1472)..(1472): n is a, c, g, or t
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcggtaagctatgggaaaggtcgcgggcccgggtggggcagcggggccttccgggcccggagacgtgttccgggaagttgccaagcgctccgggccttcgtaagctcgggcaggggaaacttgaccagggtcgcagggcagcgggatcaaggcctgggccccggggtcggaccctgagcgcgaccggaaggagcaggcggtaggtcagcccttgggcgggcccggcgtctcagtggcgcatttactaatggctcctgggcctcctcgggccacacccgcccctcccgtcaccattgcgtcacgtccgttacgtcaccacccgttgtcacggatccggagggaaaggcggtgccagccctaagtggcaagcgggtgcaccaatgggggtgggaggcttagccccgcctcgggagctcgggttccggcgggttgcatcagctgggtgcggcacgagtggcagcccggactcccccgacatgtgatcggcttcccagggagggcgggaggcccgggcgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaagtaggtcttcagtgagattttgggaaagtcataatggatttgtccacaagggggtgccagctgtgttgtatgtattgttagcggaaggggtgataaatgcgttcatgctcttgctaggcctaattcgttttcctttgtgcttgcagaagtttgcctgcaatggtactgtaattgagcatccggaatatggagaagtaattcagctacagggtgaccaacgcaagaacatatgccagttcctcgtagagttgagttcagtcactacttgatttgtgcctctctgctggcaaatctcagatcctgtctgttagcttctgctggggacataaaagttggctttgtaaggctgagcaaaacctcagttgggttttaaagtacatagacttatttctgttttataggannaagcanaagggacttgtctacctttggtttactgtttctgtggatctacttcacagatgcaaatttgaatagcatatagatgca

SEQ ID NO: 674516 - DNA, 364 bp, Homo sapiens
  misc_feature (359)..(359): n is a, c, g, or t
gcagacttagaagcagatgtgaagcatcttaaaaacaactacagttgacccttgaacaacacgaatttgaagtgtgtgagtcacttatacgtggcttttctttgcctctgccacccacgagacagcaagaccaactcctcctcctcctcctcacctactcagtcatgaagatgagaggatgaaggacctttacgatcatccgcttccactggaatggaatgctaaatatattttcggcttccttttggattttctggaataggcatgtcttttctctaggcttacttgttgggtaaggaatactggtacataatggcatagggaacataccaggcggttaaccaattccccaaaatggntgggg

SEQ ID NO: 674517 - DNA, 188 bp, Homo sapiens
cctatcacttcaacccctgccttgtacataaaattattccatccacccagtttcccccctcacctgccccctcaaaaggagttggatgggggccaagtaaggtaaccaggtggcatttcccccatgttttataaggaattttgtcaagtttttgtgaaataaaaaaacgtgcttcatttgccccccca

SEQ ID NO: 674518 - DNA, 290 bp, Homo sapiens
  misc_feature (84)..(84): n is a, c, g, or t
ccccccccccccccccccccccccccttttctttgttctggtattaggccaaagtttgggagtaaggagaggattaggtctttnggagcaaagaaaaaagtagcttggaactttttagatgatccccccacatactgtacaccttgctttacaatgtgttagcagaaaccacgtgggttataatgtagaataatgtgctttttgcccaagtggtaattcatcttggtttgctatgttaaaactgtaaaaacaacagaacattaataaatattttttgtgtagccccttta

SEQ ID NO: 674519 - DNA, 428 bp, Homo sapiens
  misc_feature (18)..(18): n is a, c, g, or t
ccctgaaaaaaaaggggnccacccccctaaacgttaatagccctatattttccataaataaacctatcctatgccctaattatgttgaacctagaccttatccaggaggatattaaccttggggtaccttaaagaattagttgtggtggcctcatgccctgtaatcccccaaaacattgagaaagccctagcggggtggatcacttgaggtcaggagtttgagacccagcccggcccaacatggtgaaaccctgtctcctactaaaaacacaaaaattagcgggtgtggtggcatgtgcctgtaatcccagctactttggagcctgagacatgagaattgcttgaacctgggaggtggaggctgcagtgagccgaaatcatgccactgcactccagtctgggctacagaaagagagactgcctcaaaa

SEQ ID NO: 674520 - DNA, 544 bp, Homo sapiens
  misc_feature (468)..(468): n is a, c, g, or t
ggtaattgggtctggaggaataattttatccctaatgcaggttggcagccgtgggtaagatccagtagttagtacatcaatggcatatgggatggcaaaactaggcaggcgtgcatggaccagagcatctctagctaacgaggccaggcgatcagcagtgtccacaaacaggatggcttgctgatctaaaaagcttgaaatcatctttaaagtaaagggtaaatgtattaagcatccctgaaaactatctccttttcacactaaatattgttaaatcattccaaagtaaacttcaaggggaattagtatcagttttccatatttcaaagtagttcttcaaatattctccagtaacttgaagaagaaatatttaatacactagtatttgatattaagagcaataattttctgtcactttaagtaaaagctttctattcatttctccatccttaacattacacacacatnatatcaaagttaggaaaaataagtagaataaaatggttttttcctcttacagacttccagagttggttgataatga

SEQ ID NO: 674521 - DNA, 354 bp, Homo sapiens
tggaaacggattctcgctctgtcgtcaggctggagtgcaagggcgtgatctcggctcactgcaacctctgcctcccgggctcaaatgattctcctgcctcagcctcccaagtagctggcattacaggcatgcaccactaggcacagctaatttggtattttaagtagagatggggttcctcagtgtgggtcaggctggtctcgaactcctgacctcaggtgatctgcatgcctcatactcccagagtgctgggattacaggcacaagccactgtgcccggccaatactgcaaaatattttaaaaagttaaaattatctcttcgggctggctcatagtggcctcacacttttaat

SEQ ID NO: 674522 - DNA, 224 bp, Homo sapiens
cccccagggggggggggccccccccccaaaaaaggggaatttttgggggggggggccccccctttttacccccgtttttttgggggggggggggccccaaatttaattccccattttttattttggggggccgggtcaaggggcccatttttggttttaaaaaagaaggggttttttaaaaaattaaggggggaaaaaaaaattttttggttttttttccccca

SEQ ID NO: 674523 - DNA, 1230 bp, Homo sapiens
agcggagatgcggactggcgcttcccgtgtggcggctggaggagcccggagggacgcagaccgggcaaggtcatgggcgcatgggcgggcggcgcgaggcgcagtggctgctggccgtggcagcaggccacctggccaccattccctggtgccctggggcacaggctgcggctgatggccggtggccagtggtgccctgccgcctgaagtgccgcctgggcgtcgggagccggtgccaagctctggtagtcgggcgctgggagtgcaaggcgtcgaagagcagcagaatgctcggggtgtccagcttgtctcaaaggaatcaggggtgtctggtgcttgacgccacgcattggccgatgattcggcgtacaccttggatgtcccaggtactgcttgcctctcgactggtgggccctcaaaaaccaagctaaagactctcggggcgcgcgctgtcacggcgtggtagagcgcctaggacccggcaaggctacacagggctgtttgcttggcaccgaaacaagacacacgttgagggacggagcgtgggcggagggttgttacctacagctcttgccccaggtgaacagggcagacggagcaaaggttggtatcttggatccaggttggttcggccccccagcacgtgtaggaaaccacaattgctttgtttcaccgggggaattgggccggctaccacaaaactcaggcgttgacggaccggacatagcgtgggacagaacgcggtgtcatgaaacgcagtggttacttcaaattccgattacgaagagattccattgggaaccaagtagccgaggacccccaggaacgaaagaacgttttgcccaagttgaacccggtgtcgccgaaccaagaacttgggaagtgataccccaatcatttcgaggacgcgtgtatcttgcgacttgtgccaaactcgttccgaaaacacaccgcaggtagggagtgtgcacagaaaagtcacttggaatggccaatcgcaccccttggagacccaaggggcccagcgcttcacaggggggggacataaacccgtccaacacaaggaaacgatcggcccaggccacaactgcactggcccagtccaggcacgctggcaaggacaaggcccaggcgtccacgaccatccgcgcgaatgcgtacacacccacaacgaacggcggaggaaacccgcagacagagcgccaccctcacaggaccaaccccaaacgg

SEQ ID NO: 674524 - DNA, 351 bp, Homo sapiens
gaaaggctgacgtggcattcctacacctcgtaggatgatgacacataagatgacaagagctaacgctcctgagtaccagtccatgtcacatgtgactgtgtgtttcaagtggtaagggaaggagttctacttgtcttgacaccattaaggtggcttgagaagatgttcttcgaagagccagtatagattctgtgccctgcagaagtccaagtgctttaaagccggttcaagctgtatagtttgcacacccatcccagtggagggggctgattagttgccaggcacacttttatgcactttgatgcccagcacatgggtactgtggatctttacagagcatattcacgcccg

SEQ ID NO: 674525 - DNA, 709 bp, Homo sapiens
cccccttacaacccgcaaaaggggtgtccgggccccaaaaaataggggtcccaaaacttagaaacccttccttaggcgtaaccaaagggttggccctcttgttgcaatttcttacccggagttaaactcgaaaacggcaaaagtggccaggtcaagctcaggaccaataggtaccccctaggttttaatcgtttaaactccaccgaccatatactgatatgggctgtaagaattagcttaaaaacagcccctctaggcactttatccaaagtcaatccaacactcatgtaattcttttaatgcacaaatgtcttcacaggaggctagtatgtgtacatatccccataatcatttagcgcgagtttcttcggtggacagggcccatagcatgtatactatttaatctatttcctccgcatatatgcaggggagtcacccagtatgaaggtggcccttgttcagatcgtagctaatgaccatgtcccaaccgtcctcactgaatcggggtacccataaagctcttactgaatctacatcccgcttacaccttgggacccagtgcccatccattctttccaacgaacccatagccttgtggcaggctcaattttgactctcccgatctgtataaagagggctcataacaggcagtgacataataaagtgcgctttgtttgtatctcataaaccttttgggagaaaaaaaaaa

SEQ ID NO: 674526 - DNA, 240 bp, Homo sapiens
gagctttttacgcaggccgaaaacgtgcgtgtcgatcgctctctccaccacgctcacgcccccgccttgcacttcgcggatcagctgatcgcgggtgagcacgcggccttggttctgggcgagggtcacaaggagcttgaattcatagggcgtgagctgcacgggctcgccgtggatgcgggcttcgtgggccgcttcgtcgatctcgagaggccccatagaaagagctgtttccttgcg

SEQ ID NO: 674527 - DNA, 187 bp, Homo sapiens
cacagcaaaataagacaaacagacagaatgtcaactgagggtgctacttttatgctatcacttccctttcccttccttagctagtgttcttatcctttcccttaatagtaacggctggtgaatcgaacatgcactattcttatccccatccatttgcttctcggcatcctgcttaaaccaaatgagt

SEQ ID NO: 674528 - DNA, 364 bp, Homo sapiens
  misc_feature (25)..(25): n is a, c, g, or t
aatgttgcatttttcaagaccatcntgacccaccaggcccctatcctaggcctataaaaacccaagatcttaggggcagacacacaggcagccagatatcaagaggaacacatcagcagaagaagacacaagtggctggacgtgagaggatggggagggagcatgccatcagaagagcataccgacagatgcaggcaggcacgctagcacatcacaggccatccactagtgggatgaggcagagtttagctagggcagtcagagaaagtctgcccaactccaggggaaaaccatctcccctctgactcccccatctgctgagagctacttctactcaataaaaccttgcactccttctccaaaa

SEQ ID NO: 674529 - DNA, 886 bp, Homo sapiens
  misc_feature (658)..(658): n is a, c, g, or t
aaaaaaaaaaaaaagggcccgttcattctcaaatgctttgggcgtctccagggtgcctcaggaaaacatgaagggggcattgtagaactgggggctactgtgtaccttgggaagaaaaagttaaggggtactttaaagtgggatactggttttggatgaaattggccaacttcagggagcccagctgggagaaggaggacgtgagtatccttacaaggctccgaaacaattctttcttcacttagtttcctttctggtgctctgcatcttattatcccagcagggtcttccaatggctgggtttaataactaccagaaactgggccaggtgcagtgggctcacgcctgtaatcccagaaacttggggaggctaagacaggcagatcacttgaggccaggagttcgaaaccagcctgggacaacttggtgatacccagtttctggctgaaaatacaaaaattagtcgggcatggtgatgtgcacctgtagtcccagctggctcgggaggctgaggcgggagaatcgcttgaacccgggagacggaggttgcaacgagccgagatcgagccattgcgctccggcctgggtgacaggagactccatctcaaaaattaaatttaacaaaagaatctacgtacaattacgatttatccccctnggggaccgtgtaaaaaacaagaaagcaaaaaaccaaagaaacaaaggagaagacgaagaaaaaacacgagaaaaggacaacgagagcagagaagcagaaacgagaaagacaaaaaaacgacaccccaaagaaacaagaaagaaaaaaaaaaaaggaaggaaaaaggaggaatcaagaaaacaacagagagaagagagaaagaaaaaacacagaacaacagagggaaat

SEQ ID NO: 674530 - DNA, 146 bp, Homo sapiens
cacgaggacgatggcgaagtggtaagagggcaattgtctgggagttgactttagtatgacgaattgattctgtgtcacgacagaatctcccaggtttacactgatgagtataaagatgggacagaggttgtattgaaagagaatga

SEQ ID NO: 674531 - DNA, 512 bp, Homo sapiens
ttgaacttcccggggtgggtagacagcttgagcccaggagttctagaccagcatgggcaacatagtgagactctatctctaaagataagaataacttttaaaataataaaaatacattaattggccgggcacggtggctcacagctgtcatagtgttaatgatgtattttatgtgttgcccaagacaattcttcttccaatgtgtcccagggcagccaaaagattggacacccctggaacagagtatggaaagggaaattagcagcttacggtgggtaactctggtagacaacgccttaaccaagtgatcaaggttaacttcaccagtgagcaatcaggtagatatcatgtgccccctaatattatgtgatgagaaggccatttcacctctggggtattctttccccaaaccccaactgcagtctaatgatcagaaaacatcagacaaatccagattgagggacatcccacaaaatacttccccgggaagttccggaacttcccgggaagtt

SEQ ID NO: 674532 - DNA, 151 bp, Homo sapiens
  misc_feature (32)..(32): n is a, c, g, or t
gttttttttaaacttaacctttatgttggttnctattgctgccttttaattcttgagatgtgtccttggacggaagacctaaatatctttctctctctctctttttttttttttttgagacagagtcttgctctgttgcccaggctggagt

SEQ ID NO: 674533 - DNA, 1078 bp, Homo sapiens
  misc_feature (524)..(524): n is a, c, g, or t
  misc_feature (617)..(617): n is a, c, g, or t
  misc_feature (621)..(621): n is a, c, g, or t
  misc_feature (643)..(643): n is a, c, g, or t
  misc_feature (686)..(686): n is a, c, g, or t
  misc_feature (693)..(693): n is a, c, g, or t
  misc_feature (715)..(715): n is a, c, g, or t
  misc_feature (722)..(722): n is a, c, g, or t
  misc_feature (726)..(726): n is a, c, g, or t
  misc_feature (739)..(739): n is a, c, g, or t
  misc_feature (770)..(770): n is a, c, g, or t
  misc_feature (786)..(786): n is a, c, g, or t
  misc_feature (796)..(796): n is a, c, g, or t
  misc_feature (1042)..(1043): n is a, c, g, or t
  misc_feature (1045)..(1045): n is a, c, g, or t
  misc_feature (1047)..(1047): n is a, c, g, or t
  misc_feature (1051)..(1051): n is a, c, g, or t
  misc_feature (1053)..(1053): n is a, c, g, or t
  misc_feature (1065)..(1066): n is a, c, g, or t
  misc_feature (1069)..(1071): n is a, c, g, or t
ctctggttctgctctcttcgcggtcgcttacgaggcgtattctgcggcctgttcacggggttcgttgtgccctgcctggtgcctgttctgctccggtttcctgcgttccgttgttggccctgtcacggtgttcgggcccgtcctgcctgccgcgaattggtggtatgtacttcccctgccctcatgttccctccctgcttgcgttgcagtactgtatcctcacctcggtttctcgcctcctgtgccccttgctgccagcttttcgctcttctctttcttttcctgtgactccgggctgtggtgtacctgagccctttagggggactgccacgccgtcgtgtttgtgccactcccatttgtgcccctcgttccctcgttacacgatcaggtgtctttggcactagtacttggcatcataagctccatgcctgagacaccaggtctatgtgggctccccaccttgtttcccatcttgcaccttagaagccgaaggtgctttcatcagaaccctaaaatggtcgttngaaggcgtcctgggtccgcagcccagcagtagtctgtgagaggcaggcagagggcagtggttctctccacaataggagacctggggccctgcnccanggccaggggtttgggcctaatnggctcttgactaaattacccccatcctccttgcccggaaaagnggagagnctagagccactcactgtcattnctgctcntganccttgaaaggggncggtggttggcctggcttctggaatggactngagtccatcgtggaanagggctgggnggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccgggacccagnnancncggncntctgggtcactnntcnnntgcacca

SEQ ID NO: 674534 - DNA, 722 bp, Homo sapiens
  misc_feature (683)..(683): n is a, c, g, or t
tcggaccgggggtcgttctccgtataaatttttcagttcacagccaggaactcgaaagggcgtagttataggaaacccgactggcacaaacgtgcagttgacgaatgtcaggctcagaaacgtaattgcccacggttatgactatatcggcattgaaggcctagaaacggtaatcgggttctcctttggtcaccgagtcgtatttgaaaacgtcaacgttcaccactgttatgttaactggtggcttaaggagcttttcgagtacagcacaggcaccaactgctacggctatgaaggcttcgtcggtatgctgatggtaggtggcaataacaccttcgtagcgtccaactttgaagagaacttcaataacttgcaaatggctggcggttacaaccacgctcacggtaagtttattggctgctcattcaatcacgcagctgatggcggccttggcttcataggtaacggggttgtgaatggtcacacctttgtcggatgcaccttctggtactctccgattacgctaagcgggtgcgccggtataagcatcacgcagtctcagatcgtttatggcaaggtgatcattgccggtggaggcctaaacaatattgacgacaattacacgcctcaggggttggtgaaagagtctactggcaatacattcactaccttccgcaggaacngagtttcctacaacactgttctgctgaatcgccgtatat

SEQ ID NO: 674535 - DNA, 108 bp, Homo sapiens
ctttcacctcccaacattatttgcataagcaacattggcatccattttagcatctttttgtgtctttattgtttctctctgtcttaaggattatagtggcatggtaag

SEQ ID NO: 674536 - DNA, 335 bp, Homo sapiens
aataattcctgcagcaggctacttccagaaagtggcacaatatgtacacggtgcacggggtgtgtctatagctgatgaagatcaagtgggctttggcagagttgggaaacatatctggagctttcagatgtatggtgaagactttgttccagacatcgtcacaatgggccgatgggcaacgggcacccggtggcatgtgtggttacaaccaaagaaattgcctaagccttcagcaggtctgggatggaatattgtaatacgtatggaggtccagtatcttgtgctgatggataggctgtcctggatataattgtactggatgaacagaaggctgc

SEQ ID NO: 674537 - DNA, 708 bp, Homo sapiens
  misc_feature (533)..(533): n is a, c, g, or t
gctttctttctcttcaaacctttcgtagtttcaaacaggtttctcttctgaactgatgacttaatgtcaaaatattgacagcttactgcagttttacagtatctcctcacaaagggcttcaggtagaatatatcagagctgctcagccagctacctctccccgtctgaaaccagcagtatcatggcatatcctgtggattcccgtcccgtccctggaagtgttggcagggggtttgtacctgaccagacttaccagggcgatgatggattacccagaacgctcctaactgaagcacaatggtgccctgtagctgcacacacaaggggaagggcccggcacccattatctgggataccatcaaggtgacccattgtggcgcccccagtgaggagctccactgaccgtctccattctcattcctatcatagttttacaggcgagatagcttacacgtaataatctaataacatctttgcagtatgcggtcaataataattcaacacacagcccgattccagccagctttcaaaanacaatagtctatccccaagaggaaaaactgtcctttcttggcgacgtttggtagacattataacttacgaagacacggggcgagttaacagttcgagaaagcgacaggttcatcattcgcaaagaatcggaaagccccgatcccaggaaagtgacaacaccgatcagtaaaccgc

SEQ ID NO: 674538 - DNA, 146 bp, Homo sapiens
ctaccgcctgtgtgacccctctgtgaagagtttgtaccagacgtcccccctttttgggatgtatttctcagtggaaagagttggaagctgagagttggtgaccccgtgtatcggatggtggattaacaggcccagtggctgacatg

SEQ ID NO: 674539 - DNA, 173 bp, Homo sapiens
gtggtgctgatattagcacagccacaggatcgcgacatctagtcttcatacgtggatcccggccagccatggttgccaccagctttatcctcgatgactactttcccgaacaaagagctggctgcatgagagccagaacctagaaggaagccaacctgctctagtgctgtcat

SEQ ID NO: 674540 - DNA, 165 bp, Homo sapiens
tttttttttttaggagcactaggattttaataaacagaacccatcctaaagccatgactacaacagtggtacttgcaccaaaacagctatagaaaaccagagtgtggtgggtaggacccgtaagccggttggggagaggatgtgagtagaaggcaacggcagtaa

SEQ ID NO: 674541 - DNA, 139 bp, Homo sapiens
agtgatctagccgagcttatggtgcatgcatgtggtgagtacgatattatctcctcaggaacaaaatgtgagagggggctgacgctggctaacacagcagggtggatgccacatcagaaagtgagtactagtccccttg

SEQ ID NO: 674542 - DNA, 1303 bp, Homo sapiens
cgtgacgcgtgggtcgagccacgcgtccgcggacccgtgggtccggctggacggtacgacgcgtcccaggagttggggatgtcctacaaacccatatgccccatgctctcgagcgatgcaccccttggctcctagcaccccatgaggccgggcaccccgggtccctacgaggtgaggatccaggctccacgccctgctacgccgtgcctgggctgagacgatggtctcggactgcagcaagacggggctagcagttcatagcagataccgtggggccatgctcggccgtaacccgtacggcgtgagacctacaggttgtgcatgggccttgttgaaaccgtgggacgttaggtcaacggtaataggggcttgagtacgagttggaagccggcaagggggagcaggggggaccttaaagatcccagcttgtagacagatagggacattggaggacacatgcgcatagttgtacacggccaatacccgtattcgggtaaggggcgacaaatccacatagacgacaaccccaggagcttcctctaggcggccatattgaggactaagacgactctaggagacgaggtccgaggcggcatacacccattgacccggccagcataccatgtaacccccatccgttgataagccatcactggagacaggaaccacgtatggaataatggcacatcgtaatcacgtgaaaagtagcctgttatcacgcccagactaccgtcacaacagagatcaactggagggacataccagaagcatggcaacgagtgagtggaatagccaagcaggtgcagaacgttgccacctattaattacgacagcaaccgccagagcagtctggtaggaacaccccgaagaggatattggggcgacagtcgcagagcacttaattcgcaaagttaggtgagagtataaagccctagtagcgatgataggacggacatgcgacacaggctccatatcacaccgggtgtgtgcagaccacataagtgtggtgaaatccgcgagagacagtcacacacccgataaaccgatcagtgtggtacgctcgctgagacgtggttctcgtgcgctccatcgtaagcgtatggcaccactctatgacgtgcgaaaacaagtggaataacaatatccctgcagactataccacgcttaatagtgccctatgtgatctccggaaataactacgtacccctagtgtagtaagcactctgcgcttgtacggctatcgaagtggagtcagcatgactcacatctatgcatcacttggagaccctcttattgtcaagca

SEQ ID NO: 674543 - DNA, 274 bp, Homo sapiens
cgcttgcgtcttggacccacaaattttttttttggtgagacacagtctagctctgctccccaggatggagtgcagtggcatgatcatagctcactgcagcctccaattcctgggctcaagcaatcttctttcctcagcctcctgaggagctgggactaggcacatgccaccatgctcaactaatttttgaactgtttgtagaaacagggtctcactatgttgccctgatagttctcaaactgttgggctcacgtgatcctcctgactccacctc

SEQ ID NO: 674544 - DNA, 754 bp, Homo sapiens
acgaggctctctggggttccggtaaagcggcggctgccgatctccggtggaggggccagagggccctcgggcctgacgatggcagtggacactgcggcggcagtactgaccgctctgggcggggcgctgaggctggcggcccgtcggtacatgaggcccagggtccatcagatgcgcataggcggagacccaggcctcatgcacgggaagactgtgctgatcaccggggcgaacaggggcctgtgcccgcgccacggacgccgagctactgctcatgggagcgcggatgatcatgggctgccgggaccgcgcgcgccccgaggacgcggcgggtcagcttcgccgcgagctacgtcaggccgcggagtgcggcccacaccctgccgtcagcggggtgggcgatctcataatccggaagctggacctcgcctcgctgcgctaggagcacgccttctgacaagaaatgctccagagaacagcctacgctggatgtctggatcaataacgcagggatcttccagtgcccttacatgaagactgaagatgggttagagatgcacttctgagtgaaccatatggggcactgtctactcaccaatcttatacttagactcctcggagacatcaattatgatgacttgaacagtgaacaaagctataataaatgcctttgttatagaccggagcaaactggctaacatttttgttaccagggaactattccgccttttataaggactgtaaccgctgtgtt

SEQ ID NO: 674545 - DNA, 589 bp, Homo sapiens
ttacaggagactcaagaaggaaattaaaaaattatcgaaacaatgaaaatggaaatacaacatactaaaatcgcatggatacagcaaagcagcactaagagcgaagttgatagcaataaatgcctatatcaaaaaagtaaaaagactttaaataaacaacctaagaatgcatctcaaggaactagaaaagcaagaacaagcccagcctataattagtagtaggaaagaaataataaaaatcagagcagaaataaatgaaattaagacaatacaatacagaatatgaacaaaaaaaagttgttttattgaaaaggtaaaaaaaaatcaacaaacctttagctatgctaaggacaaaagagagaagacccaaataaataaaatcaaaaatgaaaaaggagacgtaacaactgagacatcagaaatacaaagaatcattagacactattatgaacaattatactccaacaaactgggaaacctagaagtaatgcatatattcctggacacatatcacttaccaagattaaaacacaaagaaagctcaaaaaaccaataacaagtaacaagatttaagccataatgtgaagat

SEQ ID NO: 674546 - DNA, 748 bp, Homo sapiens
agttgtttagagatatgcaaagaaggaaatatatatgatgtcacacaagctccagtaagctatccactaagcaggtgcctgtgcaactctgatttatggcattaacatatcaaattgaaggaaggattctagctcattttccattcaagcatcttcccactgcctctcttccagctaaataatcagagaagcagggcagtatatccctggagatccctgacttttatctccataccttaaattgttggtagatcctttggatgtagagataaaaattcattatgatgctagaggcattggggggtccatgcgaaaggttcaaacagcctattacattaatgcacatgtggaaagaacaaaaattttcaagctaagtcttaagttcaaatctataatttttttctcttcagttctgttctttgtatgataatacttaaaaaagtagttgtcttcttttcacatacacctctttaaagctatcatcttataataagtggaattggatgcttattgtgtgcccagcacagtttaggaaaaaaataattggcactgtttgtccagttactggagatcttcattttgatgctttgtactttgttccaggtctttaattctcagtccatcttttcctatgattgtgtacttcacatgatacattccatataaagagctcttttaaaatgactatttcaaaaatactgtacatttatatatagtattttttctcataaaaatgtgatagtttata

SEQ ID NO: 674547 - DNA, 226 bp, Homo sapiens
gaggtgatctagacgatccgatgcgcgagcttccatcaagaagagctttttaactagagattttaaaacaaatagactttaatttatagagaagttttacatttacagaaaacatgagcacatagtacagagttcttatatctcttctctacctttcagtttccctattattaatatcttgcattagaatggtacttctgttgcagttgatggaagcgtcgcgcat

SEQ ID NO: 674548 - DNA, 363 bp, Homo sapiens
gatcaaagtagcttactatatctaaactgtaaaacaatatagttttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagcagaactgt

SEQ ID NO: 674549 - DNA, 328 bp, Homo sapiens
  misc_feature (104)..(104): n is a, c, g, or t
tactacaactaaattcgcggcggcgttgaacgggagcggtagcccagccttgcgtgcacaaacatccgggcttgtgggtcatttggtcgaagtgacgatcacgntgtttttccgcatcgatcatcacccgcttaccgtgtttttgcaggagataagtgtggatctgtcgtacctccagcgagctgtagatcgacgccacatccagcaaacccatcagaccgtcagtgctgtagtcgcgggtgttcatcagcacctgggtaccgcgcacgccgcgcggtagagaaggtaccggcgttcgagtccatgggctttcaactgcggtcgacgc

SEQ ID NO: 674550 - DNA, 474 bp, Homo sapiens
  misc_feature (20)..(20): n is a, c, g, or t
  misc_feature (25)..(25): n is a, c, g, or t
  misc_feature (36)..(36): n is a, c, g, or t
  misc_feature (73)..(73): n is a, c, g, or t
  misc_feature (75)..(75): n is a, c, g, or t
  misc_feature (78)..(78): n is a, c, g, or t
  misc_feature (193)..(193): n is a, c, g, or t
  misc_feature (277)..(277): n is a, c, g, or t
  misc_feature (356)..(356): n is a, c, g, or t
  misc_feature (381)..(381): n is a, c, g, or t
  misc_feature (413)..(413): n is a, c, g, or t
cagaaaaccgggccgcggcnccgancaagcttgggnccgggtcagggacacgcggaggtcaggccggtgaagngncanggaagctggagcacgatcccaggaggaacaatcctgcaccatgactcaacagccacttcgaggagtgaccagcctgcgtttcaaccaagaccaaagctgcttttgctgcgccatngagacaggtgtgcgcatctacaacgtggagcccttgatggagaaggggcatctggaccacgagcaggtgggcagcatgggcttngtggagatgctgcaccgctccaaccttctggccttggtgggcggtggtagtagtcccaagttctcagagatcttcagtnctgatctggggacgatgcccgggcnaagggaactccaaggagaagctggtgctggantttacctttcaccaagccagtgctttcttgttgcgcatcccatttgaacaaagatccgtga

SEQ ID NO: 674551 - DNA, 125 bp, Homo sapiens
aggggtgtctcaaggcggacacaagtcgcttcgatgcttcgatctttcttaggagcgtctggtgtcgaaatcgcctgttgtaataatgcgggccacttcggtggtgaacagctcatgagttcggc

SEQ ID NO: 674552 - DNA, 509 bp, Homo sapiens
tctgctcggaccccgagtaagctggatagaggcacccgagcacacgcccggctaagtttttttgtatttttagcagagatggggtatcaccatgttagccaggatggtctcgatttcctgacctcgtgatccacccacctcagtctcccaaagtgctgggattacaggtgtgagccactgtgcccggccatcttttaattctttaataaagtctttgtctagtagatttgctatcaggtttttgtgggtttttttggtttttgggttttgttttgttttttagacagagtcttgctctgttgcccaggctagagtacagtggtgtcatctcggctcattgcaacctccacctcctaggttcaagtgattcttctgcctcagccttccaagtagctgggattataggcacctgccaccacacccagctaatttttggtatttttagtagagacagggtttcagtatgtgggccaggctggtctcaaactcctgaccttgtgatctgcccg

SEQ ID NO: 674553 - DNA, 212 bp, Homo sapiens
taggaaaaaaaaaaaaaaccctgtgatgctatggttgggggtagttaaggaaaaaccacattaaaatgtgggcccccattttctttctgatcctaaatcattttgttttataaatcagctaaagcatctttttagaattaatcctgaaaatgttgaatgttaaaaaaaaaaagtttggatatacccataattaaaaatccacccttttggca

SEQ ID NO: 674554 - DNA, 299 bp, Homo sapiens
tggctaattctttgtatttttagtagaaacggggtttcaccatgttggccaggctggtctcgaactcctgacctcaggtgatccccccgcctcggcctcccaaagtgctgggatcacaggcgtgagccacctcacctggcctatattgtacagttttgaacagtatagatgcatacctgtttacaaatgtgtatgaagatagatatttttacctcttatttgttcaatttactttttcttgtattaattagtatattgatctaattaaaggttaaagctaaaggctttatgaaatgttt

SEQ ID NO: 674555 - DNA, 447 bp, Homo sapiens
  misc_feature (302)..(302): n is a, c, g, or t
tctacagatctacccagctactcaggaggcggactggggattcactttggtccaggtgtctttctggtattgtagacatagagctcgttatacaaaaaagtctacaggaagggagaagaatgtcgtgtcccaaatgaatacgcttcccaggaagtggtgagaaccatcttaatcatgaaaaattcctgtggaactgacatgttaaaggaatgtaaaccataccagcacagggagggcatgggcttggtccccggggcattggggatgacgacacaatgaaaacgaacgaacgcccaccaggnccatcaatcttgaaggtactgaaagccctcgttgttattaggactggtcattctcctaattccagcctagtttttttgtgtttgtattgtttgagatgaagtctcgctgtttgccacagtggagtgcaatggcgcaaactttggt

SEQ ID NO: 674556 - DNA, 432 bp, Homo sapiens
gaagtcagacttagtagtgaaccttgggacccaaggaatgacatagtggtgagctctttgagttttctttttgcttatatttttctgacctgtagctgtagaggctgttcacccagaaatgccaatgggtacaggctctgatatggttcgactctgagtccccacccgaatctcatattgaattgacacttccataattcctgcatgttgcgagagttacccagagggagataatttgaatcatgtgagcgggttaccccatactgttcttgtggtagtgaataagtctgatgagacctagtgcttttatacgaggtttccactttcgctacttgctcaatctctcttggtgtcaccgtctacgatgtgcccatcggcttacaccatgattgtcagccctcatcaagcacatcgctgccagtgcttcctgtc

SEQ ID NO: 674557 - DNA, 152 bp, Homo sapiens
gattcctgtgcatactatcacagctggtaattttgtatttttagtagagatgggatttctctcatgaccagccatgttggctggtcatttctcaacatgactagccatgttggccaggctggtctcgaactgctgacctcaagtgatacacc

SEQ ID NO: 674558 - DNA, 147 bp, Homo sapiens
catgtggtgcactcctgtagtccatatctactcgggaagccgagagatgagaatcatctgaacccaggtaggcggagagttgcaccactgttcgacagagcatgactctgtctcaaaaaaacaataacaagatttgccgaggtggta

SEQ ID NO: 674559 - DNA, 369 bp, Homo sapiens
gttgtgacaaccttggcctaactggattaatctctggttttcttgccaccttggggaagtcccaatccaattttaatcctgagcccaaccaggccttgccatgggcctctggtcctttggaacacttgtacccacaggtgaggggcagaacctgaaggaatgggcctgttcaacaatcagccataatgggggtttttgtcaactgctggtaaatggatttgggaatgttggccccgaatgaaaggttgaggcaagcctaggtggaggcaaggggaataacttaaattgggcgaattgggggctgggcaaggaagagaattcttgggaagtcttgctggccgctgttgaatacggttcctcttgacctaa

SEQ ID NO: 674560 - DNA, 976 bp, Homo sapiens
agcggactgtgccgccccggagcagactgcgtgaggctgccgccggaggcgcggggcattgcctggggatcgtggtcggagagcgcgcccgagacccactagcggagacccgcccggggacatacattatccacaacaaattacacgacaatgatgcccaatgaatgggggaagaccaatgggaaaccggaggccgatcacaggggagagagagagaggcagaggatacacgaccttggaactgagagagggcacgatgaactgaaggcagagatggcaggaaataaggaccatgcatagacccacggaaccaagaagatcaccgttagcccaataaggaggaagaaacatggcaagacgacaatcagtaaacaagcagaaggggcaggatggcagaggcccagtaccacgaacggaagggaaacgagaccaagcagtgggaacaggaagcctatcaagcaccgtacacaaggcagataagcggacaaggagacagagaacaagcgaaggaaagatcccaaaaagagaggggaaacaccggcaggggaaggacgtggaaaagacacgagcaggaagaggaacaaaccagaggaaacaagccagcatacagaaaaacacgaacacaaacgagggaaagtccagagacacacacaaaacaacagagagacgaattgagagaacaaacaaaagcagaagtcagagggagaaatggcaacacaaaagacgacgaaaagagcacacacaaacagaatgagcacggacaaacagagacacaaacacagagaagggacgaggaacaggacacactgagagagggaaggagaacacagaagacaatacacaagaaaagcctatgacacaaaagcgagacaaaagagacgaaacaaaaagcaacacacaaataaataaacacacagaaacaccacagcacaggagaccaaaagaaaaagaagaaaggaatacacaaagcaagaca

SEQ ID NO: 674561 - DNA, 528 bp, Homo sapiens
ggagagaactagtctcgagttttcggtggtgggtttttttggaacgtgaccttaaaactcaaaattttattgtctccataataaaagctattagtgggagtaaagttgaacgtccttgaaagaggataatgatgcgactgtgagttgcgtccgaagcttaggagcgttcgctaggcagaaatactaattagaggacttgtaacgcccaggtggccgacttactcgagcacatgactgcccccggctaaaacctcaccggggggtctgcgaattcgacaaaatggcctgttaactaccaaacgggggcatactgtggctagattgcagaagcagttacttgcacagtgacaccccgcattacaaagcggctcgtagccgagctcggaaaggacaaaattgggcagcctgctccataactacaacgccctcgaaaaaggggaaacagataccaacggaaaacgggcacagcacacaaggtgtgtagtccaaggcggggaacaccaaacggggtatcacggggaaataaac

SEQ ID NO: 674562 - DNA, 450 bp, Homo sapiens
cgaagtatctagtaaatttcttttttattttcctatgactgggcatatttctggtacttggcatgctaagttatggtaattgtcattaaaatactgtacattttgaatattatgcatgggcaaaatggaaaaaaataagaaaaaaaagatatcttctccaggtctgtgcatttgggttcggtatggggacactacttcagggcttagccaggtctttcacaaccctgccttagtccggtctttagcctagagattagccagaggttgaagttatgctcccctcagatctcttctaagcatgcattcggccctgagcattcaaggggctttctagtccccgggtatactggagcactttttccaagactttattccccaaagattctcattccctaccttttctttcctgggctttcagcatatctgtggtaggtctcaacggtgctttgg

SEQ ID NO: 674563 - DNA, 1163 bp, Homo sapiens
ggggggcggggcctgagatcagtctcgcacagctgccggtcttatcgggggctccgtaacttatctataccgtaccgcgtcagacgccttgaccaccctcatactaccaatatgcctggtaccgacccccagtggcactaacgtagggatcctcagggacgctctcccagccaacagcagtgagccgcccggagcggcgggatccacatgtccggccagagagaaaaatgccagctgtagggacaaggacgtgccagagccgcacaacctacggcaaggcaccaggagggcgcatgtaggcgattctacacacacgaagattcacctggagctcaaacgtaggccctgacaccagtcacttgggtccatgcagtctaacctgattcatcagctatactgatacattcatagatagcacaatatggaggacaaagatacacatcgattcagatagatacagataaacaatccatctgaccatcatgcacgcacgcgcaggcaaaaacacacaacatttcctacggacccacaagttacatacgtagactactcctgcaaccatgacacagcaccccttctccctagttacacccttgcatcgatctacacacgggcgcatttaatcaacataactcgacactttcgcacggcacctcagcgatccacccctatctggcctccctacactgtctaaatatgccaccttaaacacacacgcagccgcactgcacagatcaacaataccattagccgacgccgagctgagcaaccactaaaagaggcgcgtcatcggagcacaatcgcctgagagccacgggggacccaaaggacaccagaaaacatggccaaacggctctcccagagagccacccgggaccacgcacatacgcgcagtggacacacccatcccccaccataatacacatgccgccgctgggtacaccgggcccctgcaccacacaaccacgcgatacattcagaaccaaatccaggcagcataaaacacggcaaaacaagaagcgagcaatacaaacgcccgatcgagacagagaacccccacgacagagagtcgaacaagctcagagagacagccagaaccccggagcatgcccgccccacagcgaacgccgcgccaaccccccgacatgcgccaccccgccccc

SEQ ID NO: 674564 - DNA, 140 bp, Homo sapiens
accggggcagcttggagtggcgagtgcttcgaaggctatgaaagtggtttcatgatgatgaagaacggcatggacatggaggaaggtgaacgtaaccctcttccttggtaggggtggacctagtgtgaacagtggagggc

SEQ ID NO: 674565 - DNA, 370 bp, Homo sapiens
gggtggcgggggaaaaacaaccgttttgccaggtcacccaaacctccagacaaccggctagcccccctggccgttccttttacgcccaagttttgctccttgaaaacagattgggtgatgcccctgcaaccccagcccaaggtttgcctcaaagaccgagtgacataagccatttccaccctcctaggttcacatccagggctgtgttttccttgggggaggaaaaggtgtcgtttaaatcagggtaaggcagtcaggggggggttcacccctgcctttttttcctttgagggtgagaaccctgaacccaacccctgcccctgggtccctgtcctggaaaaggtttaataaatccttttcccttttttga

SEQ ID NO: 674566 - DNA, 477 bp, Homo sapiens
  misc_feature (24)..(24): n is a, c, g, or t
  misc_feature (63)..(63): n is a, c, g, or t
  misc_feature (101)..(101): n is a, c, g, or t
  misc_feature (119)..(119): n is a, c, g, or t
  misc_feature (122)..(122): n is a, c, g, or t
  misc_feature (131)..(131): n is a, c, g, or t
  misc_feature (134)..(134): n is a, c, g, or t
  misc_feature (136)..(136): n is a, c, g, or t
  misc_feature (141)..(141): n is a, c, g, or t
  misc_feature (150)..(150): n is a, c, g, or t
  misc_feature (177)..(178): n is a, c, g, or t
  misc_feature (180)..(180): n is a, c, g, or t
  misc_feature (201)..(201): n is a, c, g, or t
  misc_feature (217)..(217): n is a, c, g, or t
  misc_feature (221)..(221): n is a, c, g, or t
  misc_feature (229)..(229): n is a, c, g, or t
  misc_feature (232)..(235): n is a, c, g, or t
  misc_feature (238)..(238): n is a, c, g, or t
  misc_feature (255)..(255): n is a, c, g, or t
  misc_feature (259)..(259): n is a, c, g, or t
  misc_feature (301)..(301): n is a, c, g, or t
  misc_feature (313)..(313): n is a, c, g, or t
  misc_feature (334)..(334): n is a, c, g, or t
  misc_feature (336)..(336): n is a, c, g, or t
  misc_feature (347)..(347): n is a, c, g, or t
  misc_feature (354)..(354): n is a, c, g, or t
  misc_feature (357)..(357): n is a, c, g, or t
  misc_feature (359)..(359): n is a, c, g, or t
  misc_feature (369)..(369): n is a, c, g, or t
  misc_feature (371)..(371): n is a, c, g, or t
  misc_feature (379)..(379): n is a, c, g, or t
  misc_feature (387)..(387): n is a, c, g, or t
  misc_feature (395)..(395): n is a, c, g, or t
  misc_feature (402)..(402): n is a, c, g, or t
  misc_feature (449)..(449): n is a, c, g, or t
gttccccgagtggagttcccagcngcccgcggctgacggccagatctgtcctgaggggtcgtnggagcccagcgcctgccattttcctttgtaaagaagtnatccacctcctcccagcngtncccataaanaanangctgnccgagcctnttaaaacagcttcttgaaagggttttnncnttttttgttctgtgtattgtnctgcttcagctctggnggangctctatnaannnngtnacagggtcatggtcgcnttcngttttgatggtacttgcgatggtgtgtgattttccaggtttnggggggaaagtngcacgaagtcagaggtatatngnggagcaatgangtccagnacntnagtgacaaantngcgaatgnttgtaatnttagtttncagcttntctcagacactttcggatgtaactgacaacaggaagtacataatctngatttagcaggtgaaccatcctgtccag

SEQ ID NO: 674567 - DNA, 873 bp, Homo sapiens
tttttcacgccccgcaggtcccgccccctttcatgttatggcagaatgctgccttgccctcttaattggactgtctttcgcttccccgtctcatttttgttcgtcatctcctcagccgccggcctgctgggcggtggttagtcaccccccccgctggcctcgccattttttttggtgccatgacgttcctctcttatgcccgcccctcggggggggcgtggtattagtccgcttgttgttcccggctacgcctcccccctccgttaacacctctttttgtttgtgttgatgccaggttatttgttttttacggccatgcaatcaattccgccccgcatgttgtctgtcttgtggcactcggacagttattgtgtacgccgcgctggccccgcgcgccgccctcttttttttttttttttcgcgctccctcttcgtcacactccaattactcagtgggggttagccacccccgcttttttgttgtgcttcagcaacccccctcctctcttcagtaggggcggcacgtcccgcccgctagacggtgggttgttctccccgacgaggggcgcgcttgttgcaaggagagagtgtcactcctcccatcaacaattgcgcgtgtttggtcttgccccccccttattagggcgcgccccaatcccccctccttgtcgactttttgtttctttgtctcgcgcgctcgtctgttttttcctacccccgccttcgccctcctgtcgtccccccttttttgtcaacgcgcaaaaaaaaaacccttttgtaacacacaaccccaccccccccttttccccccccctctttcccccccccccccttttcccctttttttcccctttttttttatattttttttta

SEQ ID NO: 674568 - DNA, 581 bp, Homo sapiens
gacaaatatttctttttcttcttcttttctttgttgagacggagttctgctcttattgcccaggctggagtgcaatggcgtgatctcggctcaccacaacctccgcctcctgaattcaagcgattctcctgcctcagcctcccgagtagctgggattacaggcatgcagccaccatgcccggctaattgtgtagtatttagtagagtatctggaggttggtcaggctggtcttgaactctcaacacttctgggaggccgatggggggagcagatcagtgtgagcgtcaggagcttcgagaccgaggcgggcgacatgggaccagtgcgatctacggagctacgagtactacgatcggcgcaggtgtgccggagggccgcaggaggcccggcgagcttggcaagtgctgaaggcgagagagacatccagcatggaaccagcgagtgcgcgatgcggaagcagagaagacgtccgtacgaattgccgcggccggagcgccaggcgtgggtggcacaggacgagacagcaacaagcgagcacccgaaggctaccgagaacgaggaccgagcatggggggatcac

SEQ ID NO: 674569 - DNA, 125 bp, Homo sapiens
aaccccagattcctcgggctacagatcaaatccagagcaaggcctgtaacaatcctggtttttacctttacttaagtgaactttgctaaaggctaaaaatttttgatacaagaatccctcctcca

SEQ ID NO: 674570 - DNA, 488 bp, Homo sapiens
  misc_feature (353)..(353): n is a, c, g, or t
tgggtttaaaagtaatgactttattaataaatatacttccatatgatgatgtaaatacaaatcatgaacactactccattctcccatatacacattaattgtgcacacgagttagcctcaagtttcagtggacatataaaaacattacacagtatctatttcagaacttttatacagcaggaggacaggcggtgcttattactcagtataatgtggtaattatttctcctccaaaattcaccgtggtggcaaacaaagaaatattctgtgaaacacttacaaagacaactccaagaggtgactcgtgattcacttataaatccaccaccacttgaattctcactaatcatagnctattaaatatttcctcccaacacatcattacatatcactattacacctgttgttcgacagacagccaccagatatcttccatatattatgtgggagaggcgaggggggcaacacaaacaaacacaaagagaggc

SEQ ID NO: 674571 - DNA, 458 bp, Homo sapiens
  misc_feature (19)..(21): n is a, c, g, or t
  misc_feature (23)..(23): n is a, c, g, or t
  misc_feature (83)..(83): n is a, c, g, or t
  misc_feature (103)..(103): n is a, c, g, or t
  misc_feature (152)..(152): n is a, c, g, or t
  misc_feature (160)..(160): n is a, c, g, or t
  misc_feature (222)..(222): n is a, c, g, or t
  misc_feature (319)..(319): n is a, c, g, or t
  misc_feature (355)..(355): n is a, c, g, or t
  misc_feature (424)..(424): n is a, c, g, or t
  misc_feature (447)..(447): n is a, c, g, or t
aaatgacctgctttctttnnntncccgggcggcatcggacccgtcggagagtaaatcccaagtaaggtacctgccgttggaantttgagctttcttcttgganacctaatacccacagtcctccaggctccggtagattgcaaatgacctgntttctttnttttcccgggtggcatcgacccgtcggagagtaaatcccaagtaaggtacctgccgttggcnaatttgagctttcttcttggatacctaatacccacagtcctccagtaaatcccaagcaaggtacctgccgtcagcagatttgagctttcttcttggntacctaatacccacagtcctccagtaactcccaagnaaggtacctgccgttcggcgatttgggagctttcttcttgggagacctaatacccacagtccttccagnaaaaacaaacaaaggacatgggntttactgtggc

SEQ ID NO: 674572 - DNA, 187 bp, Homo sapiens
  misc_feature (119)..(119): n is a, c, g, or t
  misc_feature (143)..(143): n is a, c, g, or t
  misc_feature (187)..(187): n is a, c, g, or t
ccaacgcagggggtatcccctgatttcttcagctgttttccaaggaggaagagaaaagcatcaagataacactctcccaaagcaggtcaagacaagactcctctgcaccacggtgggtncggagttccctgcattacgcacangctatgttttacacataaattgtcagcttatgggactttctccn

SEQ ID NO: 674573 - DNA, 1903 bp, Homo sapiens
ttaaaagaggaaaacccggtaatgatgtcggggttagaggaataggaggaaaaggggggataggtgtatagaacatgagggtgttttctcgtgtgaatagacgggtttaatgtgtgtggtaacatggtgggtggggtggatgtagagccccataggtggttggtgggtaaactattgtacagaggagactgtatatgtggtctgtgtgagactacgtattgttgagaagtcctggataagtaagagaagagtgagataactctgtgcgactccacagagacacacactctgggggtgtgtactcatacacgcaccaacagacagagtgatttctctccccagtgatagcgtgtgtacacatacagctgtgcggtggcgtgataacacgtggtgcagacagtggtataccggcgagacagtgcttcgtggccatcaagaagtgtccatttcacacaacagcgtctcattaagagaagtggggaaagaatacacaagtattgtgacagacgtttctctgtgagagaaaagagagggagactataagtgagcacgtgcgccacactcgtgtgtgagaagtgtgcgcgtattcgcgaataagattgtgttgcacgtagtgtgagtgcatagggcgcacgaaaatataagctaaaagttgcgacgcgacactgtgtataatacggccccgcgtggtggtgggcgcagcaccatatatcgtggagcacaacatgtagtactcggtgggcgcgcgcgtcgtggtagcacaacgccttcctcacgggggggggagggtgtagggcagcaacagtagcaacaaaaccatgtggcgggtcgttgtgtataacatcataacacagaaacgagggggccatatcatgtgttgccgcgcgtagctatgtacggacacaaagagattatgttgtcaccaaatgtaggaacgaccaagaaattatattaacacgagactctcagtaggagtagatgatggacaccgcagatacatggcgccacgaaatattggggaaacggctgttgttgtgtaaacaacttaaacaattaataaaattcggccgccccttcccaaatagagggggcggaaaccataatagtgataaccccacacggggagcaccacaggggggggagataacagagggccccacacagtgcgatgcacactaccggatcccacagaggaggggcgggatctgcaggaagaccaacacacgatgacacggtcgtgggcacgaaaggcggcggcggataaataatataaacacccaagaaaaagcgccccgcacccacacaagaattacaaacaacaaccaaggcatcacccgtgggcgggaccaccaaacagatatccaccaatatataggggaaccccccccacagcacagaaagagggggagggggcgaacacacgacacaaagaggaggcagccctaaaaacgacggaaggacaggcctacccacacaaagggcgcggagagaagcgactctcggtacaacacaagccaacgaggcacaccactcgactacaactcagcaactcaaaaacacaacgcacgcccaattacgcgagcgtgcaacaacacggacagcaacgccaccaaataataacaacgacaagtggggaggagcgacacagacggaaggcaagtcgatgcggacaacaacgcctagcgtggcgcgccagaagcaactagctggcagcacatagacagcaatacgcagcgcacggaaagccaagcccccaacgcgggcggacggctacgagacggaacactaaacaacagacaccgaccgcaaacgacgacaaaaagcgagaccaacgaagagacagccaccacacacaacattagcaccacacacacaccaacgagccccatccagataccgcagg

SEQ ID NO: 674574 - DNA, 482 bp, Homo sapiens
  misc_feature (216)..(216): n is a, c, g, or t
  misc_feature (364)..(364): n is a, c, g, or t
  misc_feature (408)..(408): n is a, c, g, or t
tggtttctttatcagggaaaagaaaataccagccctcccttttggacaaaattgttgggctttgttcagtcagggctgagattttgcaggtaaaccctgggcggtgtggcacttcattgaatttattagttttgtattccaaggacattttatgaaaatatcaaatattctgaaaacttccatgcttgatttagaatttaaataaacactatgagncaactccttggtagagattgtttaaatttggaacacatactgactcttcccctgaatttttgagatcccctgagactggcattttacttctgtgttttaccagttggaatggagcaaccttcactaaaatctgtactgatggattttngtaactttttaatgccatttaagaacataacacctttaaattanaaatcttcaaaaggctcgtcattctgttcaagagaaggttcaatacatattcttctaattcaggaaaaaaaaaa

SEQ ID NO: 674575 - DNA, 134 bp, Homo sapiens
  misc_feature (6)..(6): n is a, c, g, or t
  misc_feature (119)..(119): n is a, c, g, or t
gatttnagaaagataccagcagcgcagtggtggcctccttggagcctccagacttctcaatctcctggatgagaacttggagtggaaaggagggtgtggcagggcctgtcaacatgatnaactgcccttgaagg

SEQ ID NO: 674576 - DNA, 283 bp, Homo sapiens
ggtctgacctttacaaaaaatacaaaaattagtgggatgtggtggcatgctcctgtagtcccagctactcgggaggctgaggcaggaggatcatctgagcccaggaggtcaaggctgctgtgagccttgatggcaccactgcgttccagcctgggtaacagagtgagaccttgtctcagaaaaaaaaaaatgtagggagacaaataatggtcatggcaagagaatatggtcactttgcacatgggtatgagtagagggataagaaaataggccaggtgcggtg

SEQ ID NO: 674577 - DNA, 112 bp, Homo sapiens
ccgggagccgccagaggcctgcagtgatattgggaggcttgagctaaggggtaagtgtttggcttttgagctcgtagaagctgtcaggatcaaggacgttttctaattctat

SEQ ID NO: 674578 - DNA, 342 bp, Homo sapiens
cgtttccatttttatgtatgttttgaaaagaaaaggtccggggatggtggctcacacctgaaatcccagcactttgggaggccgaggcaggaagatcattgagctcaggagtttgaaaccagtctggacaacatggggagaccccatctctaccggaggaaaaaaaaaagagtcaggcctggtggtgtgcgcctgtaatcccagctactcgggaggctgaggcaggacgattacttgagcttgggaaatcaaggttgcagtgagctatgattgtgtggccacactccatcctgggtcacagagtgagaccttgtctcaaaaaaagtaacataaggaaaaaaa

SEQ ID NO: 674579 - DNA, 108 bp, Homo sapiens
acttataccctgaattattttacatctactgtaccattcaaatgcttaaaagaaggctagcattgtttagcacaaaacgttggtgatatcccaccccaaatagctaat

SEQ ID NO: 674580 - DNA, 925 bp, Homo sapiens
  misc_feature (925)..(925): n is a, c, g, or t
gcctgggggacaccagaggtcggatggggggccgagtggtgcgatcggcgtcgatccctgatgcgacgcttccgtgctcccaggtcggtctattgtgcgtgctctcccctgatgactggaggtcctggttcacatttcacggcagtcagtgcttcagtgtacgcctgtcacttcaactgcacctgcgcgccacgtgggcctcgcctctgtgctcgtgcgtgctgtagatgggctgctgcccgctcgacgaccgtactgatcgccgtatccacgcacacgcgcgcgtcctgcgcggaggccctggtgtgcgcgcccggctctcctgctgcgttttccagctatccggcgctgcagcgccgtgtcggttcaacggccctcgtgttgcacgttcccatgcgacttgccgagactttgagtccgcttgccgtccggctctccgggtgtgcagtcgcatgcctgagtgtctgccatgacgtgcctctttggactgcctgtcccggccgcctgctctgcccggcccatcggcgggatgtcctgtccatcatggggaccgatggccagttgccgcccggatcaccttgggctacgtgcgcaccgacggccgggatggaggcactaagggtcatagctagaactgggaccccccacaacccttgccgacaaacgccttgaacggcaatgacgcctaattccggtagggatcctagcccctggattggcccctggctggcggcccggggcccccgcatcctagtgtggcgccatggccctccagataggaacggtttaggttcccgcccctggtggaccttgatttggcacacggtttggcgtggccccctgtttgaagggcgcctttctcgcctggctggccacttgggggtcctcccccctggctggtggcccccctttgtggaaatccccn

SEQ ID NO: 674581 - DNA, 105 bp, Homo sapiens
ggtgccggctccatcaggtttcacacgtgcctgtaggcctcgtttgtggacacgctcctccacacatccccaagtgacctggtggttcacctacctgtccttgta

SEQ ID NO: 674582 - DNA, 522 bp, Homo sapiens
  misc_feature (367)..(367): n is a, c, g, or t
gcgatacattcttatacaggtgtgacaactgtgtatgaggttagccagttaacgcgaaagtgccagtttgcatggcttggggcccttccctattggtcaaatggcatcgagcgtcctacagtgaacgaccaccgcaatacagagtgattattcttggccgtgcttgccctgctccagcgtctgctgggtaaaaaaaccgacgcctcggacgcctcgcctatcccggcgtattttcaaaaaaaggccgaacaacagggctataccctcagtgacgggcaaatccgggcgattaccgccctgaatcgcgaggcacaacacctgctcaacggccaggccacgcgcagactgtacctgcatggcccggtgnggcgtggcaaaagctggctgctggatggatttttccaggcactgcccatcgccgagaagcaacgcgtgcatttccaccaacttctttcgcccggatgcaccagggcatgttcctgaaccgcgagcatgacgaagccctgggcgccactctggccg

SEQ ID NO: 674583 - DNA, 336 bp, Homo sapiens
  misc_feature (1)..(1): n is a, c, g, or t
  misc_feature (14)..(14): n is a, c, g, or t
  misc_feature (60)..(60): n is a, c, g, or t
  misc_feature (84)..(84): n is a, c, g, or t
  misc_feature (120)..(120): n is a, c, g, or t
  misc_feature (299)..(299): n is a, c, g, or t
  misc_feature (304)..(304): n is a, c, g, or t
  misc_feature (329)..(329): n is a, c, g, or t
ngcccggctccggnaggagtgagcaggcccgggcactgctggagcgtgaggccgaagagntcgaaggcagctggccgccctggncagaccgagccactcccagctgaggccccctggcgncagacctgtggatcctcggcggcgcactccccgcaggcgatgcctgtacttgagtttcaaccccccacagcccagccgaggcactgaccgcctggatctacctgtcactactcgctctgtccatcgaaactttgaggaccgagagaggtaggaactggggagccccgaagagcggctgnaaganagcagtgaccctgataatggcagcnaggagga

SEQ ID NO: 674584 - DNA, 247 bp, Homo sapiens
ccctgcgttacgccgctgttatcactcaatgacctcaagttctttaatacaacagtaaagacaggaagtctacagcccatgggactctggagacaggtggaaggaatggaggattggaagcatggacatgccaacttcagtgaggccagtgaggacatctttataggagacccatgaaagacatacgtggagatattacaactgacagtaacagggtctcactgtatagcagggcaaggttcgtgtg

SEQ ID NO: 674585 - DNA, 963 bp, Homo sapiens
  misc_feature (65)..(65): n is a, c, g, or t
  misc_feature (196)..(196): n is a, c, g, or t
  misc_feature (311)..(311): n is a, c, g, or t
  misc_feature (674)..(674): n is a, c, g, or t
aattcacgtctcctcggtgtatgacgacaaaccggtgtgttgtgcgccacagcaaagtgtgaagnggcggtttttcacccgtgacttgtggagacgccgcggggttaacaatccttgtgtggcacaacagttctctgtgtgaacacacatctggggcgggcacacctgttctcccacctgtggctcccgcctccgntggttctgtgttcgaggcgcctaacacacgtgggcgtatatccttttgcctgcccgacaaagcggttcagtaattcttttggctcccctcaccgggcgtcactggtgtagatcgnccctcttttgcggggtcacaatacgagttatgtgtccttaaagcggtctttcagcatcatgcagttgtttgccgccacagttattcggattctccctccaattattaatacaaggagagatcttaactatttctcctccacagacattgtcgaagacaccctcatccgccaccctttcaatatcgaaacaagctcctcttcttcgcttcttcgcaatttcctacaaacgggtttttaataaccatcctctcgagtttgttgaacagcccctcactcatatgaaagtaacctttttttaattccactggcccgccttgtagtctctcgctagtcttcgttcctgctagaacaaccggtgtctcncttctatgtgcgaccctattgtgcaagctagcaataaacccgcgtgcgagacctcaacatcgtggcgggtttacttactggtcaacatcccaccacaaacatgtgcgtccccccagtttctttcttggatgcttatgaaaccccttctttttttcatcatgacctccgactattcctccttttatgaaatataatctccgaatcaagtctgcacaatcatcaacacatgaaacgcgtccattaatataacacaaacaagcaaaccaccctctttgccccggacatacaa

SEQ ID NO: 674586 - DNA, 559 bp, Homo sapiens
ggcactctctcttaatgctgtgcgacatctccagcacacgctgtaatgtgtgaagaggacatgagcaccagcttctgtgacccatatccaaaccccagatgccgtttagtgttggagaattcaagtctctgcatgttagcaaactctaccctatggcctcaagggctctctgtcttctaatcctgggaaaatctatcataattccctcaacgagtttcagagatgtaagccatgaaagtgggcactcatcacagaaggcacctggctctggtgaaccataaccttcaactctgcagcacaaatggtcctgagcccagagaaatacaagcttggataatttctattcgccaactaaacagagtgagtattgggcggtgactttggaggttggagaataagaaagatgtaaagtgattgtctccaagagtgggaaagttaacggtactagatcatggtaggctcgttaggcatgttgagtgcccacttgagcaccgtggacatgcttgggctcctccagacatatttagtgctcaggtcgctgtgggttgcgttgctgtct

SEQ ID NO: 674587 - DNA, 713 bp, Homo sapiens
agcggggggaggcgggaggcgggaggcgggaggtgtggggccgtgaagcggcctccctcccgcccccagccgccggctggccgagcctgtgcagaagcgggctggaccaggtaccgacacctagaccggccgaagggtgccgtctggacacgcaaggcggactaccggtagacagcaccaaggaccatgaggggccgcagaagcccgggacgcacggctgctgaccgagacggagctcctgagaccgccagaggaggagcagacggatcaagtgcggagtcaaagacgtcgataccaggcggagtcatgacacgcatcgaggcataccaagagcaatgggcacgacttaacaagacccaaaagtcgcatatgcaacactgctggcataaacgtgtgaaacaccaggacgccataccgtcaatatgttaccagggcgattcatgatgagggcaagatggacacatcgcctcacaaatcgaagctgtctggagtgaacgtgcactggagaaacaagataacaagaaattggaatttgatggcggacacatgaggaacgatcagtggtggccccaaacgtgtcagtacagagagtcaatacaagcacgtaatccaacaacataggcagagcccaccgagacacaaaagaaggacccccacgaacaggaaccagcgagaacgccatcaggagatccaaataggtacagaatacgaag

SEQ ID NO: 674588 - DNA, 213 bp, Homo sapiens
cgcccctcagcttataccaatattatcatcaatcaataagtggtagcttttcgtggtatatccagacaatggcatattattcagtactaaaaagaaatgtgctatcaattcatgaagagatgtgaagaaaactttaagttttcacttagtgaaagaagccaatttggaaaggccacatactgtgtgattctaactatgtggcatcgataaaga

SEQ ID NO: 674589 - DNA, 151 bp, Homo sapiens
aacataagaggagaaaggaagggacatgaggcataccattcccccccccagaattagaggtaaaggaatcctaaaataaagagcacagcagcaatcacactcacagggtccagaggcgtattcctggccatcttcctagtactcggtccgt

SEQ ID NO: 674590 - DNA, 851 bp, Homo sapiens
atcggtgagaacgtcagcgggctgcagctgcgccaaaaccagggactggacaatgaccctggtgaaggaggtcgtacagaatttcgctaatggagttttgtgatcatgttgatctggcaaggatgctggcagtgcaagatttcatcaagagctgagctgaagaaggctggggttgatgccaattaccgactgtcccagaactggagtaaccaccatgaacccacgaacagcacacaaccaccattagcacaacaagtcactcttgcactagcatccacacgagaggcgcagcaggaccctgactgggcctacaagacataaacgtaagacccaacaccatgacgccacccaagggcgaggacaaatgaactgcccaatgacgaagggcaacgcgccccgggccaacccatgactggtccacaaagcacccgcccaacactttcccacggcgtacccgcagtttacagaaactcccttggcccaggaccggatagacataaattgatcaaccttggatctgacgtcaaactggagaagaccaccatcgtacttcacgctaatggagatcaaaaccatatacaaaaccgatttctaatcattcgccacacctacatttagtaaatggagtcataaaattgacaacgaacagatcaagtttacaatagaacttgtcgcaaacgttagattccccattggcaaccatggcccaatatacaaacgcactttcccagaaagtggatggacactacaccatggcagcacagtggaaccccgcccataatacaaccccattgcgagcaataactgcattacttatacccaacgtgatcaagcaaagaaaaagtagttac

SEQ ID NO: 674591 - DNA, 167 bp, Homo sapiens
taatcgatgcactggtgttatcgatgccactggtgttatcgatgccactggtgtaatcgatgccagcggtgtttatcgatgccactggtgtaatcgatgccactggtgtttatcgatgccacccgactcttagcggtggatcactcggctcgtggcatcgataaaca

SEQ ID NO: 674592 - DNA, 274 bp, Homo sapiens
  misc_feature (133)..(133): n is a, c, g, or t
gtctttcccctctgtggcaggttaaaccaaaatccccccaaaaattccgggtttcatggtagctctctttcataggggggtgccctacccccccggtccaagggggttttataggtccggaaccttattctgncagtggattgccctttttcttttcccgcaaaaatgattccagaagaaaaataaccccccggggttggttacccttggataccccaatggtttaggttctttgctttttacctttgggcttgggttaaaaggttttgtttgg

SEQ ID NO: 674593 - DNA, 629 bp, Homo sapiens
ccagcccgtaaaaaaaaatgggtggaaccagcccctaaaaaccggggagaacatattgcctttggcccccttgccataaacccaggccccgtttattatagcgtctcgggtgccttcttagtaagaacctttgccaccccaggcagccagtgcattggcttgcagggccattccataaaagatccttagtttccagggctttggtataggtctaaggtcgatagctctaaggttgagattggcatcatgttcactcatgccacctgacagatagcagatgccaggaacatctgcaggagcagtggtgcaggcatgtcctgcagtctccatgttgggctttagcagggtgccctccaggtatacatgatggtcattcaaggcattgtagacagcaggcagcactttctcagtaacatactggcagtgttccaggtcatggtctccatcaggaatagcctctggttcaacaataggtaccagtccattctgctgacagatgctggagtagcgagacagggcgttggcgttctcttgcatagcgaggctggatggacagtggtcggcaatcgtcagcacagcacgccacttcccaaagtcaacgccatctttcgtgaagtgagcggcacgag

SEQ ID NO: 674594 - DNA, 654 bp, Homo sapiens
tgctctttgggccgttccaattaacattccaagcgtcaatgttcggttgtagggcgggcccccccatcaagggcaagaagttattaatatgtccaacaattgctaacttagcaaaatttctctagtgctttagcatatccaatgcgcacatagacttgttgttatattaacaggttagtcactttctggaactatatgcataaggattaaggggccacaaataaggaagtcgttcatgtgttatctatgtagtcatttttttgaactctcattgcagtatttcagaagtttatatgccgatatctgcctagtaattgtatcatgattagttaaagcatatatcctatctgactgcgcttattgcatcttgtaggtctgggtaccagtatcctacgagtgacagaagcacttgccccaagtatttgcatcaatcaagagcatttcactttgtgtcagtacctgcagatctgatcagtcacatcatgggcttaacgtttaggcacttaattcaatgtagatcagtcatagtacagttctaaatttctatgacaaaataattatgtcactgtagttaatatatgtaagttcagataatagaatcgcctatgaggtagtatatcattaggtctagagttatagttcagcttagtaaac

SEQ ID NO: 674595 - DNA, 154 bp, Homo sapiens
agatgtgccactctgactggaagagtggagagtactggattgaccccaaccaaggctgcaacctggatgccatcaaggtatactgcactgagactggtgagcctgcgtgtaccccactcagccgagtgtggccgagagaactgtactcagcaga

SEQ ID NO: 674596 - DNA, 693 bp, Homo sapiens
taatggctctttcagttaatggcatgaaggagttacactagttccaagttaaaaggggaccccaaagggttactttatacaagctggtggaggtgtttaaacctggtgacaaggggagaagaagggaaattctactcattggcaagggaaatcctcacttaagcttcagtggagccacaagcacttaaaacccatgaaccttcagctgatcgtccttagccagtccaatctctacgaggaactgggcatatggttctggcggtgggtcaccctggtagctggaattcacttctccatattccgggatggctcaattacaggtcaccattggcggggcaaactttttcttaaacggccttcactagttcttttttaatcggtgaatcatcagggatccctgggacagtagtaaggggtcttcctggcgcggtttctctggtgagaatctcttatatgggattataatcctcagtggccaagcgggaacgcaggtcatcaccctttactgtgcactcagcaaaggggtcagaaagaggggaggtccgggaataggggacatacgatacgattcctttccctcgggggaaacggcctgcggaaggcggcgtgcggcggtggcgggcaaaaggcgggcaggggggcaaccggacacgtcggaaagcgagggggcccagggggaaggctgctgaatcc

SEQ ID NO: 674597 - DNA, 149 bp, Homo sapiens
  misc_feature (7)..(7): n is a, c, g, or t
  misc_feature (103)..(103): n is a, c, g, or t
accaggnctgggaagacactcaggctaagtgagtgcagcttccggccagagcacgtgtccatgctggccaccggctagagcaagttttttttcggaggttgcncacgctgacccagtgctgcctgggccagaagcacctggccatcctc

SEQ ID NO: 674598 - DNA, 307 bp, Homo sapiens
  misc_feature (10)..(10): n is a, c, g, or t
  misc_feature (27)..(27): n is a, c, g, or t
  misc_feature (202)..(202): n is a, c, g, or t
  misc_feature (260)..(260): n is a, c, g, or t
  misc_feature (300)..(300): n is a, c, g, or t
  misc_feature (305)..(306): n is a, c, g, or t
cattttaacnccttattttgcccatanttttgttgtctctcctaagttattttttagagacaggatcttgctctgtcacacaggctggtatacatgggtgagatcatggctcactgtggccttgaactcctgggctcaaaagatcctcccatcttggtttctctcaagtagctgggactacaggcacacagcatctcaagancctggcctcaggtgaatcgcttgaccccgggaggtggaggttgcagtgagccgagaangcatcactgctctccagcttgggcgacaggaactgaatcnatttnng

SEQ ID NO: 674599 - DNA, 317 bp, Homo sapiens
tagggttctggatgtagctcttctcttcttggctcccaggagctacaggggaggactctagtctgtcactggtggaggagaggaggtcaccaccgtcaggcaagctcttggctgctccttaccctgagtcccaggcgcagcctactatggggcttgagcctgtgtccctgggcataactctgtcttgcacatacaaatgcacatatactgatcaccagctcaagctcagagacacacagcccacttgcacacatctcacagacccatccagttgactcgctggtgttggatctatcagaagcccgcctccagacaga

SEQ ID NO: 674600 - DNA, 374 bp, Homo sapiens
  misc_feature (7)..(7): n is a, c, g, or t
  misc_feature (119)..(119): n is a, c, g, or t
  misc_feature (215)..(215): n is a, c, g, or t
ccccatnctcctgattcctggcatccttttccctcttgcccttcaaaatgcccctgtggactggattcctttttaatttttgtttaccttatttatttgagacatagactcactgttcnccaaggctggagtacagtggcacccatcacagctcactgcagcctcatgtgatcctcccacattaacctcctcagtaactggggctataggttgtngccactgtgcgcatctttttgcatcttttgtggtgatggagttttgccatcttgcccagacgggtcttgaactcttgagctcaagcaatcctcctgcctcggcctcccaaagtgctgggataccaacgtgagccaccatgcccagcctagccccggatt

SEQ ID NO: 674601 - DNA, 118 bp, Homo sapiens
ccagtcacatgattgacaagaacatttaatcaggataaaggcatgtcctgctattagagcccttctcccctcaaaaacagtcaactgtttcaaatatgtagtaagaaagactaaaaac

SEQ ID NO: 674602 - DNA, 440 bp, Homo sapiens
tataagtagggaggtgatattgcatggtcgaggagccataagacacgtgtatgagattgatatggatagtgtcgtgtggaagaggcgagagtaggtcgactgttatgaggcaggtaatggcggaggacggatgggacatgagaaagtgaatgttgagtgtgagcatgcgtcgccggtgactgagtgcgatcggaactatatgaggagtgagagagaatgagaaagacgtggacatggataatgatgagtgaaagtgtagggagagatcgatagagggagcagagatgggactgttaggttgtgtcagtgtgccccgagcgagatggatgattccgagtggagccggtgagtgaggcggatgcacggacgcggtgtgcacaagagaggatgagcggtgagttggacttgatcaatgtgcagcctatctaggagcgactcga

SEQ ID NO: 674603 - DNA, 933 bp, Homo sapiens
gtacaatccctatgacgcattattgtctcgtgctccttctgcctataacgaagagagctaaaatcgcccatggttactcttcaatcagaccgtatagcccgcggcaataagagtgatactaaaccgtaactccccggatgctccctccgtgcgcgatcattgtgccagtaacccgcccactgaggggtgatcattgcttgctattactattcgtgtcctagatccaatcatttgttacgaaaagaacctacagtagtccgcagtcactctatcactccgtctccacagggtcattactaacctacgtactcgccgtctacatagtcgttatcgattgacataacatagacatatgcatcaggtgaagcatcagtctaacccctatggtatttaagcttattgagagaacttctagtgttgcatgaaatcacgttctcgctgatcaaatatgactctcgctacttagcaggactcaacatattagtcactagccctaatatttgcgctctatcactatttaacttaattacgatgggggtcatcacccagcacattgtctgttaaaatcctgattgcacaacgagaaaaaaaccctcatgttcatggactatcccccattctcctcttgtttcctctaaccccgacattagttaggcgggtgtactctgaaacagtttcctaaatgtatacttggaatgggggcggccgccgattcgaaaaagttggaacctgtcgtttggggcggcaccagcactaaaataaggggaacttttgccggaacgcgttctacgggggggctcaaacacaatacgcggggggcgcggcaagacaaccaagagctgggcgccggctatacaaggtcacgcttggcgcgccggcgtgaggaaagaataaagcgggggggcaacggggggcgacaaggggttcaacgac

SEQ ID NO: 674604 - DNA, 114 bp, Homo sapiens
  misc_feature (36)..(36): n is a, c, g, or t
  misc_feature (94)..(94): n is a, c, g, or t
  misc_feature (104)..(104): n is a, c, g, or t
tgatcaaacgtgtacaaaacagaacaaaaggcgggnttccccacctcaaggaatctttttaatttaattttttttgagaaaggggggggggaangaatgggganggggttcccc

SEQ ID NO: 674605 - DNA, 166 bp, Homo sapiens
gtgaataaagctatagcttgactaaaagggttctgtaactatcgtgaggtcttcaggcatccactatgggtctaggactgtatctcttacagatgaggggagactactgtattatcagttccaggttccataaaatctttactattgcgcattgcggataggccat

SEQ ID NO: 674606 - DNA, 413 bp, Homo sapiens
cttggtggtgggcacttgtggtcccggctgcttaggaggctgaggcaggagaatcgcttggacccggcaggtggcggttgcaggctcccgccaccgggcctagctaatgtttgtattttcaatagagacagtgtttcaccatgttggccaggctcgtcccaaagtcccggcctcaagtgatgcgcccgcctcagcctcccaaagtgttgggattacaggcgtgagccatcgtgctcggcaaggtaatgttaatttcatggcgtggatctgtggctaatacggttatctctatctttgccgatcttgctcctgcctagcttaggatcagagctgcagatgctcgctcaaggccactgtgctacatcttgtagcttatgcaggcctagtagcatgtgggtctctatccctcgccg

SEQ ID NO: 674607 - DNA, 104 bp, Homo sapiens
  misc_feature (20)..(20): n is a, c, g, or t
  misc_feature (71)..(71): n is a, c, g, or t
aggggaagaagcaggctgangttaacagcctggggctctgtccctcaccccaaggagagggagttttccanaccccaggccaccaagcggggccagccccagcc

SEQ ID NO: 674608 - DNA, 161 bp, Homo sapiens
  misc_feature (77)..(77): n is a, c, g, or t
  misc_feature (119)..(119): n is a, c, g, or t
  misc_feature (143)..(143): n is a, c, g, or t
tgcatgatagaatcgagctcggtaccgatgagtaatctggcttctttataaactgtttaggtcactctgtggaaaangagtggctacaagccaagatggtgctttttagaagagccctngatgggcaggccgtcaggttcctngtgtgccagtcaggtgag

SEQ ID NO: 674609 - DNA, 1112 bp, Homo sapiens
ggaggtggagctagcaagtgagccgagatagtgccattgcacaccagactgggtggacaggagcgagactccggtctctaaagaaagagagataaagattgtggctgtgtcgaagaccagccaaggaagcctcaaaaaattggtgccatatggccgtagcgctgggtttgaagagaatgctccaggagattagcctgccaaggtcaagtgccgagcatgaaagggcagtgttcaagcgcaagaactccaaggagagacctagatcaagcggtggttgaggtatcgagtctcccagaataaagatagatgacaccacgcgggtgtgagcacactcaaagagagactgtctcacggtgtcaattctgtgggacgcattatgcaaagacaccttttcggtcaaattgtcgggggtcttaaccggtatctattgtgaagcatgctctcatgtgggggttcacaagaaattcgcagtagatagcaatgacgaggctacacagtcggtgagcagaaatactgccatagggttaggcccggggggcaaatagagcatatatgtggtgttggtgcaaacttcatagaagaaaattaggtgcgacaagaaagtgcaaacgcggataaggtaatcgcgaggggaaatttgtttccagatatacgaggaggaaaatgtgttgtaaagaagaattgctgcgcgcttgtatgaggcccgaggttggaaaacagatgaggaagtctgcctgtgggcaaatgttgtccccttcgggaaatgtattatgcccaaaggaaaaagttcggcggagcccgtggggtatagaaaaagtatcacgcagtcaggggtgggtatcttccgcggaagaaaaaaacctccgtatgaacggtggacgaattggcagagaactagacattgtggagatgaatttcctgagaaatatcgaaggcatgtgaaccatgttgtgtgaaacagaaagagtgagttgaaacatggggtagttggagaacgtgggttgaaacagcgattattgattcattcacaagtgtacatggggggttaaaaatttttctcccaacacaatgaaagggggactttggagagtgggaaatagagggggatcaga

SEQ ID NO: 674610 - DNA, 111 bp, Homo sapiens
gatcacccaatcactgcaaaaaagtgtgaccccccccttttgactgttctgagagtaggcagagtggatccagcatgatgatgtctgcctcgtcgacctgttccaggtact

SEQ ID NO: 674611 - DNA, 162 bp, Homo sapiens
gttcatatttctacaccaaaacaaaaaaaaacaaaaaaaacaagcaagctggtgtagtggctcatgtcgtgttatcccagcaccttggaaagctgaagcaggaggatcctttaaacccaggagttcacgactagcctgggcaacatagggactttgtctcat

SEQ ID NO: 674612 - DNA, 480 bp, Homo sapiens
cggtgcagtgaggccgggcagtgtgtgcggagtggaccgacggacgcacgtggcggtgtcgtgcggggggccatggagcgcggcctggggcccgggggcgctgggccggggtgggcttcccactggcacgacatggagacctgtggttgcgatggctccctggtggctctggcttggaccgcgatgggtgctgggccctggcctcctaactgtgggctgcgtgtctggtggctggtagctggtggtgggcgctctcccccctgcccgcgactcggagccacccacattcccttccccttgcactggtgcaccaggtgccagggtgcgggagctaatgatagcggcgagggagccaccagggctgggatggccacgagaacttgggggcaggcagacccgagccaatgaagtgaggcctgtcgtgttgaggtgagcatctggtggacgtcttcatgactgaccgccacataaccgagagcg

SEQ ID NO: 674613 - DNA, 203 bp, Homo sapiens
tgagcgatgggtggggggtggctctgatggtggcagcagtgcctgttggttcgcccgatgggtctccatggttccagcaccagcagggcaggtggcacggccagggctccagtgcagcccaggcagctgcgcctccagcactatgcagccacacccattggtgcattttggggtttgttctgcgcactcatttcacacattca

SEQ ID NO: 674614 - DNA, 202 bp, Homo sapiens
ggggtttttggggggggccccccctttttttccggggggaaaaaggggggccccccggggatttttcccccccgcccccaaatttttcgcttcccccccggggggcaaggttttttttttctcccccccccccccgggggccaattttaattgttttttcccggggttttgggccccgggtttttttttttttttcccccca

SEQ ID NO: 674615 - DNA, 606 bp, Homo sapiens
gaggggtggggtagctgcctgtgcctggtgagggcgcgggtcactgtcttcacagaagaagttgctgatttgtgattgagagctactgttccattgtgaggtggcctggagaatcgcccagctgtggcagtggcttccattcagaagaagagaggccttttctagcccataatgggtgcaggctgatgggctgggccctgtggccctggtgcttgtagcacaggtttggggacttggcggtgtgcccgaagaccatgcggggacgacagactatcacgtcgaggaagactgagatgacttttgcatccgattggtagtgaggtgcgaagccacattgggaggggatgggctttacttgatgcaaactcatctctgcagatgggactaactgggtggtgctggatggcttttagtaactggtataggggacgagtgggcagcccccagaggtagcagcgcaagtcatggccattgaggcataccctttaacaattgttccccgcttactcaccggtgcatcacaggtggtcgcccagtcccttgccctgtgctcttttgatgctgggctcttgtcgtgtaatggtctcatctcgggtggtcgtcctg

SEQ ID NO: 674616 - DNA, 585 bp, Homo sapiens
tggaaacaaatgtctgaaaatcagagactagtgaaattaacccatagtgcagccactttcagatgtggccattaaaatgatgtgtggcagggcattcaaaaacataccaaaatatttatgcaaaaatttccattcagtgaaaaaaaaagcagagtctaaaacaatgcatcttatttttgcaaaacaaaaatataactgaacacacacatgcacacacatatacatgcagatacaaataagcagagaaaaaaaaaaccctcaaaattatcactaaaatgctaacaatacttatttctgggtggtgagaatgcaggtaatttttatactattctttttcctaagccgatgccctcaattttttatacctaacctagcttaacagtaaaactctatttttatccaagaaggacgcttctttacattcctattttttcattttaaaagggaggtgacttattaataacctcttttttttaaattttaccttccaccctaagaaacttggtttaaggaaaaagggtgggggaaaagggcttcccttaggggggaatttaggggaaagcctgaattcttggaaatttaatt

SEQ ID NO: 674617 - DNA, 427 bp, Homo sapiens
gatctagaggatcccggtctgttcctgcacttctttatggaattggttaccctttactaagcactctcttgcttatacgtcttgtactaatatttggaccccgtatagttaatactatcactcgaaatatttcttctcgcctagaagcaatcaaactccaaatggtgccataaactgaaccacacatggacaggccagccattcctccgaagacccttggatcaaccccagaaggagccctagctgctgtttcccattccacgccccttttcagcaggaagtagccagaaagagtcatcgcccaaaaccccctaacagttagtgtggcatctccacaggggataatgttataggaaaaggggtccttgggaagttttcgtggtttttgttttgttttgagacggaggctcgctctatcgcccagcct

SEQ ID NO: 674618 - DNA, 102 bp, Homo sapiens
ccattgactttcttctactagtggaaattaaggacattatcaagagacaccaggaacagtcactgaggataagaacaatgcctcccatgttgtgtatcctgt

SEQ ID NO: 674619 - DNA, 324 bp, Homo sapiens
tggtaccgttatctagtcgtagacgtaagtcaggcaagctcctggtgctctgttcactcacgtaattttcacatcaggaaaactctgggctgggtgcagtggctcacacctgtaatcctagcactttgggaaaccaaggtgggtggatgcctagctcagtgacaccagcctgggccacatggcaaaaccccgtctgtgccaaaaatgcaaaaaattagctgggtgtggtgttgacgtttgcggtcccagctactctggaggctgaggtgggaggattgcttgagtctgggaggcggaagttgcagtaagccgagatcatgccac

SEQ ID NO: 674620 - DNA, 359 bp, Homo sapiens
tgaggatccgttattgctccataggtgttcatacggttatggggctgtgccatcggcaaagccaggcagcgtgcaaagacggaaatagagaagcttcagatgaaagaaatgacctgccgtgatatcgttaaagaagttgccaaaataatttacatagtacatgacgaagttaaggatatagcttttgaactagaactcagccgggatggtgaattaactaatggaagacatgaaattgtaccaaaagatataagagaagaagcagagaaatatgctaaggaatctctgatgggagaaagatggccatcttctcccatcagctgttttgataaccaacaagaggtcaattatagaaatcc

SEQ ID NO: 674621 - DNA, 778 bp, Homo sapiens
gagtcctcagtcacgcccgtatctccccacaggcactgatcctgtacctatcatgcaagcatgaacagttggtgtgagtcctccgtacccgccttggtcctaactaatagctattgtgtccggcgttttgtcgtagaagttccttgcatttaccagtcttcatcaagacatctccagggagtgtcgctgtgggggcgatcgcgagtaggcctgtgtcgcattccttgaaagtgccgtgatccattgtgcacttgtggtaagcgtttcgaatccccagtttctacgtcctagagttacgcctgtttacagtactctaggctacaggtgttggcacgtcgtaggtgtctgcccgaaaaggccttttttcgcaatgtcgggaaagggtatagaagccggtccttaacacttacgctgaccaacggaaacaccgggtcgcacttagatagggccttgggaagctggacatattgggttgggtgttgtgccaccccaagggcagtaaggcaaggaaccatttcgtaaacgcaaaggccgggttattaccacgatagagcaatgcctattactttacaagaaaccgcgcctgggtactctgatgaatttaccctatatacgttcgaaggagtcaatgggggaaaatgcacatatgtgggtcttttgcatttggatgttcccctacaatgttttccaacttcacaggggacacttttggcggcctattgccacccaaatattttgtggtggctacttgagagattgctctccagaggcgcaggac

SEQ ID NO: 674622 - DNA, 433 bp, Homo sapiens
gccctgcattctcgtccgtcgactcctatgtgatcccctttgtatatcattggtgtcttcatccgcatgtgtgttcaccttttgtgataagtttatgactatagggtatggggcatgcatagaggtttaacggacggtgagtgggtgactcccactggacggaaatggttaagatcgtgtgtgggtgaaacgtggcgatgggaactggccttgtagatcatagtaacttgatctgtgagaagattcccatgaagggacaagggataggcaggtcattgagacaaggaccattagttcggtattcccgtaagaggtgggaaggtatggtgattaataggcgaagagaggcggtggagggaatatagctcttcttctgatgtgatacaaaaatgacaggaattagagaagagttccaaaaatgaatgctaatata

SEQ ID NO: 674623 - DNA, 205 bp, Homo sapiens
cagctggggacggcacaagctgggacaacatatggacggcactctccccggaactctacagaacatatgttggtcaccgaagacccgtacgttctaagcctccctggttcttatgaagttcgaagcagcatacccccggattccgggtacgagccaacgtcatgacacgcgtcctatggaaagaagactgtcctcacacagctcg

SEQ ID NO: 674624 - DNA, 786 bp, Homo sapiens
ttggggtcccggttgcctggattttgtcgtaatccataggccctgtcttgaagtgcctggccctcgaaccttgcacctgcttttggtgggacagcagactggagcttgctgctgttatcaatggccgaagtcgtccgtatgtctcgtgcggctcgaagtccctcgcttggtcgagctcggctcgacccactactcgactgggacctgaggtcttcaggtgtgtaactggagcacattgcctctgtacggccctgatgccattcctcagataacgttcgcagggtttcggtgatacccccaccagccacttcctgaggacgccaatggaagttctcagggacgcagaaacgagcttctctcttgatgcctcacgcgggatgaatgcttcacccagcacccttggaacaatcatgcagaagatggccatgtcaccgaggtccactctcctgctccctgagggtgggtctcccgggaatgaacaggaatggagcttcagactgagacagaacctgtgggcagctgcagtccccccagaatgggtcccatattataccagcaggacattcagagccagcgtgaaggtgaaaccgtcagccccctctgagtgatgctctacctcagtggtatagcctgccaagatgacgcaagctccggtctgatatacacaaacgactgcaggaagaccccaactacagtccccagcgcttccccaatgcccagcgggcctttgctgatgatcctaagctctttgctctatggccaaacactcatgaggggaccgtttcc

SEQ ID NO: 674625 - DNA, 277 bp, Homo sapiens
ggacacaatggtcccaaatcacttgatacaagccaaagcccttacaatgcctttacatcctgaccagccactggccctgggatcacccccttaggcattctagtgacctgggtctctgctgttccaggcatgcttcctagcactccccagccttcaatagggaatagccagatatccttgtaggttctgttttccaccccttcaggtggactctcatcatagccaccatcaccctccttaacctctacttctacctacgcctattttacaccaaccc

SEQ ID NO: 674626 - DNA, 562 bp, Homo sapiens
  misc_feature (379)..(379): n is a, c, g, or t
ctagaaatcacgaatactagtctccgtctcagtctatcatatctgtaaaatagtgacggcagaaccaagcaatgtccaaatctctcacagttaaatattaaactctgaggctgactgcagtctcattactattctcaccttcccaggacactgcctcatcaatcctcttgtctctctcacattttcagtctcagcacaagtccattgccctcttcatatatcacctgccaaacaaaatccttactctgaacctgccatttctttgcgctaccatctcctccatttaaccactatagctgtcaccaaaacagatgacaaagcaaatatactcccaagagtaagcattgtgcctccaccctatgccccaggtactcctctncagtgtccatttactccttagccaatcacaatccattccattcccttcttgaaaaccaccagcacccatctgtcagtggctctgaggtactatccctggtctccccaaccctctggtagaaaaccactatctcccactgcaagaaagggatagtgtaacaaagacaaagagggcggcttctat

SEQ ID NO: 674627 - DNA, 298 bp, Homo sapiens
  misc_feature (25)..(25): n is a, c, g, or t
  misc_feature (60)..(60): n is a, c, g, or t
  misc_feature (114)..(114): n is a, c, g, or t
cccataaggggctcaggagctggancctggggttggaggctgcagtgagctctggttgcnccactgtactcctgtactcctcctgggtgacagaatgagacgcttctttaaaanaaaaaggggggaggtgatgggggaggggctgggagagtgtcagaaaaaatagctaatgcatgccaggcttaatacttaggcagtgggttgataggtgcagcaaaccaccatagcacacatttacctatgtaacaaacctgcgcatactgcacatgtacccgaaaacttacaataaaataaaatt

SEQ ID NO: 674628 - DNA, 734 bp, Homo sapiens
agggtacctgaagcgaatgggcaccaaagcagcagtgtatgccgcagttctagcttcaccttcacgatgttcccttgtcaaaagcgcactaaatcgtctccaagtcgaagcatcagcaaacaatggcaaggagagccaccagaaatgtacacctgattttcatgacaaataggtaatgctgtattagctagtggagccactttctgtatgtgtacatgacatatgttagcacaccagtcggaatagaatgaacctgtcccctgtggcagagttacccccaaaggatgtggggcaatcagtattcattcccagctgttgtaatactgattgggttcaaaaaacagctcatatttgatgcaaattaaagcactgtggacccactaaggatatggcatcactggacgaaacttacctgctacctttgaaaccaaaaaaaaaaaaaaaaaaaaaaaaaaaaaatgtttgtggggccgcccgtcgcccagaaaaagtttaaaaaccacttctggttggcgcccgggccccgagatgtctagggaccctcgcccaaagggtgtccgaaagaacaccgcgccaatgaacacgcgggggttcccaaaaaaaaacgcgggggcaacgagggcgttgacacccgaaaggagcggggcaaaggcctaacaagggccaacgcctactagcgccgcggtgaggtggaaacaacgcgaagacacaagaagacaaagcaaaacaacacg

SEQ ID NO: 674629 - DNA, 558 bp, Homo sapiens
ggcctgacaacagcaaacattgcaaaaacactgtttccaaagtgtgttcaagatctccttagccacagaattgtcatctagacactttgtaaccacatggcctcttaaatgggggtcatcagaatgtttgtcctgatcactttagtgtgggaacaaatccaaagagatgcctggaagactcagaagactttggagtaaacaaagctataactcaaggtgagcccgcttttcgggtgggaaaagcacccctaatatacccttctgcaatatggtttctgtataaggctgagcgcgcccttgagattaaaccctcccttcaggtggtatattcgccaggtggattgttcaggcaccgaggaaatttctcctggcctgactctgccaaaaatgggcttacccaaagggaatgttaggggaatactaatggccccagtgtataaaggctatgtgcatctttttgagcacccatgtttacccgccgtgaattaagttttttaatttggcgtacctgttttaaaaatatccattaaaaaaaatctcaaaatgttgcaagaaaaa

SEQ ID NO: 674630 - DNA, 994 bp, Homo sapiens
  misc_feature (7)..(7): n is a, c, g, or t
  misc_feature (98)..(99): n is a, c, g, or t
  misc_feature (106)..(106): n is a, c, g, or t
  misc_feature (109)..(109): n is a, c, g, or t
  misc_feature (116)..(116): n is a, c, g, or t
  misc_feature (121)..(121): n is a, c, g, or t
  misc_feature (140)..(140): n is a, c, g, or t
  misc_feature (146)..(146): n is a, c, g, or t
  misc_feature (149)..(149): n is a, c, g, or t
  misc_feature (153)..(153): n is a, c, g, or t
  misc_feature (157)..(157): n is a, c, g, or t
  misc_feature (172)..(172): n is a, c, g, or t
  misc_feature (177)..(177): n is a, c, g, or t
  misc_feature (184)..(184): n is a, c, g, or t
  misc_feature (189)..(189): n is a, c, g, or t
  misc_feature (193)..(193): n is a, c, g, or t
  misc_feature (197)..(197): n is a, c, g, or t
  misc_feature (214)..(214): n is a, c, g, or t
  misc_feature (219)..(219): n is a, c, g, or t
  misc_feature (231)..(231): n is a, c, g, or t
  misc_feature (247)..(247): n is a, c, g, or t
  misc_feature (253)..(253): n is a, c, g, or t
  misc_feature (258)..(258): n is a, c, g, or t
  misc_feature (282)..(282): n is a, c, g, or t
  misc_feature (295)..(295): n is a, c, g, or t
  misc_feature (305)..(305): n is a, c, g, or t
  misc_feature (307)..(307): n is a, c, g, or t
  misc_feature (313)..(313): n is a, c, g, or t
  misc_feature (315)..(315): n is a, c, g, or t
  misc_feature (323)..(323): n is a, c, g, or t
  misc_feature (326)..(326): n is a, c, g, or t
  misc_feature (331)..(331): n is a, c, g, or t
  misc_feature (342)..(342): n is a, c, g, or t
  misc_feature (352)..(352): n is a, c, g, or t
  misc_feature (372)..(373): n is a, c, g, or t
  misc_feature (379)..(379): n is a, c, g, or t
  misc_feature (398)..(398): n is a, c, g, or t
  misc_feature (413)..(413): n is a, c, g, or t
  misc_feature (417)..(418): n is a, c, g, or t
  misc_feature (423)..(423): n is a, c, g, or t
  misc_feature (433)..(433): n is a, c, g, or t
  misc_feature (453)..(453): n is a, c, g, or t
  misc_feature (479)..(479): n is a, c, g, or t
  misc_feature (485)..(485): n is a, c, g, or t
  misc_feature (496)..(496): n is a, c, g, or t
  misc_feature (508)..(508): n is a, c, g, or t
  misc_feature (520)..(520): n is a, c, g, or t
  misc_feature (523)..(523): n is a, c, g, or t
  misc_feature (557)..(557): n is a, c, g, or t
  misc_feature (636)..(636): n is a, c, g, or t
  misc_feature (714)..(714): n is a, c, g, or t
  misc_feature (737)..(737): n is a, c, g, or t
  misc_feature (800)..(800): n is a, c, g, or t
  misc_feature (812)..(812): n is a, c, g, or t
  misc_feature (838)..(838): n is a, c, g, or t
  misc_feature (845)..(846): n is a, c, g, or t
  misc_feature (850)..(850): n is a, c, g, or t
  misc_feature (864)..(864): n is a, c, g, or t
  misc_feature (867)..(867): n is a, c, g, or t
  misc_feature (875)..(875): n is a, c, g, or t
  misc_feature (881)..(881): n is a, c, g, or t
  misc_feature (899)..(900): n is a, c, g, or t
  misc_feature (905)..(905): n is a, c, g, or t
  misc_feature (908)..(908): n is a, c, g, or t
  misc_feature (921)..(921): n is a, c, g, or t
  misc_feature (924)..(924): n is a, c, g, or t
  misc_feature (927)..(927): n is a, c, g, or t
  misc_feature (931)..(931): n is a, c, g, or t
  misc_feature (956)..(956): n is a, c, g, or t
gaaggcntggaaaacgctgcccagctcccagaggggtaggggcccactcgccggccagcagcccctgtgtggcctcgaggccttcctgctccagaacnnaaaaaanaanaaaaaanaacancagcccccgatcctaaacnctctanatnagcnccanggctgcctggagtanacggnaaagggnatgcngacnaacnacctaagatatggaatnggggnagggatccgaanagggtctagtgcaacnaaaagnggggnaaaacaccaaagggggcctgggcnacccccaccccanaaaataaaangnttaaananaaaactgnatnggtcnggcgtagcggnaaaaaaatanacgcagggctacgtggaaanntagggnaggaaaaaaaccatacagnccgtagtgcaaaacntccnnagtanataaaaaaanaactatacttatatctaagnatgcccataaacacctctacagtaanaccccntaccgtacaanaaaacacccgcnctacctgaaaanggncatagagcaacatccatacaacacaggctgcagngtcagggagaagatctgagcaaagtcaaaggcaccctgcccatcccaccagcccttggcctgggcatgagtccgcagcnccgggtgttgggccgagatgtccgtgccaatgctcagctggttggagatgttgcgggccccctcctggatcctctgtncagcccagagcctcccagctgtntccagcacccacgcctcagtgcggtcagccagcaggaaggtgctatggtaggagaatggcgcnatccctccaggnagttgccccctgcccatagtgctcantaacctnnaacnaatgcaaggctccnggnagactgcncgttcnaagcacctgagtggtcannccacnggnttcccctcccacnggnctngtcnaaagctcgtgcaatcagaacatgcnttggccatttaccccaaacaaaaggcggtaaataagct

SEQ ID NO: 674631 - DNA, 327 bp, Homo sapiens
  misc_feature (322)..(322): n is a, c, g, or t
  misc_feature (324)..(324): n is a, c, g, or t
  misc_feature (327)..(327): n is a, c, g, or t
aaaaatcccttactgtctctccctttctgaccccttaaatatgacctgtttgccccaatggttgtatttaggtaagatttgtagactctgtttttccttttgacacagctgcaaggcccaacagctgtgcaaagcccacaagttatgcctaagtcagcagttatgcctatagattacatgacctgtgactgtatcattaactgcttttgttttgcttctgtaagtttgcctataaaaaccacactcagtctttgttcaatggtcagcttttcagatacaaatccactgagccggtgtacatctaaataaatcctcctgttancnagn

SEQ ID NO: 674632 - DNA, 137 bp, Homo sapiens
agccgggagcagccaggaaatagaaacgggctgaacgatcggcccgccatcatcctgagtcctcatcgccctcccataccctgacgcatccttggacataagcagacgagggcgaacgatccctcgccttaccgatc

SEQ ID NO: 674633 - DNA, 411 bp, Homo sapiens
ctagagtatcccctgcgggaccctgatcttacatcttatacaaagaattaagcgtcaacgaatggtattaagagatttaaacataagaccgtaaacagcataaaaaccctaggaataaaaccttaggcattaccattcaggacataggcatgggcaaggacttcatgattaaaacaccaaaagcaatggcaacaaaagccaaaattgactaatgggatctgattcagactaacgagcttctgtactgcacaagacactatcatcagagtgaacaggctacctacagaatggaagacaatttttgcaatctatccatcttacaatgagctaatatccagaatttaaaggaacttaaacaaatttacaatgtgtatacatttaattagccccttcaaaaagtgggctaaggag

SEQ ID NO: 674634 - DNA, 735 bp, Homo sapiens
tcacaggggggttgcttggaccttttttggaaaaaaacaaaaaataatgtgtttcaaaaaaacacacaggtgtggcgggggaggcacagccagtgtggcggcagccaggggtgtgggcatccgggactagaggcttcactggggcggccagctctcatgcggatttggcagcttcgtgggccccacaagtcggggcccgccaacctcgaaggtgacggggagtgggtagactcctcgtgggacgtgcggtggcatacctgggccctgtgggggcctccacggctcaggtggtgccctcagggaacagggaggagagaaactgtgggttggggctcacaccacgcggggggcccacgcggtgtttattcgccggcggtgaagagcccaccgggagaaatgatagcccaagtgcacgataccgagcgcgacaccccagcgagagcactggccccaatgggcgggggcacaggagggaaaacctcagaacgtggcgggagagaagggagaacctgcaccatttccgcgcgccccacagacacaagggcccacagaaggcgccccccacactcagcacaacggcgccagacaggcggaaacaccaaacgagagcaacgacaaccggcgggctcacatcaggcacctcggggcacacaaccagaggcacgacatcaacaggagaacaaccaaactgaatatgagagcgcagcccggccaccaacaatcttgaacgccatc

SEQ ID NO: 674635 - DNA, 210 bp, Homo sapiens
tccgcgttaaaatctgctgggatactggtatgatggtggatgtgggaggatccagctcctcaatgtgtctgggttgtgggagttggagaacctggtgactcagcggtcgatacagtgggcgattgggacaaggaagacgatgtggtttccagggaggcccagagattgggagaagcggataacgttccccttaaataccggaagtcagct

SEQ ID NO: 674636 - DNA, 363 bp, Homo sapiens
  misc_feature (44)..(44): n is a, c, g, or t
cgtcgacatgtcaaaaccatttgaacatataaaaaatatggaanacttaattaaagaggaaacagattggttggcacaacatacaaatgaatatgaaaccaaaacttatcaagagcatatggaacgttatgaatcattaacaaaccggtttgaacaacttgaaggttatcagtatgaaagtaaaataaaaacagttcttcacgggcttaattttactgaaagtgattttaataaacccattaatgattttagtggtggtcaaaaaacacgactttctcttgctcaaatgttattgaatgaacccgacttactattgctagatgagccaacaaaccacttagatctagagactactgtcgacgc

SEQ ID NO: 674637 - DNA, 458 bp, Homo sapiens
  misc_feature (250)..(250): n is a, c, g, or t
cccccttggatccgacatctcctggagtataatggcgaggccaaccaggggagcccccttccaaaaatctaaaggggtctaaaaaacccgccgatggcccaggcccccttgatggtctttccgggggtttgggaggctggtcctcccctccagaaacctccccaaaccccaccaagggttagggccagaagggtggtttccgcttccaagccccttaaaaaggggggtaaagagagggtttccccaaacnccccaagggaactttccagcccaaaaatggcttaaaaaaaaccaggttaggggtttggggtttgccaggaaaattttcccccggggggggggggccttttaaaaaccaaagggtttgggccccaaaaaccaatggtttggggggtttttaaaaagggttttggtggggtttttgacccccctaaaaatggggtggttttttttttcca

SEQ ID NO: 674638 - DNA, 931 bp, Homo sapiens
  misc_feature (910)..(910): n is a, c, g, or t
gagtttcactcttgttgcccaggcggagtgcaatggaacaaccttggctcacggcaacttcagccttcccaggttcaagcaattctcctgcctcaggctcctgggtggctgggactacaggcgcgtgccaccacgccaggctaatttgtattttggtggggacattccatgtggtcaggctagtctcgaactcctgacctcaggtgatcctcctgcctcggccttcaggggtgctgggattacaggcatcagccactgcacttggcagatcttcattcttttagtaaaaagtataaagccacacatggtttatttgaaatattttataatttaaaaaagtacagaagcaggaaaaccaattctaggttcaagtgagggatgatggtagtttgaaccaaaggattgcatgtggtaagaaattgtgatttaagatatattttaaagttggaagtagcaggatattctgatggagtttgactttggtttgggcccactgagtttgagatgcctttgagaaatgaaagaagtagagagagaattaaaaactggcaggagtggtggctcacgcctgtggtcccagcactttggggggctgaggtgggtggatcacctgagaccagcttgggcaacatggtggagccctgtctctacagaagatacagaaattggtgggcattgtggcacacacctgtagtctcgtctactcacggggctgagatggggattcattgagcccatgagttcaagcctgcagtgagtcgtgatttgccactgcatcctgctgggtgacgaagagaccctgtgtcaaaaaagaatctgaaaacaacggaaccatgccttcagaattctataaagttattttcaactgataaatctatattcaggcaaagaatcaagggtgaaggtaaanaatacatttttagacaagcaa

SEQ ID NO: 674639 - DNA, 948 bp, Homo sapiens
  misc_feature (927)..(927): n is a, c, g, or t
  misc_feature (934)..(934): n is a, c, g, or t
ttgccttacgaattaatgttttacttgtttaatgttgatagaagtgttggggaatgtatgatgtaatgaatgttttattatattttgttatggtttatggttattttgtattgtatatttttatttttgtgggtatttttgagttctatggtattgggccaatacgggcatgctgctagattaattagtaattatccagtgctggtccccggtttgctcttggcctgtcgtggttttcttggcttgcctttttggtcttgtgtattcgttcttctttattggccgcctgtgactctattcaccctccacttcccgtctcagatatctaaacgtggtctaccttcgatgtacgatgatgcctcgcccgctctcacccgtgggcagtgccacccgctagatgacacgcgctttccaccatccaaccctatacctatgagaatttgcaacaggggaggttataaagaacccgatacttccaaggccctgctttttttcttgaaagtactttaaaaaggaaatttgtttgtattttttatttacattttatatttttgtacatattgttagggtcagccattgtttaatgatctcggatgaccaaaccagccttcggagcgttctctgtcctacttctgactttaccttgtggtgtgaccatgttcattataatctcaaatggagataaaaaaatccttgtaaaaaaagcataaatgacaacagaagaaacaatcttattcgcgagcattccagtaacttttttgtgtatgtacttagctgtactataagtagttggtttgtatgagatgggtaaaaaggccaaagataaaaggtttcttttttttccttttatggtcaaatgaagttgctgtttatttctcttttggcctgttgtgatatattgtgtgcaacacatgctagtaccacacngatacancaggaatatactga

SEQ ID NO: 674640 - DNA, 911 bp, Homo sapiens
gatgttgccagaattcactcaagtttgaataaagatgaacagtatttagtttacttgttgtccatgaattatatcagtattctagagaacatcgcttcagaaagagaagccgtgtttattctctgcaggcttcctgtccttttgtggtatggttgtattgggcttattttcactgggttcctccttactgccaaagcttctgaggcgtgatttcattcattgaagaatcaatagatattttgtttcaaaatgtgttgaaactaaaagagatagatggtagactttgtattaaaagcagtatatggatgtggaaatgcacatatattaagtgcagtctatcccttttcaggtgggatgagagcgaacagttgattttaataagttgccatccttagtacacatgagaatatacttttcctcaagtaatatacctgtttgaagctttaagagagatgttttgggtaagctatttcattttcgccaaagaagtttgctattcttgtgttcatggtgtataccatgattgttgtttgcctggaggtatagtgagtgtagtaagatgggggtaagttctatgtgaggggcaagtgttttctgagttgacgcttgttttacgactggattttattggcctgtgcttatccttgagtacccgtaatttttgtaaactatctaggtttcttcgacctggtattgtaaagtgttaccttccgggatgagaagggtggccgattaccaggggttccggctaaaacactgtcaaccactggtcccagaacggggcaaaattctcacgtgcggccccttagtcgacattccggtgggaccactgtcagcacttattacctcgaaaccggaatctgtgccaaaacaccgcctaaaagccatctataattaccagcgaatcacgg

SEQ ID NO: 674641 - DNA, 487 bp, Homo sapiens
  misc_feature (14)..(14): n is a, c, g, or t
aaatggaaaaaganaatgaggtaagtatatacaatggaatactaattgaccaaagaagaatgaaatcatgtcctttgcagcaacatgaatggagctggaggtcattattttaagccaggcacagaaagataattatcttatgttattatcatatgtgggagctataaaagttgatctcatggaggtagagagtagaaggatagataccaaaggctgtgaaaggtatgtctggagggtgaagagaggttggttagtgggtaaaaatacacagctagttagaataaataatttataatgtttgataagagttggttgactatatttaacaatataatgtatatttcaaaataaaaaagaggacttgaaatgttcctaactatagagatgataaattgagggtgatggataccctgacttgatcattacacattcgatgcatgtaaaaatcggcaatgtaccccataagtattatgtaacgatcaaaaaa

SEQ ID NO: 674642 - DNA, 293 bp, Homo sapiens
  misc_feature (53)..(53): n is a, c, g, or t
gggaccttgctgggcattatatgcctggtgggggtttcagagacccctgaaanaggagggaggacccgcctccttgtctgcacaactgcatgcacttctctccccatcgctccacaaccctgaaacccgagaaggaagttgctgaccagtgcccacccccggcaagccccgggaaggaaacacaaggcaagctcccttttccctttcaacggtggttcttgcagaagaagcaggggtgaagctgccaagctgccccttctccaccaagggtaccctgtcttggtggttagggg

SEQ ID NO: 674643 - DNA, 293 bp, Homo sapiens
  misc_feature (76)..(76): n is a, c, g, or t
  misc_feature (127)..(127): n is a, c, g, or t
  misc_feature (184)..(184): n is a, c, g, or t
  misc_feature (250)..(250): n is a, c, g, or t
  misc_feature (255)..(255): n is a, c, g, or t
gttttgtccgggtgctgtggttcatgcctgtagtcccagcacttcgggaagccaagacaggcggatcacttgaggncagttcaagaccagcctgggcaacatggtgaaatcctgtctctacaaaaantacaaaaaaagtaagccagatatggtggcatgcgcctgtagtcccagctgctcaggnggctgaggtgggaggatgggtttgagcctgggaggtggaggttgcagtgagccaagattttgcatntaccntccaacctgggtgacgagagcccttttttcaaaaataa

SEQ ID NO: 674644 - DNA, 105 bp, Homo sapiens
gctcgcgccccaggtgggcgcatgcgtcgactccactgacctggtagccggtatcgagcgggtacgtgacgccgacgaagccaccatgaagcgctggcacgagcg

SEQ ID NO: 674645 - DNA, 151 bp, Homo sapiens
ctctaagctcgcaggaggaggaaggaggcctgtctgccagtgctcccccaagccgcctcccgggtacctggccaggcacacggcacctcctctggtatcccagcctcacctgctgaccagcgtgcagatgcgcagctcaggaccatcgtgg

SEQ ID NO: 674646 - DNA, 268 bp, Homo sapiens
ccgccaagtgacaccaaagccctggttgactttgacagccccgtgggcgcgcgggaggccgggcactctagggtctacctaccagtgcaatcgtttagcgctttttcagtggggcagggcaggaagcaggcgggaccaggcagccagttctcaaaggctgcggggccaactagaggccacagcccctcacccctagacactgccaaccagaactgacacgcgacctcctgggcgctgacgccattaaaaccaacgttggcgcccggcg

SEQ ID NO: 674647 - DNA, 440 bp, Homo sapiens
ataataagagaataatcattgtcacagatttcagatccacagcctcatgagaataactgcacacagcaggctctggaagaaagctttacagagaacacgtgatgtttttaatcaagtggagaggagttggaagagtcaacacttgagttaaaaccttcatatgggcagggttttgtgggaccccaaccaccctctcagcaaaatccatgcaatcgggccaggcgcggtgactcacgcctgtaatcacagcactttgggaggccaagacggggatcatttgaggtcaggagttcaagaccagcctggacaacatggtgaaaccccggctctactaaaaatacaaaaattagccaggcatggtggcaggcacctgtaatcccagctactcgggaggctgaggcaggagaatcgcttgagcctgggaggcagaggttgcagtg

SEQ ID NO: 674648 - DNA, 135 bp, Homo sapiens
ttcacccaatgcaatggtacagagccaaacatgttaatgtggtgtttgagggcagggacaaactaaatctataaagatgggaacacattaatgagccttgagtgtcatgcttcactctaatgacaatgatggaag

SEQ ID NO: 674649 - DNA, 531 bp, Homo sapiens
gcgtatctcgtccaccgtagtctgaggtatctccattgtcccaccgttaccagagattcaccaactcagcaggacctcctcccccaggcttgaggtctgaggttcagaggaccacagaatactggccgtggtgtaacaatctggtaaaggcagtgcatttgacaggacaacaaggatatgaaaattcaggaccagggttctggacaggcttgggaactggtggaatactaggatatttgttcggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaacgttggagtcaaacactggatgcagaaatttcggatttttcatcactttctctttagaaaaaacgtactacctgttaacaattgggaaacgcg

SEQ ID NO: 674650 - DNA, 402 bp, Homo sapiens
  misc_feature (41)..(41): n is a, c, g, or t
  misc_feature (77)..(77): n is a, c, g, or t
  misc_feature (91)..(91): n is a, c, g, or t
tacgtatcaagtatgtgcatgcacggtagtccagtcactgngaggctaagggcacacaccaagctggctaagtttgngtctattgtagagnacaaatttccatgttgtctaggctggtctccaactcctgggctcaagttatctgcccaccttggcctcccaaagtgctgggattacaggtgtgagccactgcacccagccatggggtgcattcttaacctctctgtgcctcagtgcccttatctgtaagttggagataataatagtatccaccttacagggctattaggaggattacatgagttgttaggaggctttatacatgtacagcactcagaacagtgcctggccctaataagtgtatgtattaggctgttattgtgacacaggtgtttgcctgat

SEQ ID NO: 674651 - DNA, 233 bp, Homo sapiens
ccccagtcccctaatcccctggcctcctcccccttacttgttttaaataaaactgtttggaggatgttttttgcgctcccaggccggcatcgagtgtcatcaatttttaccccccgctcttttttttgcccaagggtgtgttgcttattccctacaaagtttatactgcatttggggcgggatctttttttgttttttgttttgtaaaaaataaatatctccgggggccgtta

SEQ ID NO: 674652 - DNA, 126 bp, Homo sapiens
cggggatcgcatactgctgtttacatggctggtttaatcaggcgcatccagttggaaccatgtccgtgtagtttaaataaaaaggaggaaaacacaaaaccaagtctgccatctctaccagatgaa

SEQ ID NO: 674653 - DNA, 175 bp, Homo sapiens
tcggacccgtttgcctgtagagtatagagctgcgcccttaaaaagcgcttcaagctgagccaggcgcgcaattgttttaatccgcgctttgacgcagcgtagcttccgatgtcgctgcctgatgcccccgttgcacgccggcagatggggccattgtcgctatggctctgcgcat

SEQ ID NO: 674654 - DNA, 127 bp, Homo sapiens
attctctacacggatccccccctcgaaacccagtcaggggttggtcacattttcgttgtcctagcccactcgtcgtttcacaccgattaacccaagctcattagaagtccggcggtaaagtagtgta

SEQ ID NO: 674655 - DNA, 142 bp, Homo sapiens
acggtggtgctgctcgccgtcgccgcgctgcgatgcgttgcagccattcctccccgtcaccgtctgtcctcgtcaccactggacgctctggtggccaaggggagacaccagcgacctggtggaattgctgcaactacagcgg

SEQ ID NO: 674656 - DNA, 818 bp, Homo sapiens
gcgggcagaagcacaggaactcagtgtcccaggtgccggaaggggggcgtttctgcacctacagcagctgtggtagagggctgctgaggggtcaagaggaggtgtagggtccctggtgcagatgaggtcaggatagcagactgcgaggggcagctgagtgtgctgggagaagtcggggagtgaaggcccagcagtgttttataaggccatgctcgccctagcccatgtaccttcagaacaggacgatgagagtggctgtggagaagcaagccctgcgagaaagtgtggggatgaacatgggctcacagaccagagtgccgggctgcacgggatctcagagctagggccagtggaggtgggagacaaggccatctgctatagggacagtgcattgcggaagggaggatgagacgaccaagggtaacgccacaacggtggcgaacttctggagtacccatgagcgtttgtggacctcaatttagagtaaatgtgggcatctcacctccagcacactgagctggcacaggtacaggcaggagaaggtggacaggtaggggtcagtagatgggagtgagcaggggggtaggagagtgttgaggatttctcatggactcccgagaggctgcccaggcagctcgatagagccgtggaggacctgttaaacttggcgagctggactaatcccgagcccggggttgacctggaacgcgacgggcagcatacatcacgtgcaagcctgaaagcaccgggaacccctactgcgcgcctcagcaaagtgggtagaaacaggcagcggttcgcccgagtgccgcgaacgg

SEQ ID NO: 674657 - DNA, 938 bp, Homo sapiens
tgaatgggcacacgttgtagtgccctctcctcttccgccgctgtggtcccccctgctgtggtctatcctccctttagcagacccttatgggctcgtatttttcaagcgcttcgtccgttaaaactttcgcccgcgtctcataatccaattccgggtgtcaccccgccggtaacttccgttaagtgcttgactaactgtgaaattttcgctggaccataacaggatctggccacaacgtggtgcatttgggaaatccgccccgcacccttgtatcagatccatgacccaaacattttgggcttcaagtacagcctcctcatatcttcttccccccaagcgtgcccctgggatcgtataaaaagggggaaccccccagacgaacttcccaatcttgacgcccccgcagaacgattattatttctatcgaatctccccctttatgactatttttgctctttctacataacgagcatatattccccttgctctgtgagcagtccgcaatactactacggtgggaacttgctcatggagcctcggcggctagaccaccttgtagtaagaagtcattttctagaaattccggcggaattgcaacgaccgaaataatatctcttctccgggtggggcacccaacccgcctttggaggtactccccctttggtcgaaaaatacaccccgtgccgaaccgattggaggcttctgagatgtaaaacgcgacgtatgacattttagacgcccgccccagttctttgtaccaacccccgcgagtcatctcccgcgcccgcttctattccaaagccgtgtatcaggattatatttggtccaaccagaaccagccatttcagggaaagcagaagacgctaatggggaacacgcagatgttccctcatcggacaaacaaacaaaaccccatagaaaagcaaaaaacaaaaaca

SEQ ID NO: 674658 - DNA, 112 bp, Homo sapiens
ccctgccacaatctcaccgttgcactgtgaccacactgatgaccttgactaccttctccaagcccacaggctgaagggatactattccttgtcttacttcatggaacaagcg

SEQ ID NO: 674659 - DNA, 258 bp, Homo sapiens
gctgggccagtgtgtaggattcattctccatgtgagagtttcctttcatcctgactagcacatccccaaggtactttccagaagcacaggaatatctctacttggatcaattctggtcataacaagaggatggcggcctcacgtgtgggaacttcccctactccctggatgtgtgtacctagcacacttccttctcccacccctttttccagttggattagtttttctgttctcttctgtcctgtctaaatgcaatca

SEQ ID NO: 674660 - DNA, 129 bp, Homo sapiens
atatacaatcgagccggtaccgcaatctattctagagtccatatcaacatagggttacgaactcgatgttggatcaggacatcccgatggtgcagccgctattaagggttcgtttgttcaacgattaaa

SEQ ID NO: 674661 - DNA, 847 bp, Homo sapiens
actggagaagggtgcatggatgcaccttgtgttgagagagaggcaaccctggagggccagttcaggtggtccccaggcataagctaggtctagagagttacacagaacaagtttgagctctttaacaagtggatgaagagcctcatttccccagcttccctgatttcttccagaatgtgggacagtgattatttagtgtgcgtctcccttgtacgtgtctagattgaatgtaaggagcgagttctctcgcgctctgcctcgtcgaaggaggacggtgcgaaggatccctggagatattagtgaggtgtcatcggagagtgggcagcagtaagcctggcggtctgaccagtatataggggcttagcaggatgcctgccagctgactctcgtatgggaggaggtgtagcgagtcgtgaagattgtcctatgacgcaagatgcttccatctaagtgtaggacctgtaggccacctagtcacgcaaggtcggggtggcaatatatggaggaccgtgggaagtgtgtgaagcggaggcgagatcacaattttcacgtggctttggacacgaagaaggagggctctggatctaacgcggggtggtcaactgttgatgaccacggtactaccttgggacatgttatttaaacatgaattcagtgattgtccttgagaatttcaccagtagtgggtgggtgactgttatgaaggctcttgacagataccactgaaaacatgaagcacgtgggaactagagaagagccccgagggttcctctctgagtgcaaagggtgcaagatggtcaagggctcctcacggggcgtgggacgtggtagccgtgaagcctgcttg

SEQ ID NO: 674662 - DNA, 887 bp, Homo sapiens
  misc_feature (878)..(878): n is a, c, g, or t
caaccccagagcacctcctctccctaccccctccctgaggaaataggaacctgtggcgatgttgaaatgtgtgtagcggatatactgaagggagaacttttatccacagaaagcaaaggaaaagagagaatcccttatcaagaagaccacacgatgtgaagtctagtctatcttccgaaggaagtccaggacaaacggtgatgctgaagatggcgcatgacatatgatgccccttttgctgggccttccaggacactatttcattagcctcagaatcgatatgaatagcagacgagtgaagccccctctgatggagcccagtttcctccaatggcagcactagaccttccttctggtactaaaggctgggtacctttgaaaagcgcagaaatcagatcacagctttcgtgggattcgaatggcagaaactggtggtgtagctctcagtgaacacacggaatctattatccatcggaatgtgcttagtgaccaatcctagcagagacagtgtgaacttgcgatagatggctacggggtcatactgaataactgctcttaggaaaaagcgtgggcagggaaaacttgctgctcggaagtctcgtgcgtcctgattaaacgtgtattttcagttgacaggagctcctcccaaagttgcttgataagtgggtacagcagctgaattgggttgcacgattggaggccacgtaacccgcggatgttgtgcggaggggaaatcttgcgggggggcccctcacagaggacctacagcgcccagaagtgatgtcacccccggaaacctccttataacagacgctcgtcccccgcgaacgttacccagcgcccgaggatagcgttcaccacaagaaagcgcaatactngagtcgtat

SEQ ID NO: 674663 - DNA, 756 bp, Homo sapiens
ttgtgcgacgcaagtctcagctcattgcgcttatctgggtccaccgtcgctatgctgccccccggatgtgaggatgtgcgaagtttcgttggtgtctgcgctcgctccctagctatggtgcccgtccccctccggaagcctgggtccccgtgggcggtcgcggccgtcttgcttcctcatgtgcctgtgcctgcggggagtggtaacggtgggcggcaacggtcgcttccgaacagatgccgtgtgtgccattggccaggccccacgatgaggtcttgtggaagtgtagggagcttggatatgtgccccggttggtgcctggctctgtcccgtcctctgagggatccccggcagccgggtcctcggagcggatcaggctgctcgggctcggaggtcgagacggcgcccccgtgggaatctgcagcccagggccttgtggcctgggcccaaggttgatttcggcccgaggcccccggtctcgtctacttatccgcagcgaacttgtccgcttggctcaggagccctccgggagtcattgactggaaccagagaagctggacacctttcccggtgcgaggaggtcccggctgcgacttggatcacccacgagttttgcctgaagtactgctctccggctttaacgcacaacaaacagcagtggcgttagggattgaaacgcggcgaaacgttgggcctactgactttcaaagggcagcttttcgtggttataatcgcacaatcaaaccaacaggggaa

SEQ ID NO: 674664 - DNA, 284 bp, Homo sapiens
ctggtggctcctcattctcttgttgcattggcatgtccccttgcagttctcttctcttttttttttttggagatgggagtttccactactggctggcccaggttggaagtgcagtggctcaatctcgggtcattggcaacctccgcctcccgggttcaagtgatcgtccggccttaggctcctggagtagctaggggattacaggtgcctaccaagctatgctcggctaaaattttttgggtattttacagtcaagcaagctgtggcggccgggagaagctgtg

SEQ ID NO: 674665 - DNA, 505 bp, Homo sapiens
catgtgcttattactattcatatatctttggtgatatgtctattcgagttcttttgctgattttttaaactgtgttgtttactttcttgatttatatattctttgcatgtggatttcaattagcccactaccatttattaaaaagactattcttggctgggcgtggtggctcacacctgtaatcccagctgctagggagactgaggcatgagaaaagcttgaacccaagaggcggaggctacactgagccgagatggtgccactgcactccagcctaggcaacacagcaagactctgtctcaaaaaaaaaattattcagcaataaaaatgaagtattgatatatgctacaacatggatatagctcaagaatcttatgctaagtaaaagaagttagatacaaaacaactactttttgtacaatgctattgatatgaaatgttcagaaaaggcatatttctagaggtagaaaacatgctcaacatagtcagccattgaaggtctctt

SEQ ID NO: 674666 - DNA, 293 bp, Homo sapiens
gagcatttgaatcattgtgagggtcccacattttaagctctgtctccacttcttgctgtcgccgctcaatggtttcccgtcttttcctctccatgcgctcctctcgggattcagcacgagctggaggaggttcatctcgagggtcctcaaactctcgaatgtacggcgctatgccacaataaggttgattgcggtgtttttcatgtggcagattctccaggggcggcaggtatggaatagggtcacggggggcaaagagggccagaagtgttggcagcaggaactggctcatc

SEQ ID NO: 674667 - DNA, 167 bp, Homo sapiens
  misc_feature (28)..(28): n is a, c, g, or t
  misc_feature (127)..(127): n is a, c, g, or t
atcataaattcccgtttggaggggcagngtggggcaaggccctgtcctccctttagctcagctgagaactgactaagatcggctttcacccgcggccgcaccgttagcactcagtgtgctggcgcanttaccaaaggtttgggtaactccacaggcagactgtcaga

SEQ ID NO: 674668 - DNA, 367 bp, Homo sapiens
actgacagtatcgacatgctaaggcacgcagggttgaatccagtgtcaagaggattacagagttctcatacattgctggtgggaatgtaaaatggtgccgctgttttggaaagcagtccagcagtttctcaacatgctcaccatagaattacacagtaaccctgagtaacatcccacttcaaggattgaaagagaattgaaagcatatgtctacacaaaaacgtgtacattaatgcccataggagcattattcatcatagccaaaaagtggaaacaacctaaatgcccatcgatggacaaatggataaacaaaatgtgatatatgcatatgatggaatattattcagccaaaacattcacgccgtca

SEQ ID NO: 674669 - DNA, 106 bp, Homo sapiens
agaaagcctacacatgagcagtgttctgtggtctcttggctggggggcacttttaaagtggcgagcctgagaagcctgtctttcccaaatgcaggcagatctgaga

SEQ ID NO: 674670 - DNA, 622 bp, Homo sapiens
  misc_feature (42)..(42): n is a, c, g, or t
  misc_feature (75)..(75): n is a, c, g, or t
  misc_feature (99)..(99): n is a, c, g, or t
  misc_feature (110)..(110): n is a, c, g, or t
  misc_feature (116)..(116): n is a, c, g, or t
  misc_feature (125)..(125): n is a, c, g, or t
  misc_feature (177)..(177): n is a, c, g, or t
  misc_feature (288)..(288): n is a, c, g, or t
  misc_feature (292)..(292): n is a, c, g, or t
  misc_feature (294)..(294): n is a, c, g, or t
  misc_feature (399)..(400): n is a, c, g, or t
  misc_feature (402)..(402): n is a, c, g, or t
  misc_feature (404)..(406): n is a, c, g, or t
  misc_feature (409)..(409): n is a, c, g, or t
  misc_feature (412)..(412): n is a, c, g, or t
  misc_feature (426)..(426): n is a, c, g, or t
  misc_feature (449)..(449): n is a, c, g, or t
  misc_feature (453)..(453): n is a, c, g, or t
  misc_feature (458)..(458): n is a, c, g, or t
  misc_feature (524)..(524): n is a, c, g, or t
  misc_feature (544)..(544): n is a, c, g, or t
  misc_feature (554)..(554): n is a, c, g, or t
  misc_feature (616)..(616): n is a, c, g, or t
cacatctccacagagccatggggagagaaagcaaattgggcnaagctttgcctactggtgaatctgagcaggatntgtggaggccaggcagcgggagtntgttgaggcanagctanagtgtgttntagaaatgtggggggctgagaggcagggccagctctagagcctgaaccacanccagggaaggaggagcaaggggagactccacacaggaggaggtcacagtgagtgggacaaacattggtgcaggacttccagaggcggaacaggatactgcagtgggcgcancttncnacctcatcctcacaggaaaaggctgaccagagcgttccccgggctttcccatggtcgcctcctcctcacgcacgttatcgtaactggcagaggaagtgtgataannanannnatnatnaagataagaaaatnaagatattgtgagtggaggaatnatcntgtantccagcagccaaagcgtcaagtgcaaaaatcagcattctctgcagtacatcaaccgcgacctgcgncattttttcaggctccacanttcttctcanatctgagtttttctgaaatcccctcaaaacaaacatttgaacaaaatcagaaagcatggccntggcga

SEQ ID NO: 674671 - DNA, 330 bp, Homo sapiens
ttttttgagatggagtttcactctagttacccaggctggagtgcagtggtgtgggcttggcttactgcaacctctgcctcctgggttcaagtgattctcctgcctcagccttccgagtagctgggatcacaggtgcacgccaccacgcctggctaatttttgtatttttagtagaaacaggatttcaccatgttggccaggctggtctccaactcctgacctcaggtgatcaacctgcctcggcctcccaaagtgctgggattacaggtgtgagccaccacgcccagccgtttctgcttattcttaagcaacccacacttttggtcgacg

SEQ ID NO: 674672 - DNA, 228 bp, Homo sapiens
gcgctaatcctctagaggtcgagcaggactccatcataaccgagtatttggaggtcagcactggtgctcacgtgtcgacggaacttgtacaggggaggcatgcaccgaattggtgaatacacgtcgaccaggctccatcttaacgatatttggaggtcagcaacggtgctccctgtgtcgacggaaacttgtccaggggaggcatgcaccgaagtgggtgaactacac

SEQ ID NO: 674673 - DNA, 344 bp, Homo sapiens
  misc_feature (60)..(60): n is a, c, g, or t
  misc_feature (225)..(225): n is a, c, g, or t
  misc_feature (230)..(230): n is a, c, g, or t
tctctaattaccaccgctacaggcgtcatctcacgtgtcgaggtgatctcgaacttttangctccggggatggggccgcatcggcctcccggagtgctgtgatgacacgcgtgggcacgacggagtttcactcttgtcgcccagggtggagtacgatggcggctctcggctcaccgcaccctccgcctcccaggttcaagtgattctcctgcctcagccttcccnaggancgggaatgacagagatgagccatcgggcccggctaatttttctatttttactacagatggggtttctccatcttggtcaggctggtcttcaacttccgaccgttggagaatctt

SEQ ID NO: 674674 - DNA, 303 bp, Homo sapiens
taccggtttccatatgatggtaatatgtttcttctaagaatatttatttttccttctaaatattgagataaaattcatgctttgaaatgttctattcagtggcttttagtatatttgctatgttgtgcaaccatcgacactatccatttctagaactttttcgtcatcccaaacagacgctctgtattcattaaaaaattacttcctaactgtctctccccctagtctttggttacctttggtataccgggttaactttgtgggggccctcgcgccggggtgaatttgggctcatttctaggg

SEQ ID NO: 674675 - DNA, 894 bp, Homo sapiens
cgggtctgtcccaaataatttctctggaggtcgcgtttggagagtttgttaaaggtgttgagagttttctgttgggaccttcaatgcggccccgcgcagggtctttatcgctgtcctcccgcctggcgtgcccttctgccatgctagatggggtaggtgcttcaccgttcttctccctccctagttcctgcgcggaccgtgtccctcccttagtagacccggggggttccttccgtgaccccccctaagcgagcccttggttcctgcgctggaggcctccttcagcgcctgtgtccccgccggtcttgtaaaagacgggtgttcccctcccccaacaggggcagacccctaatcgccccctttgatcgtggaaaattctctccccgacagtagctgtccccccaagggcattttccagaactaattttccacagtggacgaatagttttcttttaaaaaaacagtctttacaccacaattcgggttgccaaacatagcttctccggctaatgttccaactctgtcccaccacctgcaaagtcctgtcccgccctcctctctgctaatatagccagatatggatgtcttcccctcttccccgtttataacaacaattttcgccacgatgcttttcgcaccaaatatgttgcaccccccaaaacacctcctgttattgttttcacagcatgtggagactccacccccctatggttctcgttctgttatacatatcattactgggggaagatccgtttcatcatcacggaacataatgtgaggagccgtgccgtgccaaacacatcgagaattagctggtgggaaccccaaaaaaaaaaggcgaaaaaaacccctttttttaaaaaaccacaaaacaaaaaaaaccaaacataaaaa

SEQ ID NO: 674676 - DNA, 609 bp, Homo sapiens
  misc_feature (372)..(372): n is a, c, g, or t
  misc_feature (375)..(375): n is a, c, g, or t
  misc_feature (433)..(433): n is a, c, g, or t
gtacatggtgtgtgtgaatggtgtactgtgtgtgtactgtatgatgtgtgatgtgtgtggtgtgcacatatggtgtgtggtgtgtttggtgtgtgtggtatgtaatatgtggtatgcatgtgcttgtagtatgtgtgctgcatgtgtggtataaatgtgtgtgtgatatatatgtgtggtgtgtatgtgtagtgtgtatagtgtgtgcagtatgtgatgtgtgtgatatgtaatacatgatgttcatgtgtgtggtgtgtggtgtatacgtgtgcatggtgtgtatgtggtgtacgtaagtgtaagtaacatgtgtatagtatatgtgtgggagatgtatgtggtatatagtgtgtagtgtatgactgatgngtnctgtgtgtatgtgtgtgtacatgctgtatgtgtattacggtatgttgtatgacatggngtgtacatgtggtgtatacctgctcttttagctgatcttagctagctcgtctggtttacggcggtctaagctttggctctcctcgcgcagttatttctagtcaattcatacgcagaaaggtataggggatagtccctgtgctatagttatgcttgattataatttttctctttccc

SEQ ID NO: 674677 - DNA, 1622 bp, Homo sapiens
tggaggggcccagttggtttatatttaaaaaaccgtgagtgtgtccaaaaacatgtgggtgggtgtgcttcacacctttttccacgtgggaattgggtgcgtggagggtgaataggcagaattctcataccattttccctcagcaacaaaggttgaagtgcccctcaaactcaagaagagaccacaatatggtgagggacacgagggtgggcgcgagggaaacagaggcgcaaagagagtaatactccaagaggcaaaattccatatacaacacagagaggtgtaaaaaaaggtgaaccatccaaaacatatctatctataagcggggacaaggtgatgtggggcgacccagtgacaatgtgacactcacgggtcgccccagtgcacatacacgtgtgtctctctagtgcgccctactcaatgttgatggcgctccatactatctataacacgacaactctctcacaactctcaaaaaaaagagatcctctctatactgtggaatatctctccacgaagcagtaaataaggagacgcacgccgacggggcgacaaatattaattcgccataagatacgcacttaagaagcggggggcacccaaaaccataacccccgaggaggaaaaaaaaaaggccccaatacagagaaaagggcgaaagacgaggggcacaacaggacgggcgaatatgcggccaggcacgcggacaaatgacgcgcagatcgtaccacggcgcaccgacacagagaggcatgcaaaacgaacgaactatgttacaaaccaacgatgtggcacaccgacgaggtcacagaaaggaggtcaccaccaaaaaacagtggacagagagacagagtggacgacaaacacgagacaggagagaaacaaaaagaagaaagcgaaaataaaaagagccaaccagaggggggtgccacactgcaacaacaacaaacgacaaaacaaaagagaggatacttaggccacagaagaatagaggggtgcacgaacaaagaagacaataacgaggatcacaccacacacagacacaagcacaccgatgacacgaatggggcaagcagcctgcaacacaagagggagacgatttactaccacaaaagagggaatcgttggagaaacaacacagaggaaagtcagacgacaccacgtagtactggagcagaagaccagagccacaagactacaaacgagacgaagaagaaaacaaaacaaaagacaatctatcagcagaaattacccccacgagcagaaacacagacgggaaaacacaaagagagcaaaacagaaaggagtaaagcgaaacactatagacgaaaagagacaccaagaacacaagaagataggaaccaaatgaggagataccccaaggtgatggacgaccagccacacaccgaaaccagagcgacaacaaggacagaacacaacaacacacgatggaacgatataaacaataggcagcaccgccacagagcgagagtagaataatgacgcgcacacgaaggggaaagcgatccaccatatcacgggacgaacagccacacaataaagaacacacgcgaggaaacaacgaacaaagcactcaaaagcacgacaagaaaaatcctcct

SEQ ID NO: 674678 - DNA, 512 bp, Homo sapiens
tcacgccagtgtcacaaggacggacctctgcccagcaactcaggcctggatttagtccaagggccctcagtggtttttgggtggttggtattttcaggaagctgaagaatagagatgggataaaaggcggagataacttttcagactctgaccttggtaacaatctagtttccttttaaaggagcatggtttgggcctggggccacctagaccttctgatgctctttccccacccttggaggaggaggaaaggaagaaaatgggccctgagcgatcaccacataccaggccctgggggtctagtggcgaaggaggcaggtagggtctcttgctttcatggagcttctagtcaagcgagacgcactaaacagtaaagggacaaataggattactggaggtagccctaactactgggacagaaacaagatggtaagatagagaaggaagagtggcctgctcagatggggtggtccagaggcctctcgggggaggtgactcctttttattttatt

SEQ ID NO: 674679 - DNA, 147 bp, Homo sapiens
  misc_feature (89)..(89): n is a, c, g, or t
gtggagacgttgagtgtgcctcccgctctcaccaactgcactaagcactccaacttgccgaaatgcgcggccagtgcacgggcgtccancactagaaggagtcctcagaggccaggtgggcgtggggtgtctgctgcagcacgagca

SEQ ID NO: 674680 - DNA, 407 bp, Homo sapiens
  misc_feature (33)..(33): n is a, c, g, or t
catttttttgaagaataggtttagttgtatccntccctattctttctggcctcacatttcttcctcaaacactgagccatatgtattcttttctcagaataaactctggtgccagcttataaaataatacccttttcaatttatgaaattatttctgtctcagcacaaatcatccgaggaaaggttttaagcttagggtggcaaggagaaagatataacgtccatattagaatgacgtgtgtggcaagtagagggtaaacagagtaggaaggggtttcagtgtccctagaatatgcatgttacacagcactttgggaggccaaggcgggcagatcacaaggtcacgaggtcaggagattgagaccatcctggctagcacggtgaaaccccgtctctactaaaaatac

SEQ ID NO: 674681 - DNA, 295 bp, Homo sapiens
tgtaaaggatccccgacgagttgtccgagttaattgttgaattttattttagatgggggtttcaccacggaggccaggctgggtttgaactcctgacctcacgatcggcccccattggccttccaaagtgctgagattataggcatgatctaccgggccctgccagcatggagtcttttagtatgctttaagacatggaccattacatgtgaaaagtttgacaaatgttcagacactatacattcaaaggaatggaagccaaaggtcagaagtattgctaactcggacaactcgt

SEQ ID NO: 674682 - DNA, 1034 bp, Homo sapiens
gagcaccgatgagggcctggatcttctttctcctttgcctgtgccgggtagggccttggcatgccctcagcaatgaagccctgcctgatgagacagaggtggtggacagaatacttgtggcatggaggtgtaactgaggctatctgtggggcagctagagtccctgtccactgtggaagtaggcagaatttgatgcactggtgcatgaggaagaccgcaaacgtacgaggtggtggcggagaaatccctgccagaaccaccactgcaaacacggtcaatgggtgtgcgagctggatgatgaatcaacgatcgccccagtgatgcgttgtgccagagagccaccagccgatgcgtgcccagtcccccattgggcgagcttggagaacggtgtgcagctaatgacaaacaaggacctttcgaatctcttcctggccacttctttagccaacgagaagttgcaccctggagcggcgaccaagagagaggccacaatgctaccacctggatctacatcgggccttgcatatacatccccccttgccttggactctgagctgaccgaattcccccttgggcatgctgggactgtgttcaagaacgtcctggtcatcgcctgtaatgatgagggactgaggactagacaaggcttctgactgaagatcgccagaagcctgcagggtgacatgacagatccgatgcatgaactcgagaatggcggcctgcgaagggctaggagaagcaccaaagtctcgatggcaagcttgcttggatcctggcgagtttcggtagacacgaaagttataagcaatgttacagtcttccgctgttacaactgggcaaggtattcgagccgatggttgggaaccccaggggatgccaggtttggactggcgattacccgtctactccacacagaagccggaaaccgtggccattcacgacctggtccggtagggtcacacgcatttacaatccccaacaagggaaatgcgatcgggaactatacgcccgacgctattgaacccgaggatacc

SEQ ID NO: 674683 - DNA, 932 bp, Homo sapiens
gatgtaatgcggaggcaggggggaagatggtggcggatgttccaccgcgggacgtggaccgtggagacagctgggcacgtgagcagatgctcacacgtattggacattcactctaagttgtctgcacgttgaaccactggtcatcattcgtattcttgcagacacaataaactctatataggacacatttaacatatgttggtactcgactcgtctaatgaaaggaccaacttgtgattacaggccttattacaccgcactacttttagaatagataatagcgttttacaaggggtacttggaatggtattaaaggtataaaggtgtctgacgcgaacgttacaacattatgtgatacgccttaaatgacacgattatacgcacacgaacgcacaaatgccaaggtcgtgccaagaagatcctggaatgagggtccactctaaaaatattacgtaaagaatctggtcctgattaacggcggtagatacatacaatcccatctttccgcacgtaaacgggagatcgttggttcaactgcctggtattagaggaatgacttcatagatgggtgactgtttagaagactaatattgcactacaaagtgccaaaggaataagaatcgactgcattaggcctttacatgttattacagggtcaggatatgagggaagtgtgattcagaagggaatgggtaaattaaagatctctctgaatattgacgtccaggggatgaaaaatgtgttcgaattggcgacttgaggccatgaaatgtggcttactggaaatgacaggtcaagacttgatgcaatattgcagcaaatgcaaaacgcatttttgacggggaataagggggtaaggattgataccacagggtcagtctgagggttttagaaggtgggaaaattgggtttgacaatttttaacattggaa

SEQ ID NO: 674684 - DNA, 466 bp, Homo sapiens
ctaaaatcaataagagttttttcccccaagatggcagactagaggcttttagtgtgcctcagccacttggaaatagcaagatagtacataaagatcaactctgtgtgctttatttcaagaaggaaaatgagagtccactggaattgtgaaggacaccccagatcccagagaggagaattgccggcaaacagccgttgtgatggcatacagctgataaaagtgagtgaagccccagtaagtgaaaaaggcaaagaacctccctctgtcactctcctttccactggggacccaaacaacccagacctttgttactcccaagcactggagataacatggggagaagcttggagatgctgtgagagaaagaaatcaaggttgcagacattttcccagacccaggaccaagagcaagataccatttttaatccagatgcatgcgtcagccattctttgaccttggcgcgtg

SEQ ID NO: 674685 - DNA, 1081 bp, Homo sapiens
gcctcacccgggcccaggtcccttcctattcagaacataaagaggccataccctggagagcccaactacggaaaccagcaatagggaccaaacaggccagttccccatccagcaggccagtacccagcccgcaccgcgaggatcactccccaagaccaggtggaggatggccggtgcagaagcaagaggctccggggaggagccgaggcaccgatggggtcgaaggatggggcgggtgatctcaacaccgcccgaggaacgagttttataggggacaagcataacacgagcgtccacgggaagacaggtgacagacactacagtcaaggggacggtcaaacgaggaactccgccaggtgcggtgcactgctggggaaaagtaggcccctcaactcactcctgtctcagggaaaacggggaaagccgacggaaggagcgcaggggaccctacaatcgatacagggatactgaccaatcccgtaacgagactgtcccggggcactctctgtcgaggagatgatacacaggccgacatagtgcatggggattggagaggacacaagaacgaggaccagaacaaaagaggaaagacgacggcggaataacaaatatgccactgatgacagcgacagagcgtgcagcacaagaggagcccattaccggactgagaggcacaaacattggacggaacaagacaaaccaagcaggtaccaccccgccggtagccacgcgatccaccaaggaatacctaggatgctgcagagctctgacccggaagccaggaaggtatcaagcatgctaacccacacaacaaagagagcaggcaggaacggacaaaccaaggcgcccgccacattcgaacgaacaagcacacgatgataaggaaacgcaccccataaaaacaaaggaggtacggacgaaacaaaccaaaaaaccaaaaaaggcagcggaactgaaacacgattggacaaccggcagacaaatatcagataatagagagactgaagaggcacaaccacataagacatgccacgaacgagaaccacgacagaccgagtacgacagctaatcaatcaccacg

SEQ ID NO: 674686 - DNA, 177 bp, Homo sapiens
aacctatgtacatctggtagaatttgtgtgtgaattaatctaggtccaggccttttattcggcaggtagatattttattactgattcaatttggtagcttgatattaatctgtgcaaagttattatttcctcctgggtcaattttgacaggttgtgtatgggatggaatgtattcat

SEQ ID NO: 674687 - DNA, 321 bp, Homo sapiens
tagcgctcatcctgacggcatgagagctcatgcgaataacgatctgagtgtggtggggaatggagagagagcccgtgacagaaacaacatgggaaagcctccatttcccctagtagtggtgcacggcgcagtacaccaactcgaaagagaccttatgactgcaggtgtacgggaagcctttaattctcccaatttatttcaaatccatcaagaactcacacggaaagaggtcctataatgtagggaaatagtgagagccttcacagttatccaggtttccttttccggacaaaccatggaaaaatgcatactggagaaaaa

SEQ ID NO: 674688 - DNA, 140 bp, Homo sapiens
ctcttccatgggctgtgcagcagcccgctggagctgatctttttggcgcgtgggctccaccgcgcgggatacaccgtgcgcgtgccctccatgacggggtacacctaccgcaacggcaagaccctgaaggcgaaggatgg

SEQ ID NO: 674689 - DNA, 861 bp, Homo sapiens
ggtcccccattatgccgaggctgacattgttaccctgcaggcgtcaccgggggcaacacctatgctgtgcctagcaactgcccccaggtgcagtcggggatgggccccccagtagtggatttgcccctcgatctcgactcccgcttcacacggagcaagcttgtgcgagggccagtttggggaggtgcacctgtgtgcagtgtcgactaggcgcctcaagatctaggtttacgtcttagatttccccacttaaatgtgcgataagggactaccctttgctggtagctgtcacgatcttacggtcagatgccacacaaagaagttgccaaggacaaatgatttaccctagcaagagcaggctgcaacgcatccatgtcgcagggctcgaagggacccaaacgatcatacggcgcctgctgggggcgttggtatcgttgcagcggaacgaatccccccttcttgcggttcgcattaacctggaaattaacgtttcgaaagacacgggagagaacgctttcgaaacgcaaaggtttcctcatcaagttggccgacaacccaaatgccttgagaacggaaccaaaatcggccagatgccccagaacgggctggtgggccccccctttgtgaggggaacagtcgtgcgcagcgggcctttggcggcaaaggaggggccccctctagcgcaatttcgagagaccgatatcccgcaaaatatgctttggcgttggcaaattggttcgggccaaggggcccgcacaggaattccggtacctccccggggggcattatgcgcgccttatttccttcgggacacaagcaagagttccacatggtctttgggtagcaatccgggggaactcg

SEQ ID NO: 674690 - DNA, 474 bp, Homo sapiens
atccagttctaataaccctgtgatagctgaattcctttcccggggtaaatcttcaggttccagcaaacattttactagtagcacgagttccaccagaggagactccacattggaaagcaggagctttaaaagggcagatgaggccggaggtgaagccgatcatgaaggaccacatagcaccaagagaggccatgctaaatctggccctgtcagaggtatccacacttctcctttggggaagccttccttgtccccttagactaagttaaatatttctgcacagggttcccatggcccctggcatttccttcttaactctctgttacacgtcattgaaactacactttttgggcctgtttttgtgctaaactgtaagttccttgggggcagggccttggccggcctaatctctgaattcccaaatgcctaacagtccagagccatgactcattaaatccatgttaaatggaaaaa

SEQ ID NO: 674691 - DNA, 779 bp, Homo sapiens
aggattctgtttgcttcgctcatcctgatctcaaaatagttctatagttataaactttcaggatctcccctgatatttgttgaagataatatggaaagcttgtgatgatataatgttcatacgtactcttaacattggataataagcttgtacaaactgatgatgaagaggaagccggcttattggagcctcgtgtaataatctcctagatttgtcgactaagttgccagcagtctatagcactaaataggtagcgatgatagaagttccaggctgagtacctgcactcgtcctggttgacagtccatcgtggaatttcactagttacttactgggtcaaagaggttaagatagtagatttgttggtagagtaatgcaacttacaaattatctggctgtcaggtttgtagagagagctcacttataatgaatctatttcgaggaccactaacagcgcatgaccaagtatctgggagagaaggttgattgtggcgtaatcgatggacatttacgagctgcgtgatgaagaaaatagtttgaacgatacatatctagtaggagatagcaataaggagagaatttgggcactgatcctgatgatttgatatctgaggaacgcccgggttgattgtgattcctggtacgcaggatttatgccgagatgttctggagggggccctggtgtccacggaaatctttctccgggggtgggtgccccaccccgccggggcgcaaccttccgcggcaaacctccccggtgccggtctccccaaaattcg

SEQ ID NO: 674692 - DNA, 494 bp, Homo sapiens
ggcatgcaagctctggattcctagaatgggagcagggagtggttatgatgatagaggggtgcaaaaagatgaattcaacccatatcacagtatttttccaggccagaaatattaagactttattgctgaaatattaagactttaaatgtctgaataccccgaagggtagtgtgaacagcatgaaactctgatgcatcctaaggaagacataaaaccaggtttgataaaagtcattctcctctttcacacaaacacacacacacacacctgcaaacacataaacaaaatcagtaagtaaaggaagacaaattattatctaataaaaaacagccagataacagctaacaaaaacaaaaaacaaacaaacaaacaaaaaacaaaaaacagaggactgtttgtagatggagcttgagcttcattcattcattcattcaacatttagtaaatgccttgtatgtgctgaaccttattccagacactaaagatatcataga

SEQ ID NO: 674693 - DNA, 366 bp, Homo sapiens
cgctgtactggttagtgaactgctcgcttgggctgcttggtgctgcgcaggtaggcctcgacattcttggggatgcgcgaggggtgattggcgaagcgctgggtggaaaatatttcggaaaaaccggcagtgttggccaaatacagacgcaggtcgaagggaatgcacatcggccacgcctggtgaggaaactgctgtccagggtaagtggcgaccagcaacaggtaatcaacgccgtcacggttggtttcgaaaggtggacaccaccaggcccgtgctcacgccgggcgaacttgcacgggtttgcagcaccggggtttgttggtgaggggttgctccgcccgcgcaagaagtttcggggtaccg

SEQ ID NO: 674694 - DNA, 227 bp, Homo sapiens
taaagatatggccttgatttataaacagtacagaatccagatggttttcaatggcgggtcagaagcagtaccttactttcaattgcaactggatgccagtcctgatggtgactgtcctctggtttccatggtaacaaactttaatggtgatcagcattacggtaggaactttttggcattggaaacagggcaacgaaaacaaaaattctggatcctggtactggttt

SEQ ID NO: 674695 - DNA, 1350 bp, Homo sapiens
ttgtctcttgtttgtggcttgttgttctgtgcttctttttttttttctacagcgtcctcttcgtatcattgatagtgttgtgttttctttccatactccttcgtgtggtatcttttctgtcttctcctcagtttcgttgttcttgctccttcccctcctttttttgttttgttttagcgggggtctctcatatgtgtttgcgtgtgtggtgatcctgcggctcgtgtgttcccctctctggccctttcacattgttggggtcccttgttgctataggcctctgtgcccctctcaatgtagaggtgtttttctctcggtcgattacaaatgttctctcttggattcccctcatggcgctaatatcctggtgcttcttcaacagtgtctgaggcttgtgtaattccccccccgtgaaaatgtgttcatgtaggagatttgtatatataatattacggggtgaaaccgaaaaacttttttctacagccctatgctctaattgacatattgttataggtgtacttcgggattgttttcccctctttaggtgtttgccaacacgtgtaccggaccttctcgatggtaacggcgagacttcctttattttacctgattaccggtcatgtgaaatcgcaaaatgattacaacttgtttggtcaatgattttggacaagtgttctctagaggggaagacacatttttccagccttaatgcttccatgagaactggttcattggttgtcattgtaaaaatggctatgaatttcagtcgattagttggataccttttgggactaacttgcccgtaactcattgcttaaagggactattgtcggttcccagcctcaacgtttgaagctaattgtctcctttacacaactatacagtgaataagtcacttctatggggaaaagactcctcacgataaacatagatttcaaatgctaaaagagataaaagtcaggctacatacttatcctaaacactgagtcagacaaatcattactgtactagaagttgctttcctgatcaagtctgaacttcagctagctgctagagaactattttctatgacttaactctcaaccaagtgtttattttaagctgtttcatttgactagaaggcgccatgaaaagtagagtaagtgatactagtgaggagactcaagggattggtcttggtctttttcaataaagatagcaagttgctgaagtctattcttgaacttaactcaatagcacttagagtgtgaccttttagattacggctgttgagctcctgtgcttgctataaccttccatagaacagataatgcttcaaacatctaagcaataaacggctcttcatgttaa

SEQ ID NO: 674696 - DNA, 425 bp, Homo sapiens
aaggtaaaagggaagaaaaaggagatagaagagaagaagagacaacagggagggaaggaagaaaggcgcaagggataaagaagaggagaaaagagagacagagaagggtgaggtcgaggagaggatggtaggaagctggactgggagggggggtgagagaattggatatggatggaaagaaagagatagagaattcagaaggcagaaggaagaggggggagtccaagagaaaggaagagaggtaataagagaacatgaggggcatgaggaagtatagcgaaagcgagaggtagcaatatctatcgcagacaatctatatgggtaaatggcacggtcaagctcgctcggtagcactctcgcgctctctctctctctctctctctctctctctctctctctctctctctctctctctctctcctcgt

SEQ ID NO: 674697 - DNA, 205 bp, Homo sapiens
cagtacgtatgcgattcagatctgggaggtcccagctagggggggttaagattctgcatttctaacacgctcccaaggaatgtccatggcaccagtctgggaccgtcctttgattagcaaggctgtagagtggaggaaatccgtgtgtgtgtgtgtgtgtgtgtgtgtgtgtgtgtgctgtgcacggaaacaacacagtacggga

SEQ ID NO: 674698 - DNA, 370 bp, Homo sapiens
ttgagaccagcttgaccaacatggtgaaaccccgtatctactaaaaatacaataattagccgggtgtggtggcacgggcttgtagtcccagctacttgggaggctgaggcaggagaattgcttgaacccgggaggcggaggttgcagtgagccgatattgcaccactgcactccagcctgggtgacagagtgagactccgtctccaaaaaataagcaagcaaaaaaaaccagatgagcagcagtgagaagaagggggaaagagtagaacaaagagtttgggctgtcactgactgtgagtatacaattgcgataactcactaccttcacgccagcctctgagcaccttctgagccgtatctgctctctcaa

SEQ ID NO: 674699 - DNA, 188 bp, Homo sapiens
ccattcaagtttagtagtagaagacgggttaaggataacaaggcatcgtaaaagcttcgagaaggaaaggagatggttggtggaccacttgggttatctttatggcgggtggcagttttaagtgataagtttttaagatcagtacttttgaagggaaacagttggagcaaaaattggtcacataattc

SEQ ID NO: 674700 - DNA, 414 bp, Homo sapiens
tcccattgcagaggctctactacttcatttccacagtgagcatatatataatgatcacctctgagtatatcaccagtaacattgatacctattttggggtataaacatggtgtttttcagaaataccaccatcttcattaaccttagctatggctgtgataatacccaggcactcgatactcatcctcaaattttttataatatatgtaatttgtctagtcttaaagacacttggagcatggccaacagtaaggtcagcttctcagtgatgtgtgtggattcgtacagaatgttagtccgaatctttatcaatagttggtgatccatggggggcaacatcattcgtcccatggttagaaagtgaattagaaatttcagctcagtttctattttactattcaagttgtgtacttt

SEQ ID NO: 674701 - DNA, 604 bp, Homo sapiens
  misc_feature (21)..(21): n is a, c, g, or t
  misc_feature (397)..(397): n is a, c, g, or t
cgcgagccctaaaagaggccncccccgtggtgtccatacattcactggcctgatcctctcgccgtgggttttgctcttcggtctgtggatacgggatggtgccaatgtctccaacttcccttttgctcctagcacgattatatttcacctgggacatgctgctatgctgggactcatgtatgtctactgggctcagctccacatgttccagacccttaaggacctggccctcttgggcagtgtgacgtttttggctggccatcggatgctggccccgcaggcagtccaaagaaccgcccctttgttcccgaaaaaagatgggaatttttgaaactgaatgtccagaaaaggggtccagccccattccccgtgtgagaaggaaaatgggaaaaaaaancttttttttaaaaaaaaaaaagtcccggttgggggtaaacttttgcttgtttttcagtttcccccacccccagcagaaacctggtgaggtcagatagtttctttttttgaccctgggtaaaaaactgtgaatattcccaactttccccgatgttgctttttaaaagtttaaatggggtattgttttggaataaaaaggggtaccata

SEQ ID NO: 674702 - DNA, 314 bp, Homo sapiens
attcccccatgtaaaagataaaaaaggagcctgtaatccccagcactttgggaggccaatgcgggagggatcacttgaggcaggagttcgagaccagcttgggcgatatagtcaaacccctccaccccaactatctcttcaaaaaaatttaaaaattagccagatgtgctggcacatacctccttgtggggctgaggtgggaggattgcttgagcccgggagtttgaggctgcagtgagccgcattcacaccacactccagcctgggcgacagagggagactcaatctcaaaaaaataaaaaagtaactcataa

SEQ ID NO: 674703 - DNA, 397 bp, Homo sapiens
ttattaacttgtctgttctactgtgccagtactcctatgcctatacctatttaccgtctaagagggatatctatcttgctggtggaaatacacacctacacaagtaattacgatatctgtaaggagataacaacgtgtgagagacacaggattccgtggcccagacaccaaatgttccctatttaggatcaagatgtgggggttgtgaagagggtacatcactaagctgagacgaatagaggaagttagagaaatttgtaatgggtacttgattgactgtatgcaaagggtactgattaatttctgctgtaacctgtgcaaggagatctctcaaaagccctgcagcatcaaggttattatgaatggcttatatcaggtggatacagcattcctgact

SEQ ID NO: 674704 - DNA, 193 bp, Homo sapiens
aactgttacattataagctgttaatgcattattgactaagtattatacaaagtcgcactatcttgatttgtacttaaattgcattgccctatcaaacatacagctcgaaacctatgagcatcctacccgtctattgagggctgtcttgctaccaagttttgtcatctccccaaggctgttctgtgaaactctt

SEQ ID NO: 674705 - DNA, 1283 bp, Homo sapiens
  misc_feature (966)..(966): n is a, c, g, or t
tatgacaccctgagattgtttctgttgtattaatgagagtgcgtgtattaccccgggtgtatgagccatcacgacgggcagagtcttttataaaggagaaggggtgtaagaacgggttcataaggggttatctcggcataaatttgtttgtcgccgcgccctggtgttgtccctcgcgagaaatggccgcgtttgttagagtatctccccccgtgtgttatgggggcgctcgccgtgggttcccagtgggaaacgcaccgtgtttatcgcgcgcccgccggtgttccctcgtgttgcccgcgctcctaagggggggtgccattaaatctcccactgggggttccctctctatttttgggggagccctctgtagtatatagtggggtctcccctcctaggggggtgtctcagcgcgttgtggctcctaactgttttgtaaaccctctcctgaagaatttggaccccgttgcccgctggggagaagagggggcggggccaatttattctccttgccataaagtgcgggcgaagggtccccccttttggggggctttgtaaaaagtatagatgagaaattgcccacctcccgggtagacctgtgagacataagacccgccccacgggtcttcttaaatatatcccacaacacctcggcagcttttaaaaaattttctgcgtatgtggggcggagcacctcgcgcggatcacacagtgagactcccacactctctctcgagagcccacgtgagacactcggtttagagagacactgtctacccacgcttccaaaaggcgaatgactattataatagagtgccaactgtgagacccccacataacactgtgtgctcaccccgggggccccacggtttaccctagtggggggataaacacgggccaaattcctatattttatagaggcgccacaatgccacccataaagggtgtttcgacacctctcgagangttggagatacacggagtcacttcccgagtgggggccacaccccgctgtttataaaggtgttttgtttgtttcacacacgcggttataaagtgtctctcacacgtggatttgaggtgttcagagccggaggtatattccacggtgcgggtgttttatgttactttccaattgtctctctccctcgtgtcgaataaggacacaaagagagaaaaaaaggcgctatctttccgcacaagccggcctttcccccggaaaagaaattattttaacttgaggattaaaccccccccccccccagaaacacggggtttgttta

SEQ ID NO: 674706 - DNA, 278 bp, Homo sapiens
  misc_feature (139)..(139): n is a, c, g, or t
tatgcactgcttcggatgcccagaaagcaagtcttcagtcctgtggggcgggaggggtgtggaagagacggggtctcaccagcaaggcgcctcccccacagcctgtcccatgtcctcagtcccaagggccgaaccaggnaccaggagcaacgggtgcctggagccgtggggctctgccctgatgtccgcccgtgtgctggggctgtcctctctgggaagcccggggacccgcatcccccaccaacctgactaaatcagctcagggacccgcgtccccc

SEQ ID NO: 674707 - DNA, 195 bp, Homo sapiens
ttgctatcatacgcatagttttgtataagtgaggatctaacgcgggagaggctgcggggagttgggagcctaggaggctgggcgctggttacttggtgacgtgcagagtctctctctgggtgggctgcagctcatcttggggggagctggactcagatgcccccgtagttgcatgaacacatcactgggttacct

SEQ ID NO: 674708 - DNA, 927 bp, Homo sapiens
agcggacttagagcgcggtcggcgcaggggccgcgagaggcttcgtcgccgctgcagctccgggggctcccagggagcgtgcgcggaacctccaggccctagaaggatcccggtgtgcggccgaggaggataggatgccagcctagcgagcttctgcgcctgtgtgccgcgggtgtcctggaggcctctcgggtgtgacgagtgggggagccgaaggctcgttgtgccacctcctaggctctggacggctgccctccgttcttgctgcctcccaataagggtgtggcgggaatggtttcatggcctcgtggaggcttgtgcttgcatgcatggaatccgtagcagtcacggcgttccagggatggcgcatccagatagatattttcacaggttcgggcagattcggcccaggggatggtactagacaagtatgcgcttagcatgggccaatttttggctcgacggtgcgttggacgttctttagaggtcaccgctttggttacttacgtgctgggtctacatgtccggaggcgttggcgcaatgatggtttccccccctttgggggaggcatctgctgtgggaagtcgctttcggcctggcgcaggtttttcgctaccctcagggtcggtggagacagacatcggatttggggatatggccaccggagcaggagttctgatacgtgcgcttcgcgtcggcggctgaaggctgcacatacccgttggacaggcgcgtgtagcggagcgatgcacacaagacaaggtggatggacccaaccgcggaaccgacgcgatgatgcgcagagacatcgtctggaggcgccgcgcaaagaatgtgtgattccgggcgaggctgctgcgggcacgcatcgtcaggagtctgctaacctggagctggtagcagagggacacgtgacacacctgagc

SEQ ID NO: 674709 - DNA, 748 bp, Homo sapiens
taaaaagtatggctttttatgcattccttcatcgagggcatttgaagttgcttggactgataaaagcttgatgcaaaacaagaaagaaacaaacaaacaaaaaaaaccagcaaaagtgttttaccaaaaaactcaaacaaagtgagcaggtgccgtgtctcaattctcacagtctcgtgtggagatccagtgggtaaatagtgtttcaaactgacatttcctggggaaaaaaaattctctacaacttttgtccacttgtgaggggtacactacttcccaggcttaggttccccaaagctgcagtagattattgtcttcatcaacgctggtaattgggcgcttattttcatatagaacttttagcatccggggaaggagctggccccacctcaatgatattctctgagaacaacttttgtaggacggggtgtccttaaacatacttttagtaacaactgtggtgacgagtagtcagtaatggctttgctagctacacaccaggttgaccacattttgaaaactctttgggatttggtccctcatggcgccaataaatacaagaacactgtgtttttaacttgaatttctgttcaccacaaggggagggcaatgcacaaatctccattgttaacaaaacattttagccagtaggatggttttataccgacacggtacactaaattgcataggagtcacggcctctgggatccaccccagatggaccaaaggttagcgaaggttaatgtcc

SEQ ID NO: 674710 - DNA, 566 bp, Homo sapiens
gaaacccccaatgaaataaacagaaatagagcagccagtttttataaagcctgaaactcacagaattggaagtctgagtgacacagatatgttaacagaataacccaattgtttctcaacaatggaaagatgtgggatccagagagcagtttttgtttttgtttctgctattaagtgactgccctccatgtgataaaattggagaggtgaactgagagttcttcattacaaatacagctgactttattgcttactgaattttgatactgagccaggcattgggctgagtgcttcacaaacatagtttccctgatcccttccgacaactctctgaggtgggtgttggtggtcctattttacagatgcagacactgagattcaggaaagttaagcagcttgccaaatacaacacagctagaagtggcagtaccagaatgctaaccaaggcaatctgacttggttcactgtgctcttgtgagccccacaatggaagggctctgtccattacttgctgacaagaacaagacctcaaacatacacggcactcaagaaatatctgttgatgg

SEQ ID NO: 674711 - DNA, 312 bp, Homo sapiens
tcaaattaatcaataatctgcaccaaaagggcaaaatggcttacattatcctgttcaagctgagatgtaaaggacatagagcatttacactgacacacactgtgtaccatgaaacgagcttgcaagcttgtacctactatataacatggctggttgatggccatgcatttcagtcaactttatatataaatatatccccattttttgattcatataattagacctaaaatcctatgattagtgaaacaccaaaaatataggaaaataaacagcagaggaatactccccttaacagagtgatggtcccactac

SEQ ID NO: 674712 - DNA, 878 bp, Homo sapiens
  misc_feature (171)..(171): n is a, c, g, or t
  misc_feature (175)..(175): n is a, c, g, or t
  misc_feature (179)..(179): n is a, c, g, or t
  misc_feature (188)..(188): n is a, c, g, or t
  misc_feature (220)..(220): n is a, c, g, or t
  misc_feature (238)..(238): n is a, c, g, or t
  misc_feature (249)..(250): n is a, c, g, or t
  misc_feature (262)..(262): n is a, c, g, or t
  misc_feature (290)..(290): n is a, c, g, or t
  misc_feature (305)..(306): n is a, c, g, or t
  misc_feature (311)..(311): n is a, c, g, or t
  misc_feature (356)..(356): n is a, c, g, or t
  misc_feature (363)..(363): n is a, c, g, or t
  misc_feature (427)..(427): n is a, c, g, or t
  misc_feature (453)..(454): n is a, c, g, or t
  misc_feature (457)..(457): n is a, c, g, or t
  misc_feature (459)..(459): n is a, c, g, or t
  misc_feature (464)..(464): n is a, c, g, or t
  misc_feature (466)..(466): n is a, c, g, or t
  misc_feature (479)..(479): n is a, c, g, or t
  misc_feature (481)..(481): n is a, c, g, or t
  misc_feature (490)..(490): n is a, c, g, or t
  misc_feature (505)..(506): n is a, c, g, or t
  misc_feature (524)..(525): n is a, c, g, or t
  misc_feature (534)..(534): n is a, c, g, or t
  misc_feature (537)..(537): n is a, c, g, or t
  misc_feature (543)..(543): n is a, c, g, or t
  misc_feature (556)..(556): n is a, c, g, or t
  misc_feature (583)..(583): n is a, c, g, or t
agctggaagccatgctgtctgttctgctggagcagctgaacatatacatagatgtgccctgccctccccatctgcaccctgttgagttgtagttggatttgtctgtttatgcttggattcaccagagtgactatgatagtgaaaagaaaaaaaaaaaaaaaaaaggacgcntgtntctngaaatgctngtaaagaggtttctaacccaccctcacgaggngtctctcacccccacacngggactcgtgnnggcctgtgtgtngccaccctgctggggcctcccaagtttngaaagggctttcctnnagcancggggacccaacagagaccagcttctagcagctaaggaggccgtncagctgntgacgaaggcctgaagcacaggattaggactgaagcgatgatgtccccttccctacttcccctnggggctcccggtgtcagggcacaganntangntctgngngctggtctggctngnggcgcgagngatggtctctctggnncatagcccgaagtctcanngcagtcccnaanggaggnttacaactcctgnttcacaagaaaaggaagcatgccagcnggggggatctgcagtctcccagaaagctccgtgaagcctaagccacccctcaaaacggggttcctcttccaagcttcgcccctctggaaggggcagctgcaagccttcccaccaaagggccctgggaccacgagcagggaatcgggatgcaattgcctgtcctggatctgctctagaggcccaagcttgcctgcctgaggcaaggatgactttgccccaggtcaggagacacttgttccccaaaggccttgaccagaagcaccctaagcccgtttaacctttgcccaaattccac

SEQ ID NO: 674713 - DNA, 833 bp, Homo sapiens
ctgtacagggcgggacgaagcggtggtagccgaggactgtagctggggctggctggtgcttccaactgcgtggcacaggaagctggccagtacgcggccttgctatggcataagctggcacagcatagcatgcataagccgtgtacaaacattgaccaagctgcggcatggcatcagctgctgaacacactctttggatgattctgccaaaaaggtacttctggaaaacatacaaatatgtggagaattttggctctaattgatggtcgcctcaccatctgtacaatctcctgtttctttgcacatagtggctttgattatcgggattatatagcacccctattccagagtccaaacccgtaataggctattgtcgtgtcatatcctattttgctgatgatcggggattctgaccatttatacctcatataaggagaagagcatctttctcgtcggcccacaggaaaagatcctacaggacatggatcctgcatgactatccgcgcacggctgtccttccagctcttaacccgcgtcctgatcgacacaataacccccctatggacagcttagaccctcaccagtacaagataggcgtcagcaaccacaaagcaagcacgcgggcgccccgcccgatcgctcccaagacaagtcccatacggctcaccgttctcacagcgaccccaccaacgttggggacacccttgggtaccctagatttgccattatgtcacccccctgacaaccttattaccatggggatccccaatttcgaagcaagttgctcttggccactttatgaacatgcaaaacactacacccgaaagccaggg

SEQ ID NO: 674714 - DNA, 482 bp, Homo sapiens
  misc_feature (88)..(88): n is a, c, g, or t
  misc_feature (392)..(392): n is a, c, g, or t
cgggtgaaaaagcgcctgatacaaaggagaagaaacctgcggccaagaaggctggcagtgatgctgctgcctcccggccccggcgccnaaagtagccaaaaaggttcaccctaagggtaaaaagcccaagaaggcgaacccgattgcagccgaaaccctgtcctggtgagaggaattggcaggtactcccgatctgctatgtactccaggaaggccttgtacaaaaggaaatactcggctgccaagaccaaggttgagaagaagaagaaaaaagagaaggtccttgctacttgtcaccaaaacagttggtggggacaagaacggtggcacccgggtggtgaagcttcgaaaaatgcctaggtattatcccacccgaagatgttcctcggaanctgctgagccacggcaagaagcccttcagccagcacgtgagaaggctacgctccagcatcactcccggaactgtcctgattatcctcact

SEQ ID NO: 674715 - DNA, 257 bp, Homo sapiens
  misc_feature (13)..(13): n is a, c, g, or t
  misc_feature (47)..(47): n is a, c, g, or t
  misc_feature (84)..(84): n is a, c, g, or t
  misc_feature (215)..(215): n is a, c, g, or t
  misc_feature (220)..(220): n is a, c, g, or t
  misc_feature (235)..(235): n is a, c, g, or t
  misc_feature (246)..(246): n is a, c, g, or t
actaccaaactgnaaaggaagagtcaaattaaccttgttcacagatncatgattgatatttaaaaccaaagaaactccatcaanaactggttagaggctgagcatggtggctcacacctgtaatcctaacactttggaggctgaggcgggtggatcacttgaggtcaggagttcgagaccagcctgtccaacatgtgaaccccgtctgcatttanatgancaccactcactctanctggtgcaaantagctccatct

SEQ ID NO: 674716 - DNA, 299 bp, Homo sapiens
gctggttcagaccctgcgtactgcttgtatactgacccctagccagcctcatcagcactcacaactcttccgctccaccctctattacattcccacctgcatatatctcagataactcttccatgctgtatttcattcaccttacatgtatttcttatcaaacgtttattgatcaccttgacagtgttccatggggagctatggatgcgacttcgaagcaagcgacctttcctggctctagagcttgagtctggtcaggaacagcacaagtagagacgtcgatcctagggggccatatg

SEQ ID NO: 674717 - DNA, 162 bp, Homo sapiens
tgggtttgatgattaaatttctcccttcccataaccagtaaaaaaaaaaaaaaaaattacaatcaggcctggtggtggctcacgcctgtgatctcagcactttgggaggctgaggtgggcggattgcttaatctcaggagtttgagaccagcctgagcaaca

SEQ ID NO: 674718 - DNA, 991 bp, Homo sapiens
tacccccttctcttagtctttgtgcgctcaaaaaccaaataaaacccccccccctatttaaagggggggcagtaaaaaaagaaaaaaccccaaaaggacagtctctgtgaaaccaccatgtttctgtggccccccgatcattttatcccgccctagaatgggtatttggggtgcttcatcatctctggtccctcggtaatgctagggtgtaagcagatgttgaaggggtggagccgcctcctctgggggggataaatgatgcacattgagagcccttcttggaaaatgtcaaaggggaagtagagaaaagccagccactggtcccggagccgggagtattaacagggggaaacaggtggagctggtgccccccagaaaagatccagagagagggacagaaaggagggagggcgtaggcgacaggagggcccccaacgagtgtgtcacagagagagagtgtagcctcagagacggccccaaggggagggggggcctccttagcgagttgagcactagaaagagtagtgaccagaagtgagggggaaaggggagcaagacaacaaagggtggtgttgtaaaccaccaagaggtggtctccatatcaaagagaccgggagagagcagagaggagggagccacgccattctccagacaacccttgaggaagaaaacccacctcccatatactccccatcaggggagacaacaacatggggcccagcacccactaaaagaacacccgagtcatgaagcatcacagaaaaaaggaatcgagaaacgctcgagggaaggacacctccagcgagtggggaacaggggtgagtaagcgaccgcgagaacaacaaggagaagaccataaggagcgagtcagtagccccaaagaagaagaaaaaactgcaggattgaacacaacgaacagtggtggtgtggccccgcggaaaccatggttgtggtgcataacaaagaccaacacagggacctgataagtagg

SEQ ID NO: 674719 - DNA, 159 bp, Homo sapiens
tgtgacaggctgaagctaattttcaaaaacagtcaagaagctggtttctcctaaactatttgccttgtggtagtagagatcagctgggtcagaaacaagtcctgagcacttggtttccttttgagccgcgtcattaggaggcgatctgtcaatcataat

SEQ ID NO: 674720 - DNA, 282 bp, Homo sapiens
acccccccccccccccttttttccgggggggggggggggggcccaaacggttttttttctttggccccttttttttttgggggaaaagcgggggttttttcaccccgcccggggcaccccccccaggggggggggggggtttttggggccccctggggttttttttttggggggggggggttttgtttttttttttttttacccgggcccttttttgggggccccctttcccccaattttggcccccgttttttggcccccctttaaaggttttttggggga

SEQ ID NO: 674721 - DNA, 369 bp, Homo sapiens
ataagtgtagaaatatccacagacttacagaaggacttatgctcaatccaatatcggggaggcagtaacttataagcacaactgacatcaaaataatatcttgactgaggaactggtcctgctgaatgggtccaacgtggtctttaatcttctgggtccggtgcttgtttaacaggatctgggggagtgctcgcggtcacagttagggaataggctggactatatcacagctgaaatgtgagtttttattccaccatcgtgtgctgtactcctgtgatgcaagtgaaccattggagtagaggtgttgaaccattgcagaacagctctccatagtggccccttttcctccatttcctccaaccctttcct

SEQ ID NO: 674722 - DNA, 1690 bp, Homo sapiens
tggtgggtgtccttggccctcgtaaaagcttgcaaaaataaagccaatggggctatacctcagctgttgcaccacgagctcaaccccttcagaggggaaataaggtacaaaccaaaaagagttccactccaagaggacaagaggacagcaatcttcaaagagataagggaaccacctgtgccctcacgaaattgagaagaggaacccgagcgcgcaagaaacacctctgtggacagattctcttagaacacccgagggaggtggtggttcgtatacctctcacagaatgtgaattctatcaggatagactctcaccgcgagacaatggggtgtgtgtgttaactcgaatattataaaagcgcacgcctgtgagaagagtgtcacagaggaaatatctccagacaaactctgtggagagtgggttcagagaaaacgagcctccaaagggagaactactacgagggaaaacacatagtttgtgaacacactctccaaactacccgaggggggcacaacacaaccgagtctaaacaatagtggctctccccaaaaaggagagtgtgtgaaacagaggactatgtggtacccacagaaggcgcccaatttttttacgacgaaacacatagaaaaccgccaaacagtgtggaaacactttcttcttataagaaacaattgtgcacacaaagtattttccccctcaggggggggcaaaattccccccattaaatataaccacactcttcagagagaagccatattataaagtattcacacccacaccgcagtatattcctactctgcgtggggagggggacaaagagagaagtctcctctccagagaagaaggctctccaaaagatgacacccacactctcccctttgtgtggcgacttctcctaaaaagttgccgaagggcctgcagaaaagcaaaatcctaatttttatcaaaaacaacacgaaaatcttttttctaacacacagcagatgtgtacgaacaaacctctccattcgagagcaacacacttaggtgcgggggacattacatgtagtttaaacaaagggacgagcagcaccgaacaaactctataatattagacctctacaatgtttgggcggaccaatttccccgctgttgacgaagcagcgaacaacaaccggcgtcagcccccgacatgcaagatgtatatccccgaccacaccacatcgcttgtgtcggcaacgcaacagccgcggcctttatgtagcccacgggcgatccttaatcatcacggctttctccgcccaggctgcgcagcagacataccatattctgattcgccccacagcaaaggaatcctccgtcacccacctaaaacagacagagagaagctgcggtggggtgacaccagatgggtgcgcgcatggaaaccaaccttccccccaagtgggtgcagcgagcccagcagtcatgtgggtcggcaagcagcaattactctcctcacaaaaaacgagaaaacacagcaagcatggctcttcacacagccatattttgtagcacacatcatcccatacgagtaagagtactctcttatcataccgcggagcggcgcatttttattaattccccccccacgacagatcaaaacaaatcatcatgatgcttcatatctgcatgcggtccacagagagaagcaactctttagttgtggcc

SEQ ID NO: 674723 - DNA, 215 bp, Homo sapiens
acgcggtatggtgtcatgatgttcgagattaccaagcagtggaccttcaattacattctccgggagcttccagaggtgccacccacgtgccagtgtgcgtgcttggggaactaccgggacatgggcgagcaccgagtcatcctgccgaacgacgtgcgtgacttcatcgacaacctgggacaggacctccagggtccgtcctactatccgactat

SEQ ID NO: 674724 - DNA, 156 bp, Homo sapiens
attcttcacatttgtagggtttctctccactatgaattatcttgtgtgtagtaagggatgagaagtacttaaaggctctgccacattcttcacatttgtagggtttctctccagtatgaattcttttatgtgtagtaaggacagggtaccgagctc

SEQ ID NO: 674725 - DNA, 387 bp, Homo sapiens
gtactgaatcatatttagcaagttcttcattaggatcaagaaaatgatccagtactaagtccatgctgtcacagcgttatgagagcacatatgcaaagtaaggcagtaagtacatagtctcactgttattagtgtcaaattacatcatttcaacacttccatgagaaacagattattccacatgtctggagtaatgcagacgcatatttctttgtgtgtgctgaagtttattcaaaagaagcctctgatcaacagcacaatagatcaacttcctttgacataggctttagtgcacaaaactatcttcataggtcaacaggggtaacattacatagtcccttaaaggtaatgtatgcatatgagcacaatcagatattagtgttgggc

SEQ ID NO: 674726 - DNA, 202 bp, Homo sapiens
gggcaggggggggcccccccccccccccccccttttgggtttctttttcccccctttaaaaggggggggcttttttttccccttttaaagggggggggggggtttttaaaccccccggcggggggccccccggcccccttttttaaaagggggttttttttccccctttttgggaaaaaaccttggggttgggtttttttta

SEQ ID NO: 674727 - DNA, 928 bp, Homo sapiens
tcgtctggggtcattgtgcggtcgccctgctctcacggcccttttgtccgcctgcgtgggtgtcccccagggccgcgttccccaaagcagggacttccacactggcgggcgccccccgcccgttgggtgtttgccccccgctttcgggggatccacccccccgtggctgtcggcgagcacccccttcttgtcacgagggccgccaccgtgtgccccagcacactgggggagaactgcttgtgccacccccggggagccgctgcttggtgctcgcgtgtggacacaattgctcctccgttgttctgtaatgctttcccgaactgagccccccactggtgtaataccttgggcacagcgagctctccaatcccgcgcgctggggccatccctttcccgcagtacgcccccccgtggtcctttcgcctgcgtggcgtcccctgtttttcaccatcgggccccctctccccacacagcgtgtcatcactgtcccgggctgacccggcgtgtgcaagtcattatatccgcccctccctcgggggagtcacccctgtggcgggtgtcccccccgcgtgaacaagacaccccggtgtcttcatcgccgaggtgcatcctcgtcccctcggatcccgcgagattctgtggggcccccctcatctccccccccacggggatcgatgctgccaggcgccacagcggtggtgccaacactatcgtgtgtcacgggtctgcgttgccacttgtatttggtgcgcacccccaggcttgtagtgcgagtggcagtccctcttacatgcgacggggttggggcgggaacgacgtgacgacgccccttggaccatcaggccccccgtcggccgtgcctcaattgagtgtccccaccccgcatcaaaaacaacaagttttccgaaattccccacccaacaaaaca

SEQ ID NO: 674728 - DNA, 695 bp, Homo sapiens
  misc_feature (614)..(614): n is a, c, g, or t
gcaagacctgtcgtcatctgattctcccccaggagcagtgtccctttcaattttcaaaaggaatatccatgcaacactcagttgcatacaactgtggatgttccgcagatgtaagacgactggaatgcaagccttttctcaaggtcttaatgagcaacagcaagagcagtctccagttacgaacagagagacttacaatacagcagagatttcctgtttgaagctctcaaggtgtttccatctgcagaaaaaaaccagaatttctgcctgatcatcccatggtactgcaaaaaccagaaaaaaccaaagtttaagtagcattttaaggaacagatgaatttacgtttggacatctgcaaatgaggtggatctagcaacaataatctgtaatgggacttgtgacaattcaatttattcttaattttgatggttggctatttgattctctaaaaatgcagaaagagctattttaaaatataacagaatttctaatcagtttcagctttgcaaggaggtttccgggcataaattgtgggaagtaccaccttggaaaataaggaatttggttagttgaagtgcgcagactgtatattcataattggcatactatttgncaattttttgttccatcacttgtaataatggatggaatgtagctgtaaagatctcaaatataaaatatttgtaggtgtaac

SEQ ID NO: 674729 - DNA, 108 bp, Homo sapiens
cagtccgtacagcatgaagcgagctctaccactctgcagatctcccccgtgtcttcctatgcagaaagcgaaacgagctgatggtgtgcccagccgactcacgacgag

SEQ ID NO: 674730 - DNA, 380 bp, Homo sapiens
  misc_feature (1)..(1): n is a, c, g, or t
  misc_feature (117)..(117): n is a, c, g, or t
natctcggctccacttggttgcgatcacagccacttgacggggttggcagggaggggaccaggaagtcagtggggtaggggtagtcatcatagccagcacggtgaaggcatccgtgngaacatgaagagctgggtcaggtccttctcgtctgacagcggctggcaggtgccgaactcccagcggagcgtgtcgtaggctccctgtaggaacaagtccttgatctgtcggaacgcttcccgcacaccctgggtgcatatgggactctggccctcaaagtccgccgtgacgtcccggaagaactggttggagtcgccgaggcctgccacagataagaacgggcgcgctggcccgccagggcccccggaaccaagtggggagg

SEQ ID NO: 674731 - DNA, 762 bp, Homo sapiens
agctgagtggttgtggtggtcgcgtctcggaaaccggtagcgctggcagcatggctgaccgactgactgaagagcagatggtcagaattcaaatgaagcgtttttcacatatttgacaaagatggtgagtggaagctataatcaacaagaggaagtgggaagctgtgaattgagatctcttgggcagtaatcccacagaagcaggagttacaggacatgattaatgaagtagatgctgatggtaatggcacaatgacttgccctgaatttctgataatgaatggctagaatggatgaaagacacagagagtgaagaagaaattgagagaagcgttccgtgtgttgataaggatggcaaggtatattagtgcgtgctagaacttcggcatgtgatgacaagagctgggagagaagttcaacagatgaagaggttgatgaaatgatcagggaagcaggatattgatggtgatggtcgagtatactatgacgagttgtgccaaatgatgtacgggtaaagtgaagagcttgtaacggaatgtgtttaaatttctgtacaacatttgtgtagttgcttttgttggttgtactgatcgtgtaagaggtttctggctactggtaaggggaaggtgctgtatagtagtgagggagttcattttccatgtatgttcccttatgtgactgtattgcttaaactttgtggaaatgttgtgtcattgtgggtggttatcgggatttaagcttggatttagggaaggggggcag

SEQ ID NO: 674732 - DNA, 542 bp, Homo sapiens
  misc_feature (191)..(191): n is a, c, g, or t
  misc_feature (327)..(327): n is a, c, g, or t
agggcccccttttttttgtatagggtgtggtggcgccccgggccttccccgcgcatctcctttggggttttctcctctggcgcggccttaggttttttctttcccttttccgggggacggggttttgggggccccaaagggggggggacgcgggtttttcccccggggtttttccatttcccccccccctncggctttggggggttttttttggccccccaacacccggggtttttcaaaatttttttaaaccccccccccccttccccaaatgggggggggggggggggggggggggggtttttttaaaaaaccctttttttttcnccccccaatccccgggggggcccccccccctttgttgttccccttttaaaaaaccggggggggtttccccctcgtgttttttttttggggggggggggggggaaaattttttccccgggaaacctttttccctttggggctttttttgggccccttttaaacaatttttttcaaaaaaacggggggggggcggggggggttttccggggttttta

SEQ ID NO: 674733 - DNA, 324 bp, Homo sapiens
tgtcagcttcacatgtcacagcactctggcctactcttgttcactgctcacactgctcctctccattcatcgaacttctcattgtccttttcctcttgttgcctggcactagggcaacagtcatgccccctccggtgtcatgccaccctgatactgtctctgtctacttccctaaccccatgctccctctcttggcttacaccactctcccaacctttaatcacagcatatccacacacaccctcccacttttcctatctccacccgactgtggccttgctacaccctattgcccatggcacacgaacctacaagattcttcac

SEQ ID NO: 674734 - DNA, 1046 bp, Homo sapiens
  misc_feature (407)..(407): n is a, c, g, or t
aacagattccttaacatagaccgtgagtgctcctagagctaacaaagacttgtcctatggactttatcgagtctaggggagctgatcaaccaaacacattgcataactccgataccaatcttgcttctgcatctgcaccgacgatcgaaaacaacggtagtgtgagctaatatctgcataattgggatgctcggtaagctgtgcacacgatgcgcgcacatctaaggttgcccttcaaaggaatgtcctggacaatgcctaaatacatatgggtccgatttcagctatactcaagtggatattactaaacgatccgactagatatagcgagtccaagcgagcagtacaccagtacttcgtcgacgagacagacttactataaaggattcagtacagataccatagcngaagagaaagctccttcaaataactctaagacgattcacgcatctagggaagtcaacttccatagtacgtatgatttatcatagcattcaaaatttcctcccctgcttggaaataggacaagcgaaatctgagcacttcattattaacgataattcagtcatctacccccgttaagaaatagaatatgcatactgctaagcctttacgttactttgaataaagcacattaattccaggcctatagtagacaagtggtggagcccacaagtacctatacctaaattacaaaaaaaagaccaaaattcaggatggtgagtgagtctctcctagactttgtcccataggtgtgagtgctgcatttttcccttgtggtagccctaagcttttgccgggactaagtgagggtgttccctatgaaaagagggacacccagttgccaatttcagactgtcttgtgccccttaagtgacctcttggacagctaaccttagcccataccacggtttaacctggcgagagctataatttgcgactggacccaagtaaagtttagtgcaaggtccccttgggactggtcatgaaaacacggtttcccgaggattgacatgttcttgggtagacaaaaagaaattaatccg

SEQ ID NO: 674735 - DNA, 202 bp, Homo sapiens
tgcggcgaacacaagatgagtttgagttgcaatggcgagtgcatcaacttcagcctgacctgctgacgggtcccccactgcaaggacaatgtcctgatgagaagccgtcctactgcgactcccgccgctgcaagaagactttccggcagtgcagcaatgggcgctgtgtgtccaacatgctgtggtgctcggtggccgcaag

SEQ ID NO: 674736 - DNA, 112 bp, Homo sapiens
ctcaacgctttattacttccgtcagctttatactttctcaacgctttatacttcatattatacttgaattcaatacggaagtataaagcgtgaggaagtataaagcgttgag

SEQ ID NO: 674737 - DNA, 570 bp, Homo sapiens
atcccagtacttgggaggccaaggcgggtggatcacctgaggtcaggagttcaagacgagcctggcaacatagtgaaaccccatctctactaaaaaatacaaaaaattagccgggcgtggtggcagacgcctgtaatctcagctgctcgggaggctgaggcaggagaattgcttgaacccggggagtggaggttgcagtgagccaagattgtgccactgcactccagcctgggtgacagagtgagactctgtctttaaacacaaacaaaaaagattcatggtccttagattagattggtaagcccacggggcaggtacggggtctaaggtccggtgtggcccctggtcacatggtcagaggctcgaataaaggtgtcaagcaaagctagaaaacaacaccaaaaaagaaagaagaaaaaaacactgctgcgcgcagcggcgccacacgcgcccctcaagaagagatcttcgacaagccacccccccggggggtgggcgccgcggggccccccaagcgcagcgcaccgccacccacgtgtcgcaaccaagcggtgtcaccccggagccacc

SEQ ID NO: 674738 - DNA, 441 bp, Homo sapiens
  misc_feature (276)..(276): n is a, c, g, or t
tccggagcacggtggctcatgccctataatcccagcactttgggaggccaaggcaggtagattatgaggtcgggagttcgaaacccagcctggcccaacaaggtgagacccccccccgatctctactaaaataattagccgggcctggtggcgcatccctgtaatcccagctactttacttgggaggctgaggcaggagaattgcttgaactcgggaggcggatgttgcagtgagccaatatcgcaccactgcactccagcctgggcaacagagcnaagctccgtctcgaaaaaaaaaataaattttaaaaactacacattgggtacaatgtacactcctcgggtgatgggtgcaccaaaatctcaaaaatcactactaaggaacttatccatgtaaccaaacaccacctgttccccaagaactattgaaataagaaaaaa

SEQ ID NO: 674739 - DNA, 388 bp, Homo sapiens
  misc_feature (155)..(155): n is a, c, g, or t
  misc_feature (357)..(357): n is a, c, g, or t
gtgcagctgatcaagactggagacaaagtgggagcagcgaagcaacgctggtgaacatgctcaacatctcccccttctccttggggctggtcatccagcgaggtgttcgacaagtggcagcatctacaacccgtgaagtgcttgatatcacaganggaaactctgcattctcgcttcctggagggtgtccgcaagtgttgccatgtgtcgtgtcgtgcagatgggctacccaatctgttgcatcatgtacccctattcatatcatcaagcggtgtacaaagcgatgtccgtggccgttgtcgtgtgagagacgagattacacctttcccatcttgctgaaaagtgtcaaggccttcnttggcgtgatccatcgtgccttgtgtggctg

SEQ ID NO: 674740 - DNA, 428 bp, Homo sapiens
ctatgtggcaggctagtctcgaattcctgactcgtgatctgcctgccttggcctcccaaagtgctgggataacaggcgtaagccaccatgcccggtttactgttattcatttactcaaatcttccacagagcgtaacaaaccagtcatgtgatcaagacagagtcgatggtttggggggtgagagttgttggagatctgctgcgggtgcccaggagtactggggtctcttccggggccctgatttgggtcggacttgtgagcggtcccgatagaggtgtgggacacccactggtttgagaataaagagtcgaatgacacgattggacgataatggtagaaaaatgtctaattcggtcatatattcgccgagattgtatgattgagctgaatatgagtgaccatggggcgtgaggtacccctcagggga

SEQ ID NO: 674741 - DNA, 1217 bp, Homo sapiens
  misc_feature (299)..(299): n is a, c, g, or t
  misc_feature (580)..(581): n is a, c, g, or t
  misc_feature (1188)..(1188): n is a, c, g, or t
gcctcactgatatcagccagcccaccatagtgtaggctttgctgatctatggaaacttggtgacaggctggccgtgctggcggtgccctcatcacagttgacttgagtcctctgctgcactgcagtcgatggcaactatgttgctctgggcgtcgtgtgcgaaggaccggcggttcagactggcggactagtggcaccacggggagtgcctcatctagctgtcccctcagtgcagtgtgcccatggcccccagggacagtgaatgctcgagcgaatggttgttactgatagcgtaatcncgatatcgcttgccgatggaatgccgtgccactagtagccataggaccaagggcatccttacgcactcgttgggatgcaacaccagtgttcaaacaagagcttgcggccttgcgacctagctcatccacttggggggagagagccttgtacccccaacctatgctaacgatgtggaaggccatggcccgtgtgagctttccagcagcgtagctaaggccttcttgcaagcctcgcatgggaaaccgaggcagccctttcattgcctgcagatagtaccganncctgggacaacatgacttcaaactccagacttgttttgttgagcatgaaccctcgcggagatgacaattctcggcagtcacactgttttcggggcgacgttcaatactccagcgccatcggggacctagatctcgcgtggctacacgaaatttacctcgcccggtagagcccaagttccgcgagtcagccccttgtgtgaaacgggctccccgaatgggaccttttgaacgagagcccaatcaacacgggaattgcgcccaaatcgggtcaggccacgtgcgtgggggttggcaacttgctcccatctccaacaatggctcaagtcctcattgtcgggatgcgctcacagacaagccaaggccggcaattaaggtcgcttccacgtatgcctctccttgggggaggggctcggaaccattggagcgccgtcacgcctttgagaacgggttcaatgcaccttttcgagacgccaaggaaggagcaggccgggcggattttttgaacgcaaggagactttgttcccagaggcccacattcccacccctgtgctgctcgcgacagaccgtggtggcgaaaaaatttcgggggtagtccggattgtgaacncacttatccacactcgttgaaacgcgaaa

SEQ ID NO: 674742 - DNA, 208 bp, Homo sapiens
  misc_feature (72)..(72): n is a, c, g, or t
tgcaagaattgcgacactcaagctcgaagtcacgccgcagatacgccggacggcacatcatcctcgacgtgnacatcaacaaggacagccgggggagaccacgcttgcgggatcgcgatcaccaccaagcacgtaaagacccaggtactgttcgagaacggcggcacggtggtaatcggcggcatcttcgagcaggtcgaccgggatg

SEQ ID NO: 674743 - DNA, 654 bp, Homo sapiens
  misc_feature (39)..(39): n is a, c, g, or t
  misc_feature (64)..(64): n is a, c, g, or t
  misc_feature (103)..(103): n is a, c, g, or t
  misc_feature (107)..(111): n is a, c, g, or t
  misc_feature (114)..(115): n is a, c, g, or t
  misc_feature (148)..(150): n is a, c, g, or t
  misc_feature (175)..(175): n is a, c, g, or t
  misc_feature (195)..(195): n is a, c, g, or t
  misc_feature (209)..(209): n is a, c, g, or t
  misc_feature (212)..(212): n is a, c, g, or t
  misc_feature (224)..(224): n is a, c, g, or t
  misc_feature (231)..(231): n is a, c, g, or t
  misc_feature (324)..(324): n is a, c, g, or t
  misc_feature (359)..(359): n is a, c, g, or t
  misc_feature (362)..(362): n is a, c, g, or t
  misc_feature (395)..(395): n is a, c, g, or t
  misc_feature (416)..(416): n is a, c, g, or t
  misc_feature (448)..(448): n is a, c, g, or t
  misc_feature (450)..(450): n is a, c, g, or t
  misc_feature (456)..(456): n is a, c, g, or t
  misc_feature (473)..(473): n is a, c, g, or t
  misc_feature (477)..(477): n is a, c, g, or t
  misc_feature (525)..(525): n is a, c, g, or t
  misc_feature (537)..(537): n is a, c, g, or t
  misc_feature (593)..(593): n is a, c, g, or t
  misc_feature (623)..(623): n is a, c, g, or t
  misc_feature (646)..(646): n is a, c, g, or t
aaaaaaacaaatttataaaataataaaaagaattaaatnaaaaatataaaatgtataaaagaanaaaaaacaaagaaaataaagtagtatatgcattccagtnttcnnnnnagnnacggggggggcccaagtaaaagctcttctaaannngcctgaatggggcaggccgggtganaaaggttccgggcctcaggnacagtgtggggggngcntgtttcctccgnagagccnggggggtgggggcagcaccagctcctagggcctccgggccagcggcggaccccaggccggcccaagcccgacgccaggcagaaccctttgggnggggccgtatctggccctccggggacggcagtganganacccccagaaatgtgggcttcagggctggccanagggtaccctcagaagcccgnagcttagtcggctttttttaggaagattttgntnagaatnacccaaacaggggagtncgtntggatcgagaggcgcagtgcttccagagggccgaagtgggtccacctntccctctgccantcccttgtagaaggagccgatttggaggtatgccgtcggggctccgagggtaccgnagggtggcggtggggccctcctgcaggggntccttgtctgactgagggttgtngaagggca

SEQ ID NO: 674744 - DNA, 161 bp, Homo sapiens
ttatactgtccacttccaagaataattatctcaacaggcaggttaactaatgtatttaaaacttagtttatttcccaaaaagtaaggctcttgtgcctcactagctctgatagacttgatagggagaagagctggtaacctgactttacctgtatgactac

SEQ ID NO: 674745 - DNA, 210 bp, Homo sapiens
tcacatagtgtagggattacagtgcgcctggcatataccagatttaaaacaataatctataaaagtgttactacctaaggacttccactcaagaagaaaaactacatagtacacaccaaacttgcagggtggtgagttactagatacgtctcctctaaatggaagcttacctagcttcagcaacatttctggaagaggtcagcgtagtgc

SEQ ID NO: 674746 - DNA, 252 bp, Homo sapiens
gtatctagatatccgggcgggcggctgggagtagaagatgaggtatgtggcagtaacattcctgggatgtcttgaccagaaccccagtgacaggcccaagaacggcaagaggacttggaccctggagctcagggccttgtgggaaaatgcttgctggcaggctccctgtgtgggtttgggaggttacggggcaccatattggaacaggtctggaagaattgagaattgtacggttccatttcttgaccgcaa

SEQ ID NO: 674747 - DNA, 320 bp, Homo sapiens
acaaaaacaaaaaaagtttacaaccacagctagggtaatgtttgccatggttcccagtcagctccaaacccatggggtgcaaagcccatttttttccaggcatctaaatgatagatacgggctatgaaatgctttattctattggtagcagcttatgcaggtgcggccaaacacaaggcttcaggacaaatggtacaaactttacaaggggggatctaaatttaaaatatgaaacataaaattctacacaaaacggataaaaatcaagcacagataccaggatggaaacttataatattccaggtgtgaagggaagtccg

SEQ ID NO: 674748 - DNA, 354 bp, Homo sapiens
cttaaaagtaaggttttcctttaaaaaaaaaagtcttgggaataatagctcccatgtattggagtcctttccaggcactattgtatggactttataaactttatcccatttaatccccccgtcaatgctttgaggtaggtatgattccccttttatatatgagtaataaaaaaagctcaaggggtttaatcctttatcaagggttttttttgcgaataataaagccagggtggcccgtcggctcctttagcctaacgttggtttccagtattcaaaaaaagttgattgaattcaaggttttttttccaggtaaagctatttatattttccaagcctaatgaaatgggtttttta

SEQ ID NO: 674749 - DNA, 570 bp, Homo sapiens
acacattcatttggcaacacaagttttccaagtcagggggcaccagttgctatcaccatcacatatcattgtcatcattccacatcctcaacaacattttccatttcatgcagtcatgggcatgtgttgtcatcatcggcttcagcccccacagttcacactgtgctcgcattcaaccacagtcactctcatcaccacacatcagctcacacagtcagcaccacattcaatgcatccagtctgtaactcagcagtgcacaccatcatatcagcacagcagcacacaaatcccaaactaccttctatcattcacaacacatcgcaatcaccaatcacagcaacacatctgccaacacagcagcaccccaacacatggcacacgtggtttctcgcgtcaacgacttgggcttacccgggtcaggccaaatatacacagcattttggccacacccgttacgcttattctccacacgatttacctcttatagcacacttctctacacactggatcagctcttatcgggcaccagcctctatctggatctttctcacagcctttggtgaacccaa

SEQ ID NO: 674750 - DNA, 118 bp, Homo sapiens
cagtagttgttaggtgttgggaatataggtaatttttttaaataatttactttattctctaatttttcctctgggtatgtagttatgcacaacaatggagacacacataatacactgt

SEQ ID NO: 674751 - DNA, 771 bp, Homo sapiens
tctaggctcggcgccttggcgaggggggcggggagagccgagaagccacacaaaggttccaccgaggctcgagacctagtagccttcggggtgaagccagggattacagtgcggagtggatttcgggagcgaaactccggaggttctgctgggtttgagatctgcctttcggggccggggccaagtactaaagttctaaccctgtcgcttggctatttccgtgccccttgacttccctgagcttaagctcgagaactctgcagacgctgcaagtgtctgttctttcctaggcatggcagcggctgtccttagttggctgtatctgagactctgacaacctagtgccctggcctgtgggcccttaggcgagatcttagcgcaggtggtaccctgtgttcacgggaagtcgtgggcggcctaatgctggcttgggttctgagtagttcttgataccatggtgggaatgccctgtggtactcagtctagtggtggaaggcggcgcaaagttaaaagtagccgtgggtcagttctgctggagtgccgcttcctcctaacctccgagcagtttgtggccctggggtcgccttcgttggtcttgacttattttaagagctctgtcctggggcagggcttggctactggcgaggtgctcccacctgtcggtacccttggagttccaccattcgctgctggggttcgcggtcgaagcatcgtgggtccggccacctgtgcagagctcgttctggcgttcgctggattgcgacggaggcc

SEQ ID NO: 674752 - DNA, 151 bp, Homo sapiens
  misc_feature (29)..(29): n is a, c, g, or t
  misc_feature (101)..(102): n is a, c, g, or t
  misc_feature (145)..(145): n is a, c, g, or t
gcggacccgcgggtatgtcttacgcagtnatgcactcgcaacctattttggtgacataaaggtaagcttgagtttaatgaaagtactcaaactatgggttnnacgggtcgagaagattatgtactctttggcacgtaagacatanccgcgg

SEQ ID NO: 674753 - DNA, 846 bp, Homo sapiens
tggaaaggagtctcgctctgtcgcccaggcttgagtgcagtggcgcgatctcggctcactgcaggctctgtctccggggttcatgccattctcctgcttcagcctcccgagtagtcccaggagtagctgggactacgggtgcccaccaccacacccagctaattttttggtatttttagtagagatggggtttcaccgtgttatccaggagtggtttggatctcctgacctcgtgatccgcccgccttggcctcccaaaagtgctgggattataggcgtgagccaccgcccgggcaaattttggtattttatagtagagatggggtttcaccgtgtgtggccaggatggtctcaatctgaccttgtgatctgcccacctcggctcccaaagtgctaggattacttggcgtgagccaccactcctagccttaatgcatattcttacatatacaacaggtcagatttgttattgaacaattgcttgggggctataataacctaccttttacgactgagaacccggctgggctaggggaatacagtatgatcaagcttggaccctccaactgtgggctggactcctgatatatatacatgggatctctccggaactctggcactgcgaatagacaccaacaattcgtgtgaacctatctgacctatctccggcgtatatatggcaccgtacaagcgctgtgttgatacgtatcactgttcccctgtatactgctatcactgactctgcccacctaccactatggccaggagttaacacacgcctttagcccactgtaccataagagcaaacacagtgaaacggccccttggtatatcctctttgctggc

SEQ ID NO: 674754 - DNA, 174 bp, Homo sapiens
ccaggcggattttagagaatcccggtctcaaggtggctacagcattttttgagcctatttccgccccagggcaaaggtgtaatctgggcatcagggacacctcggcagaagcgagactttgggtacggcttgttcttacaataccggtaacaacgggcggttcttgcggccgca

SEQ ID NO: 674755 - DNA, 252 bp, Homo sapiens
aaggccatcccagcccgacccacgtcaagcgtccacagtccaccatggagtcacgcgtttgacacagactgcgtgaaacgctggacggttctcctgacagcaaagtttcgtattattcaccccgtgagtgtgcactacatgttgacccttttcacaacaagtcccagcgcaatctgggatatcactgcaagaccagaccatgcgacgttcgtcacgtgaggagattgaacgtccgaggaaattaatgtggcg

SEQ ID NO: 674756 - DNA, 513 bp, Homo sapiens
  misc_feature (181)..(181): n is a, c, g, or t
  misc_feature (258)..(258): n is a, c, g, or t
  misc_feature (263)..(263): n is a, c, g, or t
  misc_feature (280)..(280): n is a, c, g, or t
  misc_feature (301)..(301): n is a, c, g, or t
  misc_feature (317)..(317): n is a, c, g, or t
  misc_feature (349)..(349): n is a, c, g, or t
  misc_feature (361)..(361): n is a, c, g, or t
  misc_feature (386)..(386): n is a, c, g, or t
  misc_feature (396)..(396): n is a, c, g, or t
  misc_feature (477)..(477): n is a, c, g, or t
  misc_feature (510)..(510): n is a, c, g, or t
aattcgcggcccgcgtcgaccgagaagacgacagaaggggagcgccgattccgcgggaagggccctgggacctcacacttctagtcgcgggagctgcaggtcttacccggagagacgctgcacgtggagccctcgccgctgccgttctcagccggctctggagtgcgggcgggggcgacanggccgattccggagtgggactgatcctttgaaatactccagccatgactaaaagagaagcagaggagctgatagaantgagntgatggaacagagaaancagagtgcacagaagaaagcntgtagaacaaacctangcgccactgaatgtgtaagccagccatagacntcaatgaaccanaagcaattaaagaaactgctagaancaagactacntgtcttggtgctcatgaatttgtctgctatccagtggatccgaacgaatttatttgaccaggatacgatggaatgtacacntagtgtacagtaattctaccaggaatgaaccanttc

SEQ ID NO: 674757 - DNA, 438 bp, Homo sapiens
  misc_feature (86)..(86): n is a, c, g, or t
ttacacctttaatattaggaatttagagacaaagatacatcaaggagttatgttgacacccaaaggagtctttgtattttagaatncaagtaggaagtaaaactattcttcacactcccctttgttttaaaataccctgatctttgaaatttcaggatttttccccttagattcatgctcagaagccttgggtactattgtcagaattgctcctttcaaagtgtcttagtactgaagtacttatttattatgatggcattgtggaaatgattgttttgtgttaaggaaattaagtggccttgtctctactaataattgaaaatgtgaatgaggttttcttatggaggctgtcttactgcttagacttaccctctgttggtcctgtgattgatggcagaggtgtagttactgaaataaacaacctgttcttcctcttta

SEQ ID NO: 674758 - DNA, 278 bp, Homo sapiens
  misc_feature (44)..(44): n is a, c, g, or t
  misc_feature (51)..(51): n is a, c, g, or t
  misc_feature (78)..(78): n is a, c, g, or t
  misc_feature (132)..(132): n is a, c, g, or t
  misc_feature (143)..(143): n is a, c, g, or t
attgcctcacgggtccccaggacgctcaccatttcttgccgtgntggcggntctgttccgagtcatggtgcaggtcgnagtgggggaagtaggtcttggtggaggggtagacggtgaacatcctctccaggncctcggccccnaagtcctcctggtgccccagcaccttctcccacacatgttggatcagctgcttttcgtcctcggtcagcatggcggcggccaagggtctgcgctgggctggctgccccgcgtactctgcgttgttaccactgctt

SEQ ID NO: 674759 - DNA, 114 bp, Homo sapiens
ctactcagactcaggtagctgaagtggacagatcactggagcccaggaggtcgaggctgcaatgagctgtgatggcacccctgcaccccagcctggattgactcaggtggtgtg

SEQ ID NO: 674760 - DNA, 617 bp, Homo sapiens
gccatggtctccccacggatgtgcggggtcctctcccagagtgtgatcctagcgctcattgtcctcccccagacacggcccgctggcgtgttcgagcgtgcagatccagtctttcgggccgggtccatggcccgtggggcccctgtggtccccgctgctgcgcccggcgtccctcgtgctcggcctgcttcttcacgagtctggtctgaaggcctgaggctctcgagagtgaggcctggcggagtcgcctcggtgcagcctcgtgggctgctggtgcttgagttgcgcgcgggacctggtctagcgactcggatgccgccgcgggatgcgctcactgctggcctgggatcattctccagttggttcacggaacaaggtcctcattggcaaagagttggctcgccttcttacccagggtggatcggtcccatgtgtcgcgttgaggcagcacgtgttccttccttgtgtgcaagtgcaagttactgggaaacaccctcgtggggattgaagacggggcaagtctccatggggacggacttcgacggcatttggtgccatggggcgcctggctggacattggggattgtcccatagtgttgctaggtgtttccgggatg

SEQ ID NO: 674761 - DNA, 555 bp, Homo sapiens
  misc_feature (9)..(9): n is a, c, g, or t
attcgcggncgcgtcgacccctcaggctccaccacatccccagatcaaccatcatcatccaaccccaccacaatgacacctcaaacaccaacctcaacactagaattgactgcattatcttcagcatcaacatcaataccacaaaccaccacaacaccatctctaacagcagcctctactttaggctccaccacaccaccagatcaaccatcaacatcagaacccatcacagcatcacctcaaacattcacttcaacatcacagtctacggcacaatctttatcctcagactcagtgacaatcacaacacaggcttcatcgtctgtctctaccttcccttcatctacaccagcagatccaactcaaacatctgtttctgtatccgccacaacaccagctctatcatcaccagccccctcaagctccaccacatccccagatcaaccatcatcatccaaccccaccacaattacacctccaacatcaacctcaacactagaattgcctgcattatcttcagcataaacctcaatactacgtcgacgcggccgggaa

SEQ ID NO: 674762 - DNA, 955 bp, Homo sapiens
gatataattagttgttagaagtaattactaacttctacatttataattgtgagaaaatgctaaaagatatatatatgaaaataagaatgttgataattggacttcaggagtcccataaagccagcgttcaacaattaccaaagtgtgaccaatcattctacagcacatgcgacaggtgtgcctcagtatctgtggtggcattggttctaggaccacttatggataccaacatctatggatgctcaagtccctgatataaaatggtggactatcggcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaatttttttgtgtgtggaatattttcattccaagggtcagttgaacccatggacataggaggctgactgtgtgtgtgtgtgtgtgtgtgtgtgtgtgtgtgtgtatagagacacatatattgtgaaatgtaaatattctcttgtaaaaagttttttctcagcgtaaagattttacgagttattcttatatgcttatatacggggggtaagattagagaggggctcataatttgaacagatttatggaatggacaaaatatgttagggtaatgtagaacaacctcaagcccctataagggttctattgaccccctttttaataaaatcgtgtattggtgtcacaagagcatgtttcaaaatgcggggctgatatgcaatgtgttcatgtacacggccctatccggagggagacagaagtataacagtctttacaacgtaaatacgacattatgttgaaatgtgaaaccaaatgactaataatgaacaactacaatttcgagaaaaaagggattcggctagttatacatgtcatattc

SEQ ID NO: 674763 - DNA, 575 bp, Homo sapiens
  misc_feature (57)..(57): n is a, c, g, or t
  misc_feature (433)..(433): n is a, c, g, or t
  misc_feature (502)..(502): n is a, c, g, or t
aaagctggatctcagcgaggggctgtcattgccacggagctgaagaacacagctccnagttggcccggtggacctgctgtgctttgctggctggatctgagtacctcaagcttggttatgtgtgtcggtaccacgtgaaagactcctcacgccacgtcatcctaggcacccagcagttcactcctaatgagtttgccagccagatcaacctgagcgtggagaatgcctggggcattttacgctgcgtcattgacatctgcataagctggaggagggcaaatccccccccttctttcccaaattaccctccaaagggaccccaacaagcaggtcatccgtgtctacagcctccctgatggcaccttcagctctgatgaagatgaggaggaagaggaggaggaagaagaggaagaagaagaggaagaaacttaanccagtgatgtggagctggagtttgtccttcccccgagactacgagggcctttgatgcttagtggaatgngtgtctaacttgctctctgacatttagcagatgaaataaaatatatatctgtttagtctttcaaaaaaaaaaa

SEQ ID NO: 674764 - DNA, 546 bp, Homo sapiens
  misc_feature (10)..(10): n is a, c, g, or t
  misc_feature (77)..(77): n is a, c, g, or t
  misc_feature (158)..(158): n is a, c, g, or t
  misc_feature (167)..(167): n is a, c, g, or t
  misc_feature (210)..(210): n is a, c, g, or t
  misc_feature (487)..(487): n is a, c, g, or t
  misc_feature (531)..(531): n is a, c, g, or t
acttgaccgntctgagctaagcctagccccatgccccactccaccctactaccagacacccatagccagtccatttncccaaattaagtataggcgatagaagttgaaacctggcgcagtagtatatagtaccgcacgggaaagatgaaaaatcatgnccatgtatnttatagcaaggactaacccctataccttctgcataatgaattnactagaaataactttgcaaggggagccaaagctaagacccccgacaccagacgagctaccgaagcacagctaaaagagcacacccatctatgttgcaactatagtgggaagatttataggtagaggggacaaacctaccgagcctggcgatagcttctttgcccaagataggatcttagcttcacttaaatgtggccacagaaccctctaagtcccctggtaaattataactgttagtccaacgagcacagttctttggcactagggaaacacctgngagagagtacaaatttccaccctggcgcctaaatgaggcacggntagaagcttcaagtc

SEQ ID NO: 674765 - DNA, 388 bp, Homo sapiens
ctgcatatcctagcaatgcatcagctgatcctcctgttggttgtctgcagccatctaacagatcatcacggtcaccacatgactagttggtagtctctgaagtcctaactaaagtctgcggtgtgtggttcacagcattctgatctggacttgcttagtcccgtgtagtactgtacttcattcacgacatcaatggttctgcaagcatctgctgtgcccttgtctctgattgagctcgtctccgtgtcccgtctgatatcaatatgataggtagtcacagtctcagcctagctgtgcttgcctcattctagacagttttatttatctctccacagaacctttaacatggtgtcatcacttgagcttccctctctagcgtacagctcac

SEQ ID NO: 674766 - DNA, 1104 bp, Homo sapiens
ggcaaagagccgaggcctgggcgcgcgaccctcgtccttctgcccctggccgcacacttatgcgcaccatctctttttctgcatggtggatattatatattcattatcctttactagggtgctatgtggtgatcattccaagaagaagcccgggacggacatgtgcgtgggcatgcgggagtcacgatccacgacccagattcatcctgcgggtgctcgcccgacatcgagtggccacgcggactgcctcaagtgtgccgcagtgcagccagtacctggacgagacgtgcacgtgcttcgctcgagagaccgggaagacctactgcaagcgggactacatccggctgttcggccactcaagtgcgccacgtgccaggtgggcttcagcagcagccgaacctgcgtcgatgaggagctgctgggacagcagtgtacccacaatcacgtgctttccgcatgcctccgtgattgcagccagccagctgcatgcctgaggaccgacgcttctcgccttgcagggaagacacgacgctagactcatagccgagccgacacacggaaacatcactggatcagagaacgcgccgcaagcctggaagaccacgcgccaggcacacggaccagctaaccccggcgcacgcaagaactgcactctgccccgaacgcctgggaacaggacccggcaggccagaggatagcggcccaggaaggctgccacaaaaccgaacacggaacaagacccgaccccgcgctgccgggaaccgatactagaaccgagcaaacaaactgtaaagacatcttacggacacgcctaacgccggccaaaaccgaggacacagcacgactcgcaattgacaggcgcaaatggtgctagccaagaaccgtgcatatacccaacgggataacacgaatcttggctaacaaacctcagccgctgccctagacaagaagaaactcatacttccgcaacacaagggaccacaggcacaacgaacaaaccaactaacggacgacaggcagccctgagtaagggaacccacccgcaagcaaccccaagtgacagaagtgcgtgcaacctacacacgcgaatcgacacaggaagga

SEQ ID NO: 674767 - DNA, 867 bp, Homo sapiens
atacaagatctccgcatgatgaaacttcggatcactcctggcgcctgcctgatcctccgaatgcatcataggactatccctaggccatgccactaatcaccagacgcctcaaccgacttttcatcagtcgcccacatcattcgagacgtaaattatggctgaatcatccgctaccttcacgccaatgggcctcaatattctttatctgactcttcctatcgcatctgtcgctgaggcctatattaaggatcatttctctactcatgaaatcctagatcacatcggctataatcctcctgcttgtcaattataggcagcagccttcataggctattgtcctcccgtgagtgccaaatatcattgctgaggatgcctacagtaattaccaacttactatccgccatcccatacgttgggacatgacctagttaaatgaatctgacgagatggctactcagtgagacagtcccatcctcagacgattctttaccttacacttcatcttgcaccttcatttatggcatgtcctagtcagcagtccaactcctattctatgcacgaatagggatcaaacaagcccctaggaatcacctcacatttcgataaaatcacctttcaaccttactacaacaatcaaagacgccctcggtaagttctcgtccttctctcccttcatgatcctaatactgttctcaccagaactcttaggcgaccccgaaattataccctagaccaatcccttaaaaacccttcccaatcaggccgaatgaaattcgtatgagctaccaattgcccgaagcgccctagaacgagaggggctggccatttttcctctcttaataccctcctttttccaaagaaattggc

SEQ ID NO: 674768 - DNA, 141 bp, Homo sapiens
  misc_feature (98)..(98): n is a, c, g, or t
cacatgtgctgagtgaaataagccaggcacagaaagacaaacactgcatgatctcacttacatgtggaacctataaaagctgcccttatacaagtaanagagtcaaatgctggttaccatgggctgggaggagagggactg

SEQ ID NO: 674769 - DNA, 247 bp, Homo sapiens
agtgtcgagcacatggcaggtgctcagtaaaaagttctaaatgggctgggtgtggtggctcatgcctgtaattccagcactttgggagtctgaggtgggtggatcaggaggtcaagaggttgagaccatcctggctaacacagtgagacaccttctccactaaaaatacaaaatattagccgggtgtggtggtgggcgcctgcagtcccagccacttgggaggctgaggcaggagaatggcagggag

SEQ ID NO: 674770 - DNA, 112 bp, Homo sapiens
tacaagtcccgcggtacaccgtctcgatgatgtccaccatctcctgcttgtcttcatggctgatgttggttgtcgtttttaagcccaatgcacagtagcggggccttgtacg

SEQ ID NO: 674771 - DNA, 331 bp, Homo sapiens
caggccccgaacaatcctcatacagatcaataaatcaaaattgccagaataagcattaaaaaaaacttacgttgtcagtaagaaaacaccttcactgcatctttcaaatgcttttcttgctgctggtttagaagcaaattctacaatgcctttcccggtagatcttccacgatcatccacaattacaacagccctttcaataggaccaaactggctaaaggcttcttccacacagttcattggaaacataaggtgaaagatttcgaacagaaagggcagcagcatgtgtggcaaatcgaacccgaagctgtctaccattgtacggggcctg

SEQ ID NO: 674772 - DNA, 159 bp, Homo sapiens
gtagggggggggcactcaccccccgtttttttttgtcgggggggggggtggtttatttttcccagggttttattttccttttgggcttctggaccgtttttttttgtggttttttttgggcgccgggccgggtccccctttgggttttttgggggtgtc

SEQ ID NO: 674773 - DNA, 1446 bp, Homo sapiens
atttgtttattacactttccaataaatttattctgtaaaaacaatacatttttttgtttttggatttttttacagtaaacttttcaactgacagaaccgggaataccgcgaaaagatgttccaagggacaacgcattaacaggattggataaaacccaaactggactaaatgtggttctcacaatataacgctgggctattaataaatcaaataaatatgtctgcttatttatcgccaccaatgagcaacagatatatggtgaccactattacataatgggtttaaagggtatgatattattaacttattctcaattggtgagttcccaaaaggaaacacgagtgtgttatttctcaagagatgtctacaatattttgaaagatgtcaaagcgcgttgggtgcgtgaggtgtctcccctatagagggcgtgagtgagggtggatatcccgagctcttcaacatatgggtgtaagagttatcccaaccttgggagtggcgttaggctcaagaacatctggtgttttggcgccactggggggacaacacaatatcaacatcccattgcgcgccttataatattgcgggggatgtaaaccaccaaaaacaggactcccacttaaactttccaccttttatctagcaaacacttaagtctttggtgtgtgcaccatttaaacacatctttttggacacttttggggagagcacaaggttatcaaacgctgtgttccaaactaaagcataaattttctaaaatacgcggggaaattccgcattctttcttcaccccatttctgggggtgcaaaaaccttttcaacaactttggggggcttcaaaaaagctgggccaggcgacaactctgcaaaatttctgcgctctttcacaatttattaccccaacggtatatggtaatctggagggcaacttcaaattccgcgggggtttcgtggtcaccagcagcgagggacaattctcccatgtttctttaaaggcattaatcggcgtggaacgagggtccttacttaaacaaaactggtctcacattcattattttaacacctcggagtggtcaagaagcaagggggcggggccccagggccggacacaaccgcgaggaaatcccaaactggcgctgggaccacaagggatccctaaacacgtggataacagactggcgcaaaaaaccgtggagaaccacctagagggagaaggaggagcaacaccgggagcgcaaaaacaagctgaactacacagaaacgttactaaaaggcgagcaatagcgatgtcccccccgaaagactaacagagacagaacatcatacgaccaccaccgggggcgattgcacacaaccacacgagcatcgcgggcttacaagccaccagattaacaacaaccagcgcggcacacgaacgaacgcacaccacctagacccaaagagagcat

SEQ ID NO: 674774 - DNA, 136 bp, Homo sapiens
aacattattaaaatggtcaaatgtatgttacatgtatttaccacaataatataaaacatttttaaaaggaagtattatagtgttgaccctattataaaggaggatggcagtcttttagggcattataattaaggat

SEQ ID NO: 674775 - DNA, 1502 bp, Homo sapiens
ggagaactagtctcgagtatttttttttttgttttggaaaaagtcatggaggccagggggtgggcttgaaaccacgcttgggggggttcgattccttcctttttgggtctagaattataagtgttatacgggtttcttcgaaagtggtggtggaaggggtggggggcaatccatcataagtcacctccgagggtaatatggaaggcgtacctctctcatataatataggacactatttcgctatcgaacacgcgaaaaggcgcttcctccaaacattcgagtgcacaactatcttatataacttatctcacgtggcgggttagacagccaaagtgcacagtgcacccttcacgagcagtgtactgagcgaagtgctttaccagtgtgtgcggcgcgtagtgcacaatgcgcggcggatagcctcccaaaagtacacagagtaacgagggagcaacatacacgcgggcaataaagacgccccgcaagaaacaacgcgagcaaccggggggcgacaaaacacaacagctacaacgccatcatacacagccggcgcgaactaacacccagaacagacctacaggaacgaaaaccagagggcaatcatccaggagcaagaccaacacgacaaccagcgcaccacacaccgagcgttgcagtcaaacgaccctgagagaacaacatacagcgcgacgaaaaaaccacaccgagagaacaagcgacacggcacacccgaaccagccacggacagcaaaaaacacaacgcccacaacaaagcacaacaagggaacaacacaccgaccgaaaccaaccaacccacccacgccaagaaacagacaccggttgaaaccacacacgcaccccccacacgcacagcacctcaaacagcgcccaaccaacgcagaggcaacaaacataaccaaagacgccccacacaaaacacaaccccaaccaaccgggcaccaaacgagtcacacagacgagcaacaacaccacccaaggccaccaaacaagcaaaaacccgaccccacaatcacaaccacaacacaaatgcagccgcaaaaaggggccacgaaaaaccaaggccacagacaaaaacaccaaaaagaaacacccgcggaagcgcgaaaaggaaacgcaacaacagcgaacaaacggagcagcaaaaaaaaacgacacccaaaaaaacacagcaacaccaccgcaccacgacaaccaacaaaaggaaagagaaacagaaaccaagactagcagcaagaagcacaggcgacacagaacacaacacacaaacacagaggacgagagaaggcaaccaacacccaagcaagcaacaccctgcgacgaaacaaagagcgaaagcgcgcgcaaccgagacaaccacacgcgagaaagaaaagagcacgcagaggacacagcacaaccaagagggcgaagcaacaaagcgcaccccaaaacgcaacgaaaacacaaaaaacagcagacggccagccggccacaaaaaatca

SEQ ID NO: 674776 - DNA, 198 bp, Homo sapiens
gcagaaagagcttcccctgagcctcaggaatgggtccctattatccagcaggacatacagagccagcggaaggtgaaaccgcagcccccacagagagagcgtcaccctgggatccttgggctgctctcactcccggggtcccagcagggcaaggcctctgattgggaccagtgctgctcttcctcgctgcttactcca

SEQ ID NO: 674777 - DNA, 370 bp, Homo sapiens
tttttttttccagaaatgcttttccttttatttcagaagaaaggacataaaggcagacacttccccctcccctaaaccatgcacagaaacacggacctgaacaaccagcactaggagtgatgaaagagcccagcgctcatgagaacaagcgactgcagataacaaggattgagcctggagctccagaactacatcaatcgttgacctccacaaagtggactaggacatacgaagacgagaacgccaacgcagaagacagataacacctcacccgaaggaacaaggacggactagagagcgtcacaaatgtcggagagaccaaagcgaacgaacaacagacgggcgagacaaggagaacaccactagcccg

SEQ ID NO: 674778 - DNA, 147 bp, Homo sapiens
ggtaccgtttgtcgcgcacgccgataaagccgtgctgcgttgccaacaaggcattgctgaccgcaacgctttacgttcggcggcgggcgattgcgctccctggcgcatgaggctttgaactcggcgcagatcctgagcagataaagt

SEQ ID NO: 674779 - DNA, 130 bp, Homo sapiens
catcggtgacatctgtcacacgtgggcgacgtgcctggcctctgtagcaagacagtgcagcttcaacgctgctcaaaggtcaccaaggtctgccgcgctaccaagaagccagttccagaaagtttctgag

SEQ ID NO: 674780 - DNA, 98 bp, Homo sapiens
gggggggggccccccccggggatttttaacccaagggcggtttttttaggggggggggggggggccccccaaaaaaaccccctttttttttttgggga

SEQ ID NO: 674781 - DNA, 214 bp, Homo sapiens
tgccataatatctggacaagatcgacgtgatcacgcaggctgacatatgtgccgagcgatcaggacctgattcgatgacgtgatctgacttctggaatcttatgagaaccaagttccaggtggacaaaagtcaaactatccacaatgtttgacgtagggtggccagacagcgatgaacgaccgcacagtggactccagatgcttcaaacgaatg

SEQ ID NO: 674782 - DNA, 146 bp, Homo sapiens
ctattggtgtgtccagatgggtctcaatgtctggggctcaagtagtcctcttctcttggcctcccaaagtgctgggattataggcgtgagccaactggtacctggcctaagtacttttttgggggggggggagggagtttcgctct

SEQ ID NO: 674783 - DNA, 903 bp, Homo sapiens
agcggagcgccgcctggcctggcccggacccggtcacggtctctcacgctgctcgtccctatgtgggctgtgtttgtccttgtcccggcggtagtcctgcgccttcccatcgccggaccctggcaacgagacaagacgagcaaagtcttgcagtacggactgccggagagaacgacaaataagagtgctgcctactctcgtgggcaacttttaccagtgttcacatctgtgcacagaatatacgtagaaagagaccagaggatgagaagagtagaagaaaagcaaagttgcactacatccggggcccccatgccatgaagggtggcacttagcggtggacagctttcattaaacgcactatacatgagctagcaagaattctacctgcctagtaactggtttaattatctgcagatcaagttgggtcttcactcaatttcaattctcttctctttgcagtaaactgacagattcagcactttggtaatacttattgcccttaaggtgctatgcctaatcaaaacgtttgtatttttccaatgccttaggagatactggcctacgagccttttccagttacaattacctgaattctttcctatcctgaatgaccgagaactaaaagacttctttctccccgcgcggctgagacctcccgggccattccgggagtcctggactcctttccggggcgggcggccccggttcaagcccatcctttcgcgtggtcccctcttgttgaggaagcggggtgcttcaatatcctccgaggagtgtatgagccggggtcactcagtgggcgtcaattggacgtcgcttgcccctctgcgcggtgtgagccattgggcttattccccgggggcgctccactttccccctcgcgttgattccgccgcgcgcaca

SEQ ID NO: 674784 - DNA, 142 bp, Homo sapiens
ggtttgaatggcctgatagatgacgggctcccctcctggcccctcccagcagtcctgctccacgcagcggcatccctgggcaaaggccctaacataggcctcggtgctgctgggcccgccgatctgtgagtcagtcagatag

SEQ ID NO: 674785 - DNA, 624 bp, Homo sapiens
gcccggccgcggtgctcacgcctgtaatcccagctctcagggaggctaagaggcgggaggataagtggagcccccaggagttccgagacctgctttgggcaaattatagcgagaccccgttcttccagccaaacaaaacgaactaacaaaacaaaacacaaaaacaatcattttttgtggggccgcgacctttcgccccctcggaaaaaacgcttttttagaaaacacaaatctcgttttgggtgggggccggacgggcccacacaatgtagggtaacatagtggaacacaccatgtggcgcaacaaagggctggtgccccaaaaagaggaacaccccctgtggggcaacaagaagaaacaagacgtctggcagagggagatccacccaaccacaaaatataaagagacggcgccgcgagggagaaaacaaccagcgatggtttgtttctgagacacaacctcccacagagcggagagcgctctcgaaggcgaggacaaaaaagggacggaaggaaacataactatacaaaagcgaaggggtgaagcccaccaaagacggaaggcgcccatcataattgatcaagaagatatgcacgccccccgctggcgtcgtgtggagcaga

SEQ ID NO: 674786 - DNA, 144 bp, Homo sapiens
actgatacattcatctaatgtgggatatctagaacacttaactcacttaaaacgtcttccaacagatgtggatgtcctttgaatgcaaagaaaacattcgtacattatttggaagacttttaagtgaagtgattgttccccgct

SEQ ID NO: 674787 - DNA, 169 bp, Homo sapiens
cgtcgaccttctgctctttgtaaacctctactgaagagttaagtatataaaattaattaatgcagaaagtactctatatctcatctaatacttgatgtaatacatattataaactatttatttatttggtaggtacagcttttttatacacaaaaatagattagataaa

SEQ ID NO: 674788 - DNA, 550 bp, Homo sapiens
gattcagaggatccccttcagcacataagtaaatatccacgggggtaaaatataacctaaacttaatatgactttctggaccggcggtaagttagagaatattaatcatataagcaccatttcccggaattgttggtaactacatatttaatcttacggtcactatggtgtaaaatcttggaaaggaaaaggaatacggtgtaatagttaaccccatccataaggtggcattagagtgtcagccaaaggtgtcatacatcaaatctccagcagctttcgcataatccaggagactggattattagttaaggctaatttggccagtgaaaggtagggaaagaaaaaggttggaactttaaatcatccagatagctaaatccttactcctaaaatttaaaccccttaatccggtcggtagtggtaatatcaagacttttggatagtcatggaaacggagtaaaacttaatccagattacttaaaaacagctttcccgggggtgaataccaccttaatttggaccagagtatctaaagcaacaaaagtgcgga

SEQ ID NO: 674789 - DNA, 241 bp, Homo sapiens
  misc_feature (203)..(203): n is a, c, g, or t
  misc_feature (232)..(232): n is a, c, g, or t
ggcggatcacaaggtcgggagattgagaccatcctggctaacacggtggggccctgtctctactaaaaatacaaaaaaaagaaaattagccgggcgcggtggcgggcacctgtggtcccagctgctcgggaggctgaggtgggagaatggcgtgaacccagggaggcggatttgcggttgagccgggatcgtgccatttgcgntccagtcttggggcaacagagcaagattncgtctttca

SEQ ID NO: 674790 - DNA, 838 bp, Homo sapiens
ataggttggtctgaaggcgttccaccgtgatgcagcctggaaacctatgcctgcctctttttatgcatagatcgacattttcgtaaaatgattttctgtgtaccctgaaaaagtgatcagtcttagtttgaacactatgttatttcgagaaagacttgatatgtggtatatggtatcactcatagaagatactcaataataagaaagcaccaaagagaacaaccaaaggaggggcagaaaaaaggaggacaaagagagaagccatatacagagtagcagcaaaaactagacccctgcacagaaaagcacagcaaccgtctgttatgctggtggacacatggcccctcccccgtggcaggagcttgggacctaatccaagcatcccttgcccagaaagaagatgggggaggaggcagtaataaaagagatggaagtatttgctggaataagttcaaattcttctgaactcaaaactgaggaatttcacctgtaaacctgagtcgtacagaaagctgcctggtatatccaaaagctttttattcctcctgctcatattgtgattctgccttggggacttttcttaaaccttcagttatgatttttttttcatacacttatgggaactcttgctttgattttgggcctcttccagtcttcctgacaactttaattaccaacctgttacctacttgtgacttttgcatttaaaacagacactggcatgggatatagttttacttttaaactgtgtacataactggaaaatgtgctatactgcatacttttaaatgtcaagatatttaatctttatatgagaaatccttaggaaaggctttgg

SEQ ID NO: 674791 - DNA, 192 bp, Homo sapiens
ccagtcgtttctaccatggaacagtgtatgtttaagaattagcagaatatcttagctcattattagactgtagctatagaaaagctctttgaaatcttatcacttgagtatcagatgtatgtgagaaagcatatggaagtattttcataaactgtaaaggtattatataaatgttattatggagaaccgact

SEQ ID NO: 674792 - DNA, 252 bp, Homo sapiens
ggcccccccgggcccccttgggggggtgggggggggaaagggggttccccccaagggggggggttggggggggccgatttggggccccgccccccccggggggggggggggggggaaccccgtttccaaaaaaaaaaaaaaaacttggggggggggggcccttttgttttttgaaaaaaacccccccccaccccccggggggttaagggggggggattttcccaaaagggaaggggttggggccggggtcca

SEQ ID NO: 674793 - DNA, 197 bp, Homo sapiens
atagagacagggtcttgttaggttggccaggttggtcttcaactcttggtctcaagcagtcctcctgcctcagcctcctaaagtgctaggatcacaggcataagccaccatgcccagcctctttcttccctcccctcccctcttttccctttcttcttctcttcccttcccttctgtcgtcttataacagccgtata

SEQ ID NO: 674794 - DNA, 338 bp, Homo sapiens
taatcgttgaacaaacagctttaatagcggctgcaccatcgggatgtcctgatccaatcattgagatcgtaaacctctatgttgatatggactctagaataggattgcgctgtaatccctagggtaacttgtaccgtaggtcaagttattggatcaattgagtatagtagttcgctttgtctggtgaagtcttagcatgtactgctcggaggtaggagtactgctctcgagatcgcgccaaccgaaatctagactgcaggtgtagtagtttaggacctgagggtttgaagggtactgttagcattaactaaattagagctccatagcgtcttctcgtc

SEQ ID NO: 674795 - DNA, 824 bp, Homo sapiens
agtccgcggaggtgtggtagaacaccgaggggtatatgtcctggaggctgcttttctacgacggggtgcttccccccccccggatagtgttatagaatggcgggttttcttggaaaaactggtcttggcaggggacccacattggtcctctggtgtttcgtcgcggcaccgatgtgggtgggcggagccctagggtttatgataggacctaccgcatcctgggggggtgccccctccctcagcccccggcaacccccgggtgcggggcgaaccccaccaacccaaccccaccagacggcgtaggttgtctccccaaccgcagtcctttgggtaaagatccgcgttacgcccgacctcgtagtggcccgcctgtctttgtgaaaagatattcgtccgaccgcgctggggatgtcagcccggtcttctgaggcgttgcaattctcacgtcctccttccttggttctcacaagagaacgggcatttgtgttccccctggggttcatctacagccccgtcgcgctatctaacgccgcggaacccactatataccgtcgtccgaaatcaacacttttcttactaacagagaggaacactcaccaactccctgattacccccacgtattatccacacaatccgctgtgttatcccccatgacccacgaagagatcacccacctggttgttatttggcacattttaattcccccttgtcactccatcctggtaataaacacgtccacagtttcaccgagaatgaagacaacaaaagcccctttttagtccacccaggacccaaaaacaaaatttttaaagcccacataaca

SEQ ID NO: 674796 - DNA, 246 bp, Homo sapiens
ccacgtcagtgattataagggcgttgtgttagctagttggcagcgtagagttactttggcacagacatttgggagtgtgttttgggggccagagccatagctccaaaaaaaaaaaaaagggttcaaaaattttttagatttctcaaatttgaggccaggaggaaaaacctcaaaaattccaaagggaaatttatttttttgaaaaattattgtcagactccaaaatttgatgaccccttctccatt

SEQ ID NO: 674797 - DNA, 679 bp, Homo sapiens
gtcgcaatgcaccatgaaagcttttgtgaagctcttcctggggacaatgtgggctttaatgttatgattgtgtctgtcacggctcctcgttgtggcaaagttgctgtggacagcgaaaatgatccaccaatgttagcagctggctttacttgctcaggtgatgatcctggaccatccaggtcaaataagcgccgcctatgcccctgtattgtattagcacacggcttacaatgtatggaagtctttctgagctgccccaaaagtacggttcgctgttttcttagcttcaaagttctccctaattttttggggtcctataatgctgccatatcctctttgccacctggcatgtcctacttttccaagaggctaacacactttccccccttttggtcactccaatacgctccgatgctcgcctatccttttgccctccctcccctcaggcccgtcatctttcccctgaaccacttctttgaattccctatcgccactccgaaccctaattcctccttgctttttttcttactttctcgcctcctcaattcccttccacttaccgcgacaggctcgctccctatcattccctttattctctactctccgtcaccgcgcatacaacaccctctcctctcgtcgccccccctgctcccatctacacccctcctccacttccccc

SEQ ID NO: 674798 - DNA, 176 bp, Homo sapiens
caaaaaaatcgtatcgtgggagaagacgatggcgaaaaagcttgaacagatcgaagccgatgcgcaggaaatttgatcgcagcggaattgatccgcctgggggcgcggatgcagctgctggaagcggaggtggtgctgagccgcgatcggctgatgaagctctacaagcaagtgcg

SEQ ID NO: 674799 - DNA, 1025 bp, Homo sapiens
  misc_feature (251)..(251): n is a, c, g, or t
caagctgggctgcagagcatctgtttttctgctctccagtttcttttctttttattgttttatttttttggacattggacccgtggtgcactcaacgcgcgaactgtgggctcctccaaacaacatagcaaacgacacgcaaaaaagttcacacttacacacacactcctggcgtcaaccgggcacactactccttctctgctagttctctctacacgtcctaacgtcgtccgccacgctatcaataaganacacagtgtcgttccccccaagcctctgtgcgcgcgacacacatcctagcatgctgccgcacaacaccgtcgtgagtccaccccgcgacaaggtggccgagcggagcaacaaacattataccaatatcacacatcaacaacgccgagcgactccacaacacacccttcaacaactctactcacacacacagaacactatcacaacatatactacacctctctcacccacaactataaataatatcatctaatcgccgctctaacagaccagccccctacatctcatcatctcagaaacgacaacacatttgtaggatatctctcacgtgtatcacacatatctataataacactacgacctgccgcgccgaccaaccacgataaagcgtctctacctccaacaaaacagaccacctcttcacaccacacacacacccgacaccttaatttcttcttcacaccataacaccaacataacacacacatacttcaagtcgacatagtcctcataccaccaacattcttcatctaatcatcctcccccacaccgcaacacacataatatatcatcatatactactactactactatactaatactcatcattatcccctgctcgtgcccacacacacacaagcagaccacctctctctcctctcacactacaatagattcaacaccaacttaagacatgcacgtcagcgatgactactacctaaacaaacagactgacgtctacacccaacactcgttgagacctacacccaaatatg

SEQ ID NO: 674800 - DNA, 148 bp, Homo sapiens
agactctagagtatccctgcacttccataccagacattaggcagcccggcgtgaagatgttggagccaggagcactgctttgggcgagttggctccttatccgacgaggcccccagtttaaccatctctacactgcagagttggactc

SEQ ID NO: 674801 - DNA, 158 bp, Homo sapiens
agctggaactatcggctaaagggtctctaccacatagtagggtctctaccacataggatatctacgtaaacaggataaaacagtaggactacatataccaatatatcacgggcctacgaaaaagagtacctagtaatatagtatataattaaccgtac

SEQ ID NO: 674802 - DNA, 274 bp, Homo sapiens
  misc_feature (35)..(35): n is a, c, g, or t
atgacagcacgggatgtgtggacacataagcacantatgaacatttgtcctatagtagaaagcagagaacagagaactcctccaatttatctttgtatcaatgtggttctataaaaaataccagatggtttaaacttaattatttcatggagggattaataaagggactaattttaaagatatgaggagtatatatatagaaaacacaatatacactggagcttctcttggggacataaccgatgcgtggcgcgatcctcatagagttcgacct

SEQ ID NO: 674803 - DNA, 383 bp, Homo sapiens
atttgaggctggttttgatggctgggtccttgggcctggccagtcttcctcttagcctctggatttaaaagggaccataaaaggagtaggccctggttccttctgttctggtggctgggcccaacaggggccctcactctttaagtccaggactgggtcttacctggtgggagcccccgccaaaggatgctctttcccaggacggatgggccctgtgtttcaagagtggggttgggggacagccttcaacagcagctcaccccctaccttccccaaacttgcactggggtgggatttggagtgatgggaaggtttttaagggccggggatggatcttttttaaatgttattacttgtaaataaagtctatttttttcccgtga

SEQ ID NO: 674804 - DNA, 1211 bp, Homo sapiens
gtcctcagtttcccaagtagctgggattacagttccttcctcagcagatcacctatgggcatggcttgtggcagacctgttccactcctatgtaggcagctcaccgcagaaccccgctgtactcgaagattcacgacgcctcatacgtgtaagatgaaaacagcctatccacttacaaccaagcatttctcccatcctggcattcccactcctgcaccctggctcccaggccctgtgcagctccaatgcccccgtcttctgccaggccccgcacgcccccaccactctgccagcgccctctccaccgccccccacgctactgcccctgcatccgctccctctccgccccatcacatgcacctgacccggcccctcctcgcctctctgcgcatctctcccacctcaccactactactctctacccacacccaccacccttcccccctacaatactactcacctccacccctctccccctcccgacaccctccctgctcaccgctcccccccccgacctcgtcccgctctccccgcccctccctccctctctctcctgcccccacacctgcctcctaccccacgctctcacgggccacctacctgatcaggcaacctccccctgcggcacacttcaccgcggtcttctgccccacctcctgctctcacccgctacctttcacaaccccccctggcctaccaacttcgcaagcgccacttccgcaacctaaacgcaactggcgccggaacaccaccccagcaccgaaacccaccacctcccacttcaccacaaactcgcttcgcactacgctcacccgcttaatccccttacccttaaaaaacaccccgctcacaccgtccacaactctcattcctcctctcgcactccttcacctaactcactccactcaccctcccactccacccctacttaccttcaccccctacttcgtctccaccacaccacactactcccaccaccccacctccgctcctccccctcctctcaccaccgctctcacccccgcgcaccgcgcacttcgcccactccccacccctccacctcccataccccgcaccgccaccaccccgtccccggaccacacgccccgcgccacccgactccactctgccctcctaccccgccccccacagcccacccaccaccaccctccgacccaccacaccccccctgccccccacctccctcgccc

SEQ ID NO: 674805 - DNA, 110 bp, Homo sapiens
agttcgacggagactctcgacatcgtgctctgcgtgctggatgtcgagagtggcaacatctctgtgcttgagggggtccctgagaatgtgtcccctggacaggcattttg

SEQ ID NO: 674806 - DNA, 174 bp, Homo sapiens
gcgcaaatagacaggaatatgagtttacatacgctaacggcccaaatgtgagctgtttaaacagccaaaccactaagtgtcattaatactttagggcagtggagggatggcttatttgtattgtgtaatttttatcactatatgtagtggtagatgtctaattggacttagaca

SEQ ID NO: 674807 - DNA, 107 bp, Homo sapiens
cagctggagaccagtggcatcatcctgcttctcgagctgcaccatccagtgtgcagtcaccagccccagggctgtttacacagttaactcacagttcagtgcctcag

SEQ ID NO: 674808 - DNA, 658 bp, Homo sapiens
ggtgatcacaccactgcactcctggactcaagccaccctcccacttcagcccccatcgctacaaaatattttaaaaattagccaggtgtggtggcttgtgcttgttgtcccggctacttgggaggctgaagtgggagggtggcttgagtccaggagtgcacctgcatcgtgatcatgctgaatgcacaccacatgcgctccagcctggacgacaggagatgagacgggccaatctctaaaagacacggcacgctccacaaaaggcatgccatcaattgtcccaactgtggccacccttgtggggctttgcaagtacttgtccccctcactggaactagtcacctttctagtttcttcgggttcaaacaaactcccccttatactacccgcgctttcgaacccgctcgaacctctatgcagcacaaatcaaaatgcggctcaattcattatctgagctggggggcccatcccctgttgaagtctatagggcgtcaccaacacgtataaaaagcccccgggtgctccacattctggaccttcaaatcacacaatcgttggagcggccacgactaccaattaaacacatcacctctctccccccatgcagtgacggaatagcacaatacattcactctttgaccacagcacaacacacaaa

SEQ ID NO: 674809 - DNA, 116 bp, Homo sapiens
tccagtgacttccatgtcagctcccaaagtgctgggcactacagtttgagccaccacgccagtcctcaggatgttatagattctctataaatcatttatagagaatgctctagatt

SEQ ID NO: 674810 - DNA, 558 bp, Homo sapiens
gtgagagctccctggagagttccctgagagagctcggaatcttcctcttctccacaacacactagagggggtagtagttttgtgtagagtttctatccccatctatgaattataaactgcagaggtgcacttagtggtagacaaggtagactttgatttgatatgtgtggcatgtaagcacgtttagattacaacaagtactatgcttgcagagacctcatgggctatgacagaagagggagacctggagaccgttacgacggcatggtaagaactttggtttattaccagtgtgttgggtatgtgagggttgtcacaatgtagttcacgttttgttgaaggttatcgtgattaaaaagtttttcttacaagtaaattttgtttggattactagttaaataattctgttatttgctgctggaggattacgactttattgagcttggtcccctcgattacaaatagtggctatatattgtacctcttttgtttactgtacatgcaattaggctattaaaacactctgccaagggggggtacgagctcgaatcgtatcat

SEQ ID NO: 674811 - DNA, 323 bp, Homo sapiens
attattttgttggttgtaatctcaacagtctctgtactgctagagtctatatgctcatgggccatagctgtctgctgttttccttggacggcttcctctagtccactcatggaagctgtctcattgccatgggctaagattgtccaattgtggctttcccccatacctcatggctgggccatggcaatggaagctgtgccattgttcccttagaggattctgtccagccacccagcttatattcatttccattcagcatctcacccgagcgtagcttaatgtgtctggtttccatcccaagcatcatatagttcagcgtctga

SEQ ID NO: 674812 - DNA, 329 bp, Homo sapiens
  misc_feature (56)..(56): n is a, c, g, or t
caaaacgatcccctcggccaacccaacagtttttcccacccccccggggtcggaantaataggaaaaaactttttgtgaaaaaacgagccagtggctgaaaccccctggtggaaacctgttgccagaccttcccctttttcttcagaataaggagctgtggggggtatttttttttgaagaaaaaaaaaaccgattttagggggggaaaaaccgtccactcccccaaagaatgggaaaaaattctgggtttaatttagccaaaacctttttcaagggaaaggaagaattttttttttgccggccataaaacccttggggtttttttgga

SEQ ID NO: 674813 - DNA, 345 bp, Homo sapiens
cgactacatacttccgaattgctaaataatataaaattcattctgctggcatttgtgaggaggctaaggtaactgtatctgggaaactaacatgccatgttgacttctgattaaccccagttctgggaatgcctctaagatttccaatttatctactgtttctggagtaatggcacatacttacagtaaatcctgcccttacatcaaattcctacctattccttccgaagcatgtgtgccctttccttagatataatccctgggtctggggtataatggcatggagatctatccgtcttgcagttgccaaaaaccacgcttctgtctgtcagttccccaataaaa

SEQ ID NO: 674814 - DNA, 351 bp, Homo sapiens
tacaggactccgccagtagtcaagatcgatgcactgcactgtagcctggggcgcacagtgagactccgtcatatatatatatatagcacttcattacccagagggcctcttgggcctgttgaaaaatgaaacccaatatttggaaattaaatccagagtttaaacgcagctatttgtggaagagctgccattagggtagaaagtatccaacaatgtaccaaaagcaaagttgtatgggcagtagcagtgtgaaggtaggcatttaagcagccagcactgccccaaatataaacttcctcataatgcaaaatgttctcataatgtcatgttgccccagtacaagtagcccac

SEQ ID NO: 674815 - DNA, 1538 bp, Homo sapiens
accatagcgatcgcaccgaatgaatccttctaagggctctccagctctactgagatcacactaatctggcactctagtaaaaaagctaacgatcagaggtggtcacatggtccttggcgctgtggttgcagagaaggtctcgaccggaacccttgatattccggataactaggccttgttcgagacgcgcgcgtggcattctgaacatatgtcctcagctcgctaacgctctgatatctcataccactagtaacaaagcgatctagttaagtcaacgaagcgaccgactcctcgctcgtacacaggccaagcgtgaggcttgggcacttggcagcagtaaggtagtaacgtccagacgaatctccaagccacgatcagcaccggactgacaactcaaaaagtccaatgtgtctcactaccacacagggcacctgagagacggtgcaaccagccgcaggtcaatgagtcccctagatgggggctgaggcgttctagcggtccgtagatttgaccttatatcatagtcccttatgatatcatctcgacagaccataccaggacaaccgtctgcatcgacccatgttgccgccgactaccagtcacatttccttcctagctttggcgaacgcgaaatttctacgggaaacccttccctcaaagttcgcgcgagcgttagagtcagatcgtctccaagggcagtccggataatctccctcaaaggccaaagggctcgtggcggccataaaaagcccatcaaaacacttttggccgcgcgcgcaaagcctaagtaatgaaaccgcccctaatctttgagtacgtacatcacatcgtgccattctgtcctacgcacattgaacgctaatttgaacgaccaggtcactttccgcggtagcgatgcggacagtaggttacttcggactttccgttcgcagtatcgtgtaactcgggggaaaggcatccaaaacggagtaaaccaatattagttgaacccccgacgcacgttgagataacgcgaccgcaccgtcaaacaccggttgatttccttcacacggacaatagccaatgagccctgggcagggcccttcccaagttacacagacccgccacaagaaacaagattatacatccaaattctatctttggaaaaacccaccgtaccgagtttcttagctgagcacggagttaacacacaatgtgaagcggcgcggtccgcaaattggattcaccggaaacagcacagtccctttttacttagacccccttggaatgtgaactatccacgggtgccccagttagactgctggcgcgtccataaggcaattaccggaaattccgggatacggattgtgttacccgcaagcgtgaggtattaaatagccccttccgtgtgtgatattgcagcaagacaacaaacacattacaaaacgacgggtcattgttaaaacccgctgtgtcacaataacgacacagaatagacagacaacctcaaaaaggtggtggcggcgcgccacagggcagttatatacagagagataatt

SEQ ID NO: 674816 - DNA, 387 bp, Homo sapiens
agcgggtcgcggcggcgagagcgcgattccagaagcggcatcgcggcggcggcagcggcggcggctacaccgggcttggccaaaaccaaaggaacaaaccaacgacatgccctcaccaggaggcagcaaacagaacaagaacgcaacgcacaaaagacagcgcgcgggcgaccagacacacaaaaagtgaaaaaacaggacgcccgcaggcaacccacaactgcacgcgagagccaaagcgcataagagacagccgacaccagaacatagcacgactacaaaagggcccccgagagccaagacctaagtgaccccacagaccacacaaaaaatacagaaaactagcagaagcaaagcaagcacacccatacgacaaggcctgaaacg

SEQ ID NO: 674817 - DNA, 993 bp, Homo sapiens
  misc_feature (292)..(292): n is a, c, g, or t
ggagaactagtctcgagttgtttttgagattttttaaaggatctcttaagaagtttattataacccagttctcataggccacaaggaaaataaagggactatgtacagccttacgggaaacaggcagggagctgaggagggccaaaatgagcctagggccttggtggggcgcattcccgggggagggggccctgtaaagggaaaccagagaatcccatgagactccacgaacaagcagctataagaaaacaaacaggtactgcaggaaacgatggccctgaaggaactcaangcaccagggccatcgtggaggagcataaattaccaataccctcgtggtgagcccaagggctcaaaaagaaggccatcaggaattccccaagggcgagagagagcgccagaatattccccgagatgggggacatgccccaatatggagatgtacaccataaataacacaaggggagataatcacccaatatgggtgagaccccaaaaagagaaggtgcatacatacccaaggaaggttggaacccaaataaaatacgaccttgaaagagcgggtagcaacccacacgagacacccaaataagggatggaggtaaaagagaacaccccacaaggagaccaagagagagagaaaaaaccgaggggaatcggcgaaagccccccagagcaaaacaaacaacgtgggcatggtatcgaacaaagcaaaagaatggcaaacaaaggcgagatgaaacacagaagaaaacaataaaagaccaataataaaagagagaggaaaaaacaacaaccccgatgatagacaagaagaaaagtgacgccccggaagcaaagccacccaaagaggaacacactggtgcccccaaaagaaaaaagacatcccgatgaaacgagaaagacccactggagggaaccaatgggagacacacaccgcaagcaacgtggggaggaaaaatacgagcggagccccaagagcgagagacccac

SEQ ID NO: 674818 - DNA, 120 bp, Homo sapiens
cttctgcgcttcctgcttctgccgcttcctgcttctgccttcactttctccctcctcttcctcctcttcttcacgtttcttcatcttcttcttcctcttcttcctcctcctcctcctctt

SEQ ID NO: 674819 - DNA, 2655 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctccaacaatggggaccagatttaagcatgagacgaaaacaccctcacccagacccacctccaacactggggaccagatttcagcatgagacccaaacacctgcatccagccccacctcaaccactaggaaccagatttcggcatgagacccaaa

SEQ ID NO: 674820 - DNA, 230 bp, Homo sapiens
ccccccgggccccctttttattggggacttgttggttaaaggagctctttttgcagggtggaagccccagggaattaattccccccgtcaaccaatgggatccaaaaaggggatggggggtccatacaaccttttccccccccccatttttttttgtcctaaaaatgttttccctttgggggtttttgagttggagcctttataaaaaaggggtaaatgttggaactgca

SEQ ID NO: 674821 - DNA, 151 bp, Homo sapiens
ttttttcccccccccccccttagggtaaaacttttaataaaaggtgggagggaaagaaattagggggaaaaaaagggctttattttttttttccattttaaggggtagggggaaatccccaaaagggcttgctttcctaaaaagctgtgga

SEQ ID NO: 674822 - DNA, 2506 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggcacctccaccacacagaagtatattcagagaaccgtcaattcagggatcctcaaggtagcc

SEQ ID NO: 674823 - DNA, 2334 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatggcaagtaatatagaagaaaattagtgtgatctcccagtggcccaaggcataaattgggcatcctcgtacctctccctcacttcccacatcagtatacatttaattatgttgattcagcctcctaaattccttgtgactgtttccatttttctcatccccatttatatttcaatttctcattcttggga

SEQ ID NO: 674824 - DNA, 543 bp, Homo sapiens
  misc_feature (149)..(149): n is a, c, g, or t
  misc_feature (153)..(153): n is a, c, g, or t
  misc_feature (165)..(165): n is a, c, g, or t
  misc_feature (205)..(205): n is a, c, g, or t
  misc_feature (232)..(232): n is a, c, g, or t
  misc_feature (395)..(395): n is a, c, g, or t
  misc_feature (397)..(397): n is a, c, g, or t
  misc_feature (400)..(400): n is a, c, g, or t
  misc_feature (417)..(417): n is a, c, g, or t
  misc_feature (429)..(429): n is a, c, g, or t
  misc_feature (455)..(455): n is a, c, g, or t
  misc_feature (468)..(468): n is a, c, g, or t
  misc_feature (476)..(476): n is a, c, g, or t
  misc_feature (484)..(484): n is a, c, g, or t
  misc_feature (501)..(501): n is a, c, g, or t
cagtgaaacagcatgacaaattaagacatctatgcaatgctggagatagaatcttaccaaacctaatcaagaacacattaatggagaagtataggcctggctacagaaagaacagcaaagaggaaaaaaaaaaaaaaaaaaaaacacangganaacaaaaacagntgcttcaatggaggcggtccaggcggtggaggagctgcgnaagctgaagcggggctgaaagggtcanacaaagctaagctgtcatgcaggaaaacaccaggagctcagtgatacttgagctttatttgagacctaaatttctatgtccataaataaccttttttgggagcacaaccacacccactcatttatgcacggtctatggctactgtgttcaacctgtgcagttnantanctgctatggaggtcacntgactggcaaanccttaagtagctactatcttgtcctnaatggggtctgtngactgacncctgcttnaaagagctgtggggacntcacatactttatcttatttaatcttcacaacaatcttttgc

SEQ ID NO: 674825 - DNA, 167 bp, Homo sapiens
  misc_feature (161)..(161): n is a, c, g, or t
cagaggggagagatagtcggagcagtcaggcatgttgtagccgaaggcgaggatggtccaggtggtctcgtgcggcggctggatgaagagcgtgttcaggaagaggaaacctgcacgagacaaagcagggggagcaccaggcacagccccctacccaaaancacctg

SEQ ID NO: 674826 - DNA, 151 bp, Homo sapiens
gtttgggtgctctgaggatcccccccgactagcccgacaggccaagagaaggcagggggagggaggaagaggagaaatagaaagagaggaaggaaggaaggaaggaaggaaggaaggaaggaaggaaggaaggaaggaaggttggttagtt

SEQ ID NO: 674827 - DNA, 452 bp, Homo sapiens
cacgaggatgttggccaggtagtcggcgaacggcccgacgtagtggaagtggttctcggcccagcgggcgaagtggtggcgctccaactgcccttcggcccacgccttggagaacgatgcgttcttggcctcacggcccttgatggcgttctccagctcggcgcggaactcgtcgcggcccagtagttcagtcatggatcagatcccttcgatcagttgatgtcgcgaaacgatgagcaacagagaatgtttcgcaatgatgggggctgcgagacgccgcggcgttgcgaagtcgcctctgcaccagcgacgttagccagcagaccggcgttgcgacatggacaacatcaccccggatgcccgcggcgacgaggcatggtgcacaccgcctcagtgactgccgaccgcagcggtcagcgcctcgaattcgggcaggatcgccgcaccgacgg

SEQ ID NO: 674828 - DNA, 230 bp, Homo sapiens
agggggccggggcccctttaaaaaaagggtccccccccggggttgaagaaccaacccaaaaaaaggttgggttgggccaagggcccccccgggccccggccccccgggggcccccccctggttggtttgctggccaaaaggccggttccccccccggggtttcacccccccaaggctttttttaaccaaatttggccccccggccaaaaaaaccccctttttttttttga

SEQ ID NO: 674829 - DNA, 87 bp, Homo sapiens
agcgagcaggaaacatactcgggggcgggtttgccccgcactcacctggtcagacgaactccgtttccaaaacaaaaacaaaacgga

SEQ ID NO: 674830 - DNA, 636 bp, Homo sapiens
ctattttgaacgaatgtcatgctttcacatgattcataatagtgctattgtgaacgaatgtcatgctttcacatgattcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattct

SEQ ID NO: 674831 - DNA, 261 bp, Homo sapiens
gaagctaaaataaaggccccaaaatttgggttttaaacagggtttcccacactttttggtattcggcagtctaaaaggaaccaattcctttattttagccttcccccccaaagtttattgggaattctttatcctttaaaaactataaatatatttgggggtcagcccagtaatgccccccaatattgtttttaaacaaaaaaggtaaccattcaaaagaatctctttaaatccctgattaaatcatttggctggaaccca

SEQ ID NO: 674832 - DNA, 182 bp, Homo sapiens
tgtacgctcagccaccaccgcttgctgtggtccagaacctccagcttctctccctggaccacagtcagttcccgtgggattcctagcttcaaactcgtacaagacttgcattttcagggactggctgggcaggtttggggctggagggccgaagggaaacaggatcctggtatcctaagggt

SEQ ID NO: 674833 - DNA, 114 bp, Homo sapiens
tttttttttttaaaaaatccttttaaaggtttttgttttaccataaagtagggcctggcccttttataaaaaaaagttcccctagtattaaagggtttttaagttccccaggga

SEQ ID NO: 674834 - DNA, 140 bp, Homo sapiens
ctctctctcaattgaacttcaaatctacgttcctttattgaaaattcatgttccattgtactgatctttactttggcttctttttttgcctccagcgcattcttccttaaactctcagtctctttccgtaactgtttatt

SEQ ID NO: 674835 - DNA, 2282 bp, Homo sapiens
  misc_feature (1440)..(1440): n is a, c, g, or t
aacaacttccgctcgggaagtttgtaaaagtctggtctaccggcgcggcgtagtggatgcagcatcctagtggaggacgcccctgtgatggagtctcactctgttgcccaggctggagtacagtggcgtgatctcggctcactgcaagctctgcctcccggttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcgttcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagngtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagctgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatggatcgggacactgccgtgtttcaggttagccaatta

SEQ ID NO: 674836 - DNA, 208 bp, Homo sapiens
gttacgttacgatgtctgccatgtcgcctgaaataccatgagtgtttatggaaagtcagtgcgtattaatacgcacggactttcctttctttgggatacatacccagcagtgggactgctggatcatacgatagctctacttttagttgtttggttttctttttggggatggagtctcgctctgtcacccaggcgggagtgcagtggt

SEQ ID NO: 674837 - DNA, 2143 bp, Homo sapiens
  misc_feature (1301)..(1301): n is a, c, g, or t
aacaacttccgctcgggaagtttgtaaaagtctggtctaccggcgcggcgtagtggatgcagcatcctagtggaggacgcccctgtgatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggtgagcacgggctgagcgcagcgtgagcacagggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcgttcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagngtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagctgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatggatcgggacactgccgtgtttcaggttagccaatta

SEQ ID NO: 674838 - DNA, 2443 bp, Homo sapiens
  misc_feature (1601)..(1601): n is a, c, g, or t
ttacacttgcaggttgtcaggacccggttgcgtatcctcttgaagctggtttcttcctggccgaccccgtccgcgatcgtgaccttagttatccctcatagacactttccacacctgtgtctccagccctatcgctccgatgagacccgagcgcttagactgtgattcataacacccaaagctccccggccccaggctgagctcctgcaacctccacaccccaccctctggtcctcccaggcattccaccgcgaaggagaggaggcagaaacccgagattcgcttcttctcctttcctgcccacgcccagcacacagtcactggctggagtgcgatggcgcgatatcggtcgccgcaacttctgcctcctgggttcaagtgaatctcctgccccagcctcctgagcagctgggatgacagatctgccctccttggcactgtgcttccccagaggggtggcctcgctgttcccatggacatggcccaggagccagtgaccttcagggacgtggccatctacttctcaagggaggagtgggcgtgtctggaacccagccagagggccctctaccgggacgtgatgctggacaacttcagcagtgtggctgctctgggattttgcagccccagaccagacctcgtctctcgcctggaacagtgggaggagccgtgggttgaagaccgggagagacctgagttccaggcagtgcagaggggaccccggccaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcgttcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagngtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagctgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatggatcgggacactgccgtgtttcaggttagccaatta

SEQ ID NO: 674839 - DNA, 281 bp, Homo sapiens
  misc_feature (37)..(37): n is a, c, g, or t
aaggagtaccaatgtgcgaacatcatcatgccgcgtngcaatcctgtgctcgcagtgtgacatgctggtggcgttaccgcgccttgagcatggtcagatagcggcatgtccccggtgtggcacaacgttaaccgtggcgtggtatgcccctcggtagcgttcccaccgccctatggtttggctgtactgtttatgctgttgctgtccaacttgttttccttttgtgaatatgaacgttgcaggagttaccagtgttattacattactggtaattcccggcg

SEQ ID NO: 674840 - DNA, 588 bp, Homo sapiens
aaaagcttcagtcttggctgcagcgttctcttcctctacaaatccgatatctttaagtataagtgccttgagcataaatttctttggttcaatctctgggtgctgtgaatctttcaagggtactcttttcccgaagaagagagcttcagatttggctgacaagcttgtcaaaatcattctggaacatggttaactccttttcatactttttttaggcttccattttaattttggctatctcggtatctttaaaaaacttcaactttggacacatttctgcccgaagttgctcttctatgtctctcttatactcatttagctttatttctaaagattcgaacttgatacgctgagggtaagcatctgcaaagtgatcatcaataagctgaagcttctcagccagagaatctctgttaaaggtcgaactggtctgagtttccatattacaactctctttagctggatgatattcggccaattcttttaaaaaatgcataagaaaacctttttgattttctttatcagatcctgaaaccagtgattggtagagactggaagtagggttgattttaatgaggtgtaatagat

SEQ ID NO: 674841 - DNA, 680 bp, Homo sapiens
gctggagttggatccacaggctctggctaggtcattatgtcacttttgcacagcgaatgtagatgtgactgtcacctctgaatttgttcagtgtcccaccagtggtctatgagaagtacactggaagcgtggggggaacacattgacatgatttggtgaatatcatcatctttgccagacaaggtctccagtgggagtcccttgtttcccaagcgtgtaacaggtgtgaaccgtgacacgacgatcacacgcactgggagtgcacgaccttgcgcctgtgtctacagtgggcctgtaatggtcgggcgtcgtggagcctatccgagacgtaacgtgcgtctcaaagcgactagtcgagatagcctcgactggcgactgcgtatgtcgtctgtactttggatgcgcgtatgtagtgggtagccctcaagaaagctagagactgttctgcgcatgaggtgagctgggcagcaaatctcccatctcaaggagaacgttgcctagtgactgtgtcttgccagagtcacaagagcgcccgccggtagaactcactaggggccctcgttcccagaaagagacatctagttcgtatcagcttcagaaatcaggaacactcaagtgctctgtgcagaggaaggccacagttagcttgtcatgggtctttacgcctctggcttgttccc

SEQ ID NO: 674842 - DNA, 183 bp, Homo sapiens
  misc_feature (75)..(75): n is a, c, g, or t
  misc_feature (131)..(131): n is a, c, g, or t
tcaagcttctacgatgtacggggacatggtgaaggctagtagttctggaaaaagccactggggacgaagacaggntgctaaagtatgaacgacgctgatggagtatgaactcaccaggtccacagaatctngtttaaaggttcagacttctaaatcagtggcaaataaaaagtgctatttgca

SEQ ID NO: 674843 - DNA, 603 bp, Homo sapiens
  misc_feature (297)..(297): n is a, c, g, or t
aactgctgtatcttttccattgtgaaatgaggactggtgtaagctagccagtgggtacactagagtcagcaaagataggcctggggcattttgtgctagctttctccttccctcctgctcttcctcttttcctccttcctgtagtgggactataatacagagaattgttaacataggtgatggacgacttgagattgccaaaaagggcatgatgaggcagtcgagagattagcagcagtaagaagcaagtagtgatctatagagggatacaagtaggagatggttcttggaggctgnggaccagagttacctggtgggaactgggcttgtccagaaggagcagaaacatttgggagattcagtcttagagagaaaggttctcctaccttccggtcaaagccaatggacaagggagctgcagcttatttcttagtgaacggaatataaaaccattccttagaataatttccttacctataaaaaaatcagtctggttaattccagcttgtctttttactgagaagtaaatttattgagtatatttaaatatttgtgagatttggccagtcatggtggctcgggcctgtggtcccaagtagctgg

SEQ ID NO: 674844 - DNA, 352 bp, Homo sapiens
ttttaattttagaaattttaaacttgaaagaaccctcaattatcggggggtttttgaaggaaagttaaaaaccaacataggaaatgggaaaaaatttgggtttgttttgtttgactaacttgggggtaaaagcaatttttaggggggggaaagttttttgaaagggtattgtccttttacattttgttaaaaagccctgggttttgagaatcaaaaagggggttgtttagggggtaattgggtttaaatttttcaaaaactttttttttttggtttataaaaaggtccagggggcccattttgattagtttgaaggttttcgggccttgaaataaattttggttaggggata

SEQ ID NO: 674845 - DNA, 616 bp, Homo sapiens
tcttctactaatggacatgtatgtcagctgtagagaaaaggatccttgccaaaacacgtcttcgagtggtgaaatacaccccgcaattcctttaatgatttcagattatcttaaatatttataaaaatcgactctcagcaacacttctttaagcaaacctcctcatcaacttcgattatttatatatttatgaacacgatgttcaaggagcagacggcagctagtaagtcctccaaaagaaggaaaaaaaaatcaatgggacagaatgtaagctccatgactcgtccatgtactcttctcgacaagctctggcacaattatctttccattcagcggaagcgccacacaaaagtccacaatgggtttaaaatagcacacttggacttcataaagcttggaggctccaagtttaatccaggaatgacctgccagccaagggctctattcccaaaggaaactgaagctctgtcaggggagaagatcttctcccctgacagacccgcaagacaaaacaacgggttcttgccagcctctagagaaatcccagaacactcagccctgacacgttaataccctgcacagatcagaggctgctggccacacagactcaccagcc

SEQ ID NO: 674846 - DNA, 133 bp, Homo sapiens
gaaggggctgggaactagtaggagctagggcaaaagaaaaaggaagtagaaaggaatcttggatcctctagtaccagcccaatagcatagtaatgtactatatatgcctacagtagtagggctatcgctatac

SEQ ID NO: 674847 - DNA, 103 bp, Homo sapiens
  misc_feature (50)..(50): n is a, c, g, or t
caccatgatgaatggatgtgtactgtttcttcttcgagcatcaccaaggntgatgacgatcactgtcgctatgacaacagccggccaccatgagtccaatgat

SEQ ID NO: 674848 - DNA, 955 bp, Homo sapiens
  misc_feature (177)..(177): n is a, c, g, or t
  misc_feature (179)..(179): n is a, c, g, or t
  misc_feature (218)..(218): n is a, c, g, or t
  misc_feature (224)..(224): n is a, c, g, or t
  misc_feature (229)..(231): n is a, c, g, or t
  misc_feature (239)..(239): n is a, c, g, or t
  misc_feature (248)..(248): n is a, c, g, or t
  misc_feature (263)..(263): n is a, c, g, or t
  misc_feature (266)..(267): n is a, c, g, or t
  misc_feature (292)..(292): n is a, c, g, or t
  misc_feature (326)..(326): n is a, c, g, or t
  misc_feature (358)..(358): n is a, c, g, or t
  misc_feature (360)..(360): n is a, c, g, or t
  misc_feature (364)..(364): n is a, c, g, or t
  misc_feature (375)..(376): n is a, c, g, or t
  misc_feature (383)..(383): n is a, c, g, or t
  misc_feature (389)..(390): n is a, c, g, or t
  misc_feature (400)..(400): n is a, c, g, or t
  misc_feature (406)..(406): n is a, c, g, or t
  misc_feature (415)..(415): n is a, c, g, or t
  misc_feature (434)..(434): n is a, c, g, or t
  misc_feature (437)..(437): n is a, c, g, or t
  misc_feature (467)..(468): n is a, c, g, or t
  misc_feature (480)..(480): n is a, c, g, or t
  misc_feature (497)..(497): n is a, c, g, or t
  misc_feature (503)..(503): n is a, c, g, or t
  misc_feature (513)..(513): n is a, c, g, or t
  misc_feature (596)..(596): n is a, c, g, or t
  misc_feature (623)..(623): n is a, c, g, or t
  misc_feature (632)..(632): n is a, c, g, or t
  misc_feature (661)..(661): n is a, c, g, or t
  misc_feature (695)..(695): n is a, c, g, or t
  misc_feature (890)..(890): n is a, c, g, or t
gacagagcggtcggtgacagcctcaaggcgcttcaggcaccgcgcccatggtgagagccatgaccgagctcacgattcatgactctgagtggaggacgccgctggtggcatgaagcacgcacagtggacgttcctggcggaacttattctcccagacgctcagcctgggcagccagnanggagcgtctgctggacgagctgaccttggaaggggtggnccggtncatgnnngagcgaancgctgtcgncagagtcatctgttngtnngggagctggaatcttccacatccgnaggcatccccgagtttcgctctccatccaccggnctctatgacaacctagagaagtaccatcttcncntacnccagaggccannctttgangatcannctatttcagnaacacnatccggaanccttcttcgccctcgccanggnaactctagtcctgggcagttcaagccaacnnatctgtcactancttcatgcgcctgctgnaggacnaggggctacntcctgcgctgctacacgcagaacatagataccctggagcgaatagccgggctggaacaggaggacttggtggaggcgcacggnaccttctacacatcacactgcgtcagngccagctgncggcacgaatacccgctaagctggatganagagaagatcttctctgaggtgacgcccaagtgngaagactgtcagagcctggtgaagcctgatatcgtctttttggtgagagcctcccagcgcgtttcttctcctgtatgcagtcagacttcctgaaggtggactccttccctggtcaatgggtacctccttgcaggtgcagcctttgctccctcatcagaaggcacccctctcaccctcggctgtcatcaaaggggnagctggcagtggaccttccgggcggtatcggtcgagaggtgactgcgtccaaggccccgcgtgtt

SEQ ID NO: 674849 - DNA, 174 bp, Homo sapiens
  misc_feature (108)..(108): n is a, c, g, or t
tgtgtcgagtaaggagcagaaagggcagcattgaggtttcataagcccaagggcgaaaagggacttacccccgcatgggtcttcaagcaagtggaccaagcttccttnttttaaacaagttatttatttcattccttttttttatttttattttttgggggctcttactcggta

SEQ ID NO: 674850 - DNA, 161 bp, Homo sapiens
  misc_feature (155)..(155): n is a, c, g, or t
ctaacacagtgaaccctgctctactaaaaaaaacaaaaaatagcttgcgtgttgttgggcgcctgagtcccggagcttgggagctgagctggagaaggggaaccaggaggcgcagcttgagtgagccaagatcgcgccactgcactccagcccgngtgaca

SEQ ID NO: 674851 - DNA, 274 bp, Homo sapiens
gaggcactgaatgttagtgtacttggagtattaggggtctgaccccaaacaccttccagctcctgtaacatactggcctggactgttttctcttcggctcccctatgtgtcccttgttccctgttatctccacctaagaacttgtaaacctctcgatgggcatgggaccacgacctctgtacttgttcgtgtgttctttcacatgctcctccgcacaagtgctgatatatacacgcaagtgaggctcacatgtgctaagagaggctcacagatg

SEQ ID NO: 674852 - DNA, 617 bp, Homo sapiens
agctggtccgcgattgctcccaatcagaataaagccttccttctgcaatcggtgtctgagaggttttgtctgcagctcgtcctgctacatcctgaccttgtgatccactcgcctcggcctcccaaaatgctgggatgacaggcatgagccactgcgcccggcaccaggtcatgtttttttgttgttgttcagccaagtttgagattccctgagccaggcaaatgtcaactgcagtttccagccctcagcatctacacctctggcgtctgtcatacaggatcatttcaaacaccttgtacttcccagaggttctgctaagccgtggagcccagacagatgtgtttctgaatgggagtgacttcctccattaaaccaggatcacagcatgcgttcatctgaaaagtgtttccaaacagccaggactatgcaccaaatcttcagttctaaaaatatctccagcctgggtgacagagcaagactccatctcaaaaaaaaaggacaagaaaaataaaataccactgggcatggtggctcatgcctataatcccagcactttgggaggcccaggagctcgagaccagcctgggcaacatggtgagtccccatttctacaaaaa

SEQ ID NO: 674853 - DNA, 301 bp, Homo sapiens
acatttccactgagtcgcataataaatcaacagagagacaggcatagccatgtacctagcgactggattacatgacaagctccgtgctccctactatggaatagtattttcactctctccgtttttcatggaagagtatacatagggaaaactaatgctcactactgtccttgcattaataaactaatgaaaaccagtaagagcagccggctttaaagtttaataattatctgcaaaggcagaagtttccagtttcactcaaatttgtccttttatactaaatgcgtgactcgtggaaatg

SEQ ID NO: 674854 - DNA, 627 bp, Homo sapiens
ttttgaaaaaggtgggaatagctggtaaggtctctttattatttatttatttattcatttattcaattctttttttttcttttcaccaaatagattttaggtaaaccaaggctttgaatagaacagaaaagtgtatgtatgtttgtacatgtgaactaattcgccaaattcgatgtatttttttctaccgaatctaaaattctattgaagagctttttttaaaaaaaaaaaataataaataactgaacttgttcagacaagaaagaaatttaaggaacctggaattgttgaaccaggataaacatagaacatcttttagggtttcgtcattgttgttggttttccattctagtcctcagcaatttaaaattttaaattcacacctcttcagttgtatttaaatccgcagttgggcaaccttttgggaagaaagaaatattaatggaattattttagttttttatttttattaagatttggggtggtaggtagaggtagaagaaagagatgactgactctattctagcctgacattctttttgtttgtgtgcataaacatgctgatagtaatattccaagttactcaaatcagggaatatattaaatttttgtgattgatacagagct

SEQ ID NO: 674855 - DNA, 256 bp, Homo sapiens
cggcgccgcttgtgcgctctggtggcgcggcgcctactcccctccacttcccacaggcccctggcctcccttttgtcaccccactcctcaccagccctgcaccctcccctccctgtgggtttttttttttttttttttttttttttttttttttttttttttttgttttttttgttcttcggaccttgacttcgcgtcctcttctccatcgctctgacgacgccctcgcgtcccaggcccacgccacgggaggccg

SEQ ID NO: 674856 - DNA, 416 bp, Homo sapiens
gaggatcccgaggcgttgtatggcctgggtgatgaggatgcaatgagctgtgattgtgccaccacactccagcctgggcaatacagcaagactgtctcaaaaaaaaaaaaacccaaaaaaactcaaaaatgtaatgaatgatacccaatgtgccttttctaaaaaaagttgccaaatatttctctgggatctgctgagcatgtcctctgatacttaaggcaagcttgttttacacccggtgtggatcccagtgagttttccagattccaaactgatggacgctactggcccttgggactgacatcctctgggattatacccttctctggggctgagatgctgctgccagctctaaaacagccctctttcctcaaaacctcatggcaggcccctggctccattattcagctgcctac

SEQ ID NO: 674857 - DNA, 148 bp, Homo sapiens
gtcactctagagtgatccccgttctcccttgtcaatgaaatgctcaggtcatgggactcataggaagttctcagtactttatacttacttgcatactcagagtgttcgacactatgaaaacactccctccttgtaaaacccacgctgt

SEQ ID NO: 674858 - DNA, 1209 bp, Homo sapiens
ggtcgggaagagcttcgggcggggctccaccctgatccagcaccagatgcgatccagcgtcgcggtgagaagccgcatacaaatgtgagagtctgcaagcgaaaggtgcttcgtccctagaatggcgtctgtaaccttcatcgaatagcgacctatgcgcaatcccaagagctaggcagtagcaggaaccctacaacaatcgatccccagttgtcggcgaaaggtccatgtcgccagactatgctccttgacaacatgctctcgcacgacccagctgccacttcaacatcgtagcccacgaaagccctacatagtgtcccactattgattggcaactggcccttacggacgagcagacttcacttagccctgccctgccggaactaacccaagacgtcatccctcaactagtacttcagctggaatcttggaccacttacacagactggcaaccgaaagtcgacgtgctaacggttggcttatcacctcgcagtaaacttcgcttcccctgttcgcagtgcacctccacgcagtggtaggctccacacgggttcagtacagggctctgtcaggcatgttggccactacttggcgagcaacagcaagtctgtacctccccagtcgagttcggacactcctctattcgcaccccgatgtcgcctggcagtggcacgccccggtgtcatacacgcccattcaaggtgccctgtagtgctgggcacaaggctgctttgggcccaaaaagcttccgggatgctgtggcctatcccatcgacctctgcaagcgctatccctggcacgaggagcgcagcatccgtaacgagacatggcccccgaaacatgcggggtctaacgtaaccttttccaatttcgacttcctctctatctgctcgatcccatggggaccaaagcggcctcgcccacactgggacggcatacgggacctttaccagggtagttgcctggtggttgacgagcacatggtgactttcttgcgcgcgtacctcacaacagcttcgttgccaaggcattacaaccggggtcccacaggttgggcgaagcgggttccttaccaaggttgccgaatagacttggcgggaaaagggccctttctcccccaggagactacagaaccctcgattcccgcccaccaagggggagcccaacgctgaaggggccaggaagctgaacttggggcccccatatgtg

SEQ ID NO: 674859 - DNA, 777 bp, Homo sapiens
tctcactgctgtgatagtattccttgacagggatgcctgagaccagtctacatgtcagctcctgctccgaaggaagggttccaagaaggttgtgaccaaggcgcagcaagaaggatgggtgagaagcgcaagcgcagtcgtaaggagagctactccgtgtatgtgtacaaagtgctacaatacaggttcaccccgaataatggccatctcatccaaggccatgggcatcatgaattccttcgtaaactgacatcttcgaacgcatcggaggcgaggcttcccgactggcccactacaactgagcgctcgaccattacctccaggagatccagaccgcgcggtgcgtctgctgcttcccggagatcagggcaagcacgcagtgtccgaaggtcccaagggctgtcaccaagtaatacaaagctccaagttaaactgtgtgcttaggtgcttcaataactcaagaggctctgtattcaagagccctagctcaaaggtactcaacactagaaaggaggctttttgacataatgtggaacttttcacccggtgtgttactaagggcgaaataatttattgaccggatgtcttcgtaaaatccctagtcacctattagggatgggccggacgcgcggtgcaggatcccgagcacgcagtttgtgggggtaaccgtggttaaaagtctccgttctcataacttagaaacataacagagatatataagcccggggccgttggtggcaggtccgacagtgtaaatcccccataggaactcgggga

SEQ ID NO: 674860 - DNA, 608 bp, Homo sapiens
  misc_feature (345)..(345): n is a, c, g, or t
  misc_feature (608)..(608): n is a, c, g, or t
ggaatagaccagaacatgtatagctgtctgtatctctttctgtttttaagatctccagtgaaggaattactaacagagtacaggagattgtatggaaggcctatagtgatgactctttcatcagctttgttcgtaataaattaactgtatgtgtttcagagagtcatatgactccaaaatgatttaacacatgctgctacaagccagccttcttaagtttttattaaatcttgattgttttggtcacataatttttatattaaatcctgtgatagtcattgttctttctataacaaatcatcacatttcaacgtgttaaggtcacgtgtgtactagaaaactggnacaggtaactagatttttgaacagggctactggcgattaaatagaatccatccaaaaccatttactttccttatacattatacgcagaagtggctaaattagagggttgttcctgtctccatcatgcacttctgtcttctaactccatttccccttggtatactatttgcgggcatactttctggaagccaaagttgctaagcgttacttacacagctgatatttcagattaatatgaatgctgaccgtttgccctcacaacn

SEQ ID NO: 674861 - DNA, 1375 bp, Homo sapiens
atgagcacggcatcgaccccacgtggcacctaccacgtgggcacagctgacctgcagctggaagcgcagtcaacgtgtactacaatgagtgccaccggctggcaatgtactgtgcccctgctgcctgtgctctgtggatcttggatgccctgtgcaccagtgtgactcctgttgctgctctgtgtggccctttctggtgcatgatcattcctgtgcctgtgatcatacttctgttattcgtgtccatgatggttgtgttgcttgtgtgcaaccaatctttgtgtgccacaatgtgtgtgcgacataacaacaatgtatatgtgcttgcctgtgcacgccttgtgttgtgaaacttctgttgttggcattggggacttgttttgtttgcacgacaacatcgcgcacgtggcctcagcgacgcaaggccatttcgttacgcactattgcccgcattgccacaatgatgtgcctttgctaccccaaatgacttttgccactacacagacatacacacaattagttgtggcttaggtgaaggtggcgtaagaaccctctagcgagcaggatacccatttatggtgtctcgcaaatttgcgggtgagttaaaccaccacagaatcccaccatttcccatagcttcacgagtggtccacgacaagagcaaacttccaccgatcggacggcggcccactcgggccgccacatctgcttcacagctacccctgcgcacaagtcaggcaaacctccaaacctcgtggagaagatttccacgcacttgttggctcaagtcacagcccccacaaaacgcgtgacgactctggcacacgctacaacggagcagatttgggtcactttggtgcacggacacttgggtgcccacaccacagattaagatacacacggtcaccgccagctcgaccacaaacacacactacgtcggtccacagtagtgatattaccactaaaacgaggcgccaaaacccataatatgctccacgaaatagggtgacagtagtgtgatcggcaaacatcatggtgctcgctgcaacagactggaacacccactcccgaccgccgaataattacaaggcgcagcgacgaacaacagcgccggtgggtcgacgtagctacggaatgacaagccaggcacacgtattaccccaatgattcaccctcgaaagcgaggagcacttaccaccgacgcaagagacagccgccgccccgcacaacggtagaacgtcacgacttatccccacgcaggcgacgagataagaacgcaggcaggcaaacacgaaccaacgtgacagcaacaaacgccacccacaaagcagccgtacacgcgcggtcaacgaccccgcgctgtgccaaaaacgtc

SEQ ID NO: 674862 - DNA, 319 bp, Homo sapiens
ataacgccgagcaggtgccgactctgtctcctttgggtagtgctgacggggaacaacattcagcgcatgttgcagaagctcgggagaaatcagtctgtgaataatccactatagggggaagaggccacttttctggttcctccctcctacgaactttctcatcaacgatctccaccaccttgctgtcctttagggccgcaaagatgactgaactgtcagtggtaagggcctgcactcggtggaaggcagaaataagggtgatgggtaggaaaccatcagcatccattttccttcgcaggaagaagtctcgctctaaatt

SEQ ID NO: 674863 - DNA, 570 bp, Homo sapiens
tccccggggaaaacagggtcttttctactcggaaaaaaacttttttggggggcgggggggggtgtaaaaaaaaaaaaaaaaaaacacttaaaaaaaaaaaaaggggggggggccaaaaaaacccccgggggggcccctatcagccaggcgccacaccgacctttctgtttgagaaagagggggccccccatcaggcaggagtggcgctcatcaaaacaaacgacagagcagcggggggccgcgtaaaaaaacaagcggcggtcgcggagcggcaacacaagtcttgcctactggtgggtgctctctgtgggagagagagagaacacaccaccattctgtgtggggggggggggacactctttgtgtcggggaacacaccccatcaccaacagagaatattaatgacgctccgtcaggaggagttaaataataaaaaaaacagaggagttttcatgtgggtggtaacccaccagaccatcttaattgttgcgtggtcgacgagaaaaagtattgtgtccgcgcacagatttgatatctaaaaaatattttcagggggcgtgaagataaagt

SEQ ID NO: 674864 - DNA, 133 bp, Homo sapiens
atggcctggtgcaagctgcaggccagttttgagcccatcagctgccctgtctccagagaaggcctcgcacagttgcgtgctgcttgctgaggatcgggccgagtcgggcaccaagggactcttcaccggccat

SEQ ID NO: 674865 - DNA, 232 bp, Homo sapiens
tttcatgtcgtagatacaggaccgtgtatgcgtacaatgcatctgaaaggaacacaggaactagaataagcagaaacaattttgaaaaagaaaataaaggggcactcctcagtgtcacctgatttcaaagcttattatatagctatagtaatcaagacaatatattcatccagctgggggcacataccacagatcactgaaatcgcagtagaaacatgcaaaaacagcatgc

SEQ ID NO: 674866 - DNA, 290 bp, Homo sapiens
gatttccccttttttccttccccctcaggaaaaaaaaaaattagtggttccagccctttttggagccttcatggtccaggggtaggggcccccctggcctgagcatcccatttttaggggaggggagttgtgcctatttatcccctggcagaggggatgccaggaccatggacattagggttgcccatccctgccaacttacacagcctggacccctgtccccccttccttgggtactttgaaatgggcctgctcctggcatttcaataaaacccgggttgggtttgtga

SEQ ID NO: 674867 - DNA, 141 bp, Homo sapiens
tggtgcggatttttttctttccctctgggcgggttttacaccgcataatcggtaaccttcggtggatcctttttccaggggttttaatgggttgggggcctttaatcaaactggtttgtgccgctattaagccaccccccc

SEQ ID NO: 674868 - DNA, 384 bp, Homo sapiens
cttgaacttttgggctcaggtaatcctcctgccttggcctcccaaagtgatgggattacaggtgtgagtcactgcgcctggcttattattccttttttttaaaaaaaactttttttgggggcaggacatgggatctcgctttgtcgcccagctggggcgacagagcgagactccatctccaaaaaaaaaaaaaaaatagggacagcctggccaacatgacaaaaccaaaccctgtctctactaaaaatataaaaattagccaatcccagctactggggaggctgaggcgggggaatcccttgaacctgagaggcgaaggttgaagtgagcccagatggtgccattgtgctccagcctgggtgacacagtgagactctgtctcaa

SEQ ID NO: 674869 - DNA, 225 bp, Homo sapiens
cgctagcggaattaatgacgtctctggacttggatctatatgttaattctttcatggaccctgggcattgctctttccatggatcctcatacctcactaagtgtaagggtcctgtctggccccattccctatcaactggtcattttgaccaaatccttgcttctcaaattaagcacatttgatttataacataatttaggtatcgttcacttaatgccgctagcg

SEQ ID NO: 674870 - DNA, 105 bp, Homo sapiens
caggcatgcagctgggagtcgaattttaatataacttaagtaatttaaactggccccgtgtggctagatggctactgtactggccaagctaatgctagactcact

SEQ ID NO: 674871 - DNA, 603 bp, Homo sapiens
  misc_feature (6)..(6): n is a, c, g, or t
  misc_feature (542)..(542): n is a, c, g, or t
  misc_feature (559)..(559): n is a, c, g, or t
  misc_feature (567)..(567): n is a, c, g, or t
  misc_feature (570)..(570): n is a, c, g, or t
  misc_feature (579)..(579): n is a, c, g, or t
acgaanaagtagtaccaaggcggaccgaaagcgggaccggctcgaccccgcggaaacgaagttgatggaccagagaaactgacaaatcccctaccgttggagtctgtgctgagaaaacttctctgtcaataaaaacgaaaaatttcaaaagaaaataaaattttaaaagaagaaacctgcccccccccccccccccttaatgccctaccaaaaaccaaaaaataagattacaacgctaaaatagagtaaaaatctaaaagaatagagtaaaataccctcatcccccgctccctcccctctcaactcctcttctgagcaatctcttgctgagcctacaaacctcgcctatagttcgtacacctctcagtgctctttgtagtccgtcgtcattagctttactgcactctaaacgccctaccgggcaacttaggacaccgcctatcacaacctcggcccgccctctcatcgtcctttctgctcccccgcttacgttacctttacgccctgagaccaaccccctaatatacctagtctcgacctcnctcgcccgtcctccaanccttcgancgncggaaatgntcgtagtgaactttcttatttcca

SEQ ID NO: 674872 - DNA, 681 bp, Homo sapiens
ctgctgctttgacactgagtatgtctcttcaagcctattaccagcctgtcctgccaactcagagagtgtatgtggtgtgcaatggtgcctgaatgtgtgggcatagatgatgttctgggattacctcttcgctgtgaatattaaactcaatcatgctgctgtgaacactggattcctgactgtcaacttgtgttgtgtccccctgtgatgtgtgatcaatggtgatgaccactgaatttacttgactacattgatactgtgtccaattgagagccactgtatgtcttgcatgatcaatagctctggcgaaaatccatgccttatgttcaatgacactgcacactgagttgactcctctgacatgtgcatgagatactgtgaatgtgacgttgtctccgactcttggtgtggatcccagaccatgggctcgttgtggctccttcttcctccctgaccctaaatcgaagtatctttgagctaaatccacgggcactgcagatttgacatcttcagctatcaatgccccacacctgctcacctctaaaaatccttggacgaagcatcccgccctgtagtatgactacctgctgcatggtatctggcagtgagcacaagttcctcatctggcctggggaaattccaggatcaacacatgggattggcctgtcagtcataccgatg

SEQ ID NO: 674873 - DNA, 299 bp, Homo sapiens
gctacgtcagtaatctggcctattagtgcgccctcgtgctgttatatatacttcctggtcttagtgctcctgtaacaagtactcaacattgtataagggcgctgctgatcaggacgtgtcctgcatactggcctttgggtaaacgtagtcctcaaaagcactatcatgtttgcttttactctttgtcagtgatcgatctattttacagggtactgaataacatgtgttgatcgactgtaaaagaacctttactctgaatgggagacagcagtcgctgatctgatagcaagcttcccaag

SEQ ID NO: 674874 - DNA, 235 bp, Homo sapiens
acgcttagaggctgcagtgcagcaaggatgaaagagaagaatgaaagatatgaatggacgtatctttcagagaaatattgaaggagtaaactgggtcttccagcctacatctttctcccatgctggaggatttcgctttcctggtttcggagatcaacggtcgaggagtctatgagctgcagctctccgaggagcgggacctgctcaagggcaccggtacgggcgcttctatccg

SEQ ID NO: 674875 - DNA, 110 bp, Homo sapiens
ctatacatactgacgctaatgtgactgcagacattcagactgcccactctttgagaaaacaaacaaaaacaggtacactcccatgtcctcccaacacaacattgacactg

SEQ ID NO: 674876 - DNA, 1085 bp, Homo sapiens
  misc_feature (134)..(134): n is a, c, g, or t
  misc_feature (392)..(392): n is a, c, g, or t
ccacgcggctgcatgccgtatcatatagtaaaacccagcccatgacccctaacaggggccctctcaggccctccgtaatgaccttccgtgccatagcctttgatgaattatctacttccgcttccataaacgcntccttctatacttatgtgcccgtacttaatctcaatctacacgtaagccagtataccaaatggagtggcgcggatgtagcacgaggaaagcactattgctcgatggaccatacacagcacctaccatgtgtccatacaaatggtgcattcgaaattagcggggataaatccatagttctagttaccatcagtgagaattgtgtgttctttcgccagtggattcggctgagtccttgtttaccgactcgcgagcccctnagtcgccgcataccctctccaaaattagtggaggtgtcaccttgtgctccctcgagaatagcgtctatccaacccggacttacatatcaccactagaaagatcccaacgtgcacgttataacacaatcccggtaaatctaacttccggtaactcccgaggtaggataatcaatactatccattgaaggctacctaccaaataaggctccttaacttatgaaaatacctaagcacgaatatctcacataatatatttcagaaggcactgccttaattgaccaagttttactgggtggtcgcgtaactctttaccgcatctcttacaaaggccctcgatgaacgttactctcagaatgtctatccccattacgaacatctattccctgcacgtggagatcctaggaggactcaaacagataacgaaaggttaggcccgaacgggttgcccccacggggacttttccaaggatcccacttgactctgggcctccaaacgttggtccctactagttaatgctaggtatccaatcccgggcccattcttgaattatttcacccttttaaacattcgcaaaaggcaatcaagcttatgggagtatcagaaagccctggcccgtctggataacctgggcaatctcgtgacaatgttggggacaggctaatagcctggtattggcttccccactctacccg

SEQ ID NO: 674877 - DNA, 1334 bp, Homo sapiens
gcagggacgctacttcccacatatcataggaagagctgatcgagccttgcatagatcagcagccacgtcatgaatcacttttcctgtatactagcgttgcactagatcctgatatgcggctttatccctaattactacacaaacataagatcgtagagctagatcctaaacatgcgtcagatcggctcgagggaggactagaaaccggtacgtgagacctatcgcgtgcccggctcaatctactctcatcatgttcctcgattcgaccgcttcgccgagttcctcgtcacgacattcgcgttataacactaagcaggatcgtaggggtcaaacgcagtccctgctcgcattgacgcaatgcatagattctaaaattgtgctcgatccgaaatgggtcacctagagaacccttagcgaaagtaacaaccgaatctgactgcgccgtgaacctaaactcgtttgcaagctccctacaattaccgttcctcgcgctcgattgtacttgcctctagtaagcctagtgtcggaccctggcagaactgccctatgaaccagtgtggagcgagaatgcgaggcttagtagcctcccgaattgagatgccccgctcatttcagtaataaataagttacatcacaaagacgtcttgcactcatgagctgtccccgcaacattagggcttaacacagacagatgcaatttccctggacgtctaaagaccaaagccaactttcacccgtcgtacacgacccgggggtatactacgggtcaatgctctgaaatctgtggagcaaaaccacagtttcatgccccatcagtacctagaattgaatttccccctaaacaaatctttgaaatacgggcccgtatttaccctatagcacccccctctaaccccctctagaggcccagaaatatccgacatcacataaaggccggtcttgaaagtagcccatcaaaggctcttcgaggacccttggagacacagagccctggcgagccttccttgtatcacatcgtctccatcaattgaaatccggcccccagtatttgtcgttgccttaaagaaataggggggccccccgcaggagaaaaccccaggcggcggtctcacacacgtggaacgtgggggaaaggccccggaaaaagctatctagccaccgaagatgcccgatgcaccacacagccgcccagttcacaaactggccacaacgccatggtggactgcacccatacgcaaatgttcaccaacacgactccatgtacacacggggcaataatccgtcccacacccgaccaactgtcgctaccattgccgaactttcgcacaacccgc

SEQ ID NO: 674878 - DNA, 170 bp, Homo sapiens
tgctttacggctgcataggaggtggggctggcttattatttgccacaacaaacttgggcttgggggccaacctggtggcttctttatctctggctgcagaagtcatgattcccctggtgcagctcgccccatgagttcagcagcagctcgcccctgagttaggcggcgct

SEQ ID NO: 674879 - DNA, 207 bp, Homo sapiens
ccagcctgggccacaatatgagaccttgtctctactaccaaaaaaaaaaaaaaattaaccaggcttggtgatgagtgcctgtagtcccagctacttgggaggctgaggcaggagaatcacttgagtacaggagtttgaggctgcagtgaactatgatcgagccactccaccccagcctgggtgacacagcaagaacttgcctgttta

SEQ ID NO: 674880 - DNA, 439 bp, Homo sapiens
  misc_feature (21)..(21): n is a, c, g, or t
ccgatggggaaaaaaaaactnctgtttaccctgctaatgaaagaaaatgccctttaactttctaatgattatagataaatataatatgcgtctttttcccaatatcctatgatttttagactaggctctagtgttcagaattcatgaaattatccatggtaaaaactagttataaaaattacataattcaaagataacattgttatttttaagccttatataatattgtaacttgcatggatccaaacctggatttgggatgaaaaacttaatgatctttcccttggaaaaaactggaagtgaaaaggttttgttgcttgtacagtgtcagatgaggaacccccctattttaattttgcgaaaccctgcatttgctggggctatttttatacagtgaagcaacagctttgcagcaaaataataaaaaactttttcgtta

SEQ ID NO: 674881 - DNA, 352 bp, Homo sapiens
cggcaccattcaggagatacctatatagctgtactatccatggggatggttacagataggaagtttattagctgtacagagaagcaccttttgacaaaaaggggattttcatttacttcgagttacacgcattctgaaacattgagccaaagacaaagattactgaaagaactttagctaaaatcttccagtttactttgtcttactctcttttacttctcagacacttcccccaccctcttagaacctgttgcttgcaacttagtttcacagctttgcctcttctttttgatgtattttttccagaccttttctgccacttagcacttgtttgttcggactgcaattgggg

SEQ ID NO: 674882 - DNA, 129 bp, Homo sapiens
tatttgaatctgaacatgaataaaatttgagataaagagacattttcatctctttgtctggtttgtccttgtgctttatggggactctaatggcatttcagtcctgttggttgagggcattatatttta

SEQ ID NO: 674883 - DNA, 172 bp, Homo sapiens
gtacgtacttaagcattctgcgcttccacaccagcctatcaacgtcctggtctcgaacgaacctgtcagtggggctcaacggccccgcgcaagactcatctctgagacgagttacccgcttagatgcttatcacgcggttatctctatcccgcacttagactactcgcgcaa

SEQ ID NO: 674884 - DNA, 124 bp, Homo sapiens
gagtcggccccatattaatgcgatcagaatatagacggattattctcatttgttcaaaattcatttgattctgaatgtctcgaaatcactgccgacgtttctttttacgcggcttcgcctaacg

SEQ ID NO: 674885 - DNA, 1172 bp, Homo sapiens
  misc_feature (553)..(553): n is a, c, g, or t
  misc_feature (555)..(555): n is a, c, g, or t
  misc_feature (566)..(566): n is a, c, g, or t
  misc_feature (607)..(607): n is a, c, g, or t
ggacgggcgctttggagccggacccaggcagcgtgtgtcgcgtcgcctagtctggagaactagtcctcgagtcacgtgcataggtatgatgctgaaaggaataacaaggtcttatctctaggtatccataagtgggaccctgggcgtgtattacacatggggacccaagctcgtcaaagcattgcgtgcttcaccttagataatcgcaggttccaggtgagagtccggagaggtatttccacgcaagcctagattgagaatgagccgggtcaattcgatggggatcggaggtagtgagggtcgagcgagtacaaaatctccccccgaggatttggagactgtatttccccgatggccttcctcctcgcttggtgatgcgaggtgaagacattcagtgaagcgttggctgatgggtaaggaaacgcaggcctagaacttctgcattacctgaaagacaggcagttatggttatccaggtatacgatatcttctgtatggagagaagggaacaggaaaaaccctaagtctttgccatgttatcatttctgtgcanancaggactggcngatactacatattccagatgctcatctttgggtgaaaaatngtcgggatcttctgcagtccagctacaacaaacagcgctttgatcaaccctttagcaggcttcaacctggctgaagaatttcaaaactacaaatgagcgcttcctgaaccagataaaagttcaacgagaagtactgctctggcaataagagagaaagcactgagaaagcggagtcctctgggagcaacgtggcttgaacacgggcactaacacgggctgaggaacgccacagatgcagcttggaattgtgctgacaagagctaaagaggcaaagcttctcttggcgtatgtttcacctcctagttggcacgtggcactggaactcaatgctctcttggggaagaaccactctgacaaagcagaagataaaagccccgattgcccccgaggcacttacgcacttgctcacaacttgcaggcacactgatgacccctctgattggcatggaccgccgccattgctgtcggctctctgagcccaagactggagtctctcttctaaggccccggaaacgcctatctgaccccaggacgttgctggcgacacggaggatccgcatgccct

SEQ ID NO: 674886 - DNA, 120 bp, Homo sapiens
cagcccgccaacaccccttgcaaagtcatctgctgctcccgggggagaggacggcggctcagctactagcccaccagcccaccaggagaaaggaagccatgagaggcagcgcccgccacc

SEQ ID NO: 674887 - DNA, 192 bp, Homo sapiens
tttaagtcactagtagatatgatagagtggtattggttcagaattaagtgttggttgaacaggtggaagattacataaagaaatggggcattgcggtggttcatggcttgtattccgcaggattttgggagggtgagctggagatgatcccttagaggccatggggagttcaatggaccatgctcttagggc

SEQ ID NO: 674888 - DNA, 1155 bp, Homo sapiens
  misc_feature (1155)..(1155): n is a, c, g, or t
cggacgcgtgggtacaagatcaataacattattaatatatctagtcttcttagaaatcgttagcgacaaaaatcttggactcaaaagtatatattgggcacttactgtgtgccaagttctgcattaggtacaggaagccaagcagccaggcaagggaagcaagacacagaaaattaatctcccctctcactgatccctcaaactttgctggacatcttacaggggtagtggcatatgatagccttctatataggtagatgtagctagataaaaaataaatatgtaatagaaaaaggaataggaaattagaccttacccatcctaatactactgtatgttataccttaatggccccaaaagataaatattttactcagatgtaaaccatgtgaacgcctcagatcataggtatacggttgacctaagtcttacaaagaaaaatatccctatccttatgaatacatggtacactatacaagagtgaattatcatagtaaaataaaatctaaatagattcatgagtacacttaacataaagcataaagacctatttatctgaccttgactattgccaagtacatggcaaaaaatctatagcaattataacatggcaatatatgaaactctgatttcccttagaacatcacaggggtaagactgactcattttgactggacaagatgaaggacctaccactaacgggacaggcccagcaacaggacactaacaaaacagaaaaatagaacggtcacaaagcacaaaggcaacaatacaatgcaataaaaaagccctacaatagacagaacgagggacacaacaccaaaagcgacccgtaaaaacaaaaggcaggaacaatacaacagacaccagatcacgcaaaggagaaaaaacgggaaatagtaaagaactacaaatgaagagaggcataacaagagtagaaaaaaagagagaaataaatgaaggaataaactgtggttgacaataaaatagagcaaagtataggcagagacaacaatgaatacgatgtcaatagaaatacagaaatagggttaagttgttacatatagaagcgcagagaacgagataaataaaaaaaaaaacaaggaaaattaagaacatataaaaaatgcataaagggtcaatccatcactcaan

SEQ ID NO: 674889 - DNA, 269 bp, Homo sapiens
  misc_feature (14)..(14): n is a, c, g, or t
  misc_feature (243)..(243): n is a, c, g, or t
agctgggaacctanaagcgtgcgccaaccaatgcccaagctaatttttgtactttttgtagaagacaagaatttcggccattttgcccccaggctggtctttaactgggctcaagcgggtctgcttgcctcaccctcccaaagtgctgggattacagcatgagccaccacgctcagctggaaacagagctttttgattagggccagaagcgtccccctgaactgcatatttgactaatcctgntttcagcagttttaacatcccatgag

SEQ ID NO: 674890 - DNA, 1232 bp, Homo sapiens
ggctgcggagatggagcatccctcggacctgccggcgcgtgcaaagcatttcccctgtatggggctcttaaagccgttgccctcccagagaccttcccggtgttgcgccgccccggccaaagcctcagcctttctggggccttagcttcttcacgtgtaggtggcggcagggaggactggaccacctgtgcgcggcttgggagccctgatgccctaagggtataccatgaggtgcaccgggagggtgacaaagtcgggcggcccactacgtggaccgtgggcccccacaaagaattcggccccccaggggctactggactccaaagaacaagagtaggggatggaactgaccatgggcccaagggccaacacggggagtgaactgggaaagggggccctgcaggggactcaccaggtgggaacacactggaacccatcccagagaaacccaggaacagggccccagaatggcacgggtggtgtcgcccctttcctggggcccttcttggccccctgtggaatcacaattccaaagaggccgcctctcgaaatgggaaaaccccaaccgcaataggaacacccaggcaacgaggaaacaccgcaggaactagacacacctagctttacaacccaacccaggggcggcaccttactcccccgatttatcggtgaactggcacgcacgtggggttccaacacccatatgtttgggccctccgaacacgaggcaatgtgcctgggaccgcccgcggaaattccccttataggcgccgagggagaggcaaacctctccctcggtggggtcaaaaaccccactcatttgaacgacgcaagcacttccccgttggggagagaaactgtggccccccgggtcacaactagtgggagacatgcacaaggggttaggaagtgcgtccgggccgaatcccttccattgtgacctctcatatccgaatagacccatttcaaagccaggaggcttgccatgtgtgcgccaatggccccaagggcccagattgctaaggccgctacacaggggggcaaaacacaatttttcgcagattgaagggggcctccccttgggggacccacgttgtcatagaccgatcacaacatgtatcatgtccagcagaccacccatgtttcgtgcgcgcgccctgctgacctcacggaggaagcttgctggaccacccattgttttgctggagcgtgcctcaggatgcccgcctgac

SEQ ID NO: 674891 - DNA, 497 bp, Homo sapiens
  misc_feature (134)..(134): n is a, c, g, or t
  misc_feature (221)..(221): n is a, c, g, or t
gggtctgtctctatgcttcaacatgtgttgtggcacggaagcagagtccgtggtgactcgtcttccagtcctccgatccgccctccgatttcctctccgcttgcaagcctccgggatccatcttctcgtgccantcttccctgcgttcgtgggaccgtgcccagacaccggttgtatagtaggtttagcgtgccgttcgtttgccgagaccaagccatgangctccccagattcgtgcagagatgtattccacacgaccgtggaagggcgagccccgggttccgaaaaaccaaaggcccgcttgggggtttcccaaaattgtttgtagattaacccctggcacagagggccccttcgcataaacacgcacatagagccattcgtacttcttggggactttcctaaatttgcgaaacacggcggaatcagatggtgtgggcgtacttgggggaaaacgggggccggtttggaaggggccccaaagcatttatcctttc

SEQ ID NO: 674892 - DNA, 390 bp, Homo sapiens
ccgtacctgtggccaggcttgagtccctgatgaattcgacattgacggacgagcttggaaaactaaaagggaaatcagaaaggtcatctgaggaccccactgatgactccaggcttcccagtggccgaagcggcgcagggaaaaggaccagctcaggacccaggtggtgaggctacaagcagagaaggcagacctgtggggcatcgtgtctgaactgcagctcaagctgacctccagcggctcctcagaagattccttggtggaaataaggatggctgaaggagaagcagaagggtcagtaaaagaaatcaagcatagtcctgggccccaacgagaaacagtctccatgggcagggcattgtctaaattataggagcagatctgcagatg

SEQ ID NO: 674893 - DNA, 192 bp, Homo sapiens
  misc_feature (159)..(159): n is a, c, g, or t
gagaagagaagaagggatgagtgagtggaacggaaggaagtgtcttagtctgaaatgcttcgcgtaacttggtgctcaggttcctatgggactttggatgcttaaagggagaagaaactacggccgggtcctcttgcgagaactggcctattgatcttnggatgtggatgattgtgccctgtgaaacatgtc

SEQ ID NO: 674894 - DNA, 562 bp, Homo sapiens
gcccctccctagtctgggatcacctcggtctcccttctgtcttcaggagtcctaatgttgggtactcagaagacagccactatgggtataaggtctagcaaacactgtgcacataagatgccttgcttccttcagtccaggagaagtagcctatagctttcgtgggggttactactatttgttaccagccccgcggttgaaatcataggtcctctaacttattacctgtgatgttgaggcaataactacaattctctgtgcttcaattttctcccatgtgacataggaatactggtagtacttatctcacacaatttttacaaagattaaatgggttaacgtttacaaagtgcttagaactgtacttcacacataatacctgttacttgaatgattgctgtggtcgtcattagctaccatttagagctgtgtgaggaacagattaataacgcctgtccagcacgtatcatggggggcacacacataaactgtaagcaccccattaatgctaagctataattactttggtcaaatatgacacacgtgtctgaaatgacccgct

SEQ ID NO: 674895 - DNA, 701 bp, Homo sapiens
  misc_feature (538)..(538): n is a, c, g, or t
  misc_feature (563)..(563): n is a, c, g, or t
tggaatagtcaataaaatcatttggctttggaaagaacagaggtattttgttcaatagttttgttttctttaggctgagacagcaattatgccatcatcatcactttccatcttttagaaggatattggttaaattttgagttaatgatttttttctccccaagattcctttctagcccctaacattactatagtcttaaactatcttctgtttgtcatacaaaatggcttctcatagaacaacaccaatgtcagggtaggagctgaggaagaaaaagtaaataaaaatacacaaaatccaaactttgttatatgttccattcagtggccttatacatgacttacaaattttgtttgaagtttaattataactaaccactatttaattcgaattcactgctggctgtatttcctgattcagagttccatattgcttctattgctggttttaatttatttgaacctcagtcttctaaattgtctctatttcctatccattattttttatttgcctagaggtacttgaaaatgcattcanaaaaaaaaattcttactcaccattntgtacaactcttcaaaactctaggatatgctacataatgtacataataaaagtagtaatttcaacagaaaatcaagatgccactcgattttgccatggatttataaaatgacacattagaccacagaagcatatgaga

SEQ ID NO: 674896 - DNA, 129 bp, Homo sapiens
caccgctttcctggatctgggtggactggcctgcctctcctccttgtcctgtctcaccctaagcgaaggacagagctctgttctcagataatgacagataatatcagagcttagcagtatatctgactg

SEQ ID NO: 674897 - DNA, 875 bp, Homo sapiens
gccgggcgcggtggctcacgcctgtaatccctaagtgctgggattacaggtgtgagccacagtgcctggcccattcttgagtttgataaagtaattcatacaaagtaccgtgtcctcaaataagtcttccttagctaaatgcaatttaaaattattcaaagatcctagggcacttctagtttcaggtaaatcattcatataaggtggttctcttcatccattgtgttttcacactgatcacataacacaattaccagcagtctaatctagtgacacctcagtcatatttcgtatagattttacctcaaatcagtccaagacttttttcagagatcaccattgtgtctgtgaaaaggttcatttcgtatattaaactgcctaccttataagtaattaacgagaaattaagaaggtagtatgcatttctaatctgaacatggtttacattcttgtgtataataaactaaaagcaaaatgtcataaacaaatttgcggtaaagatataaaatgccacatgaagtattccaaattttctattctaatatttagttcaccatcatggtggaaacaaactactagatcctgttagtatatatattctcctagtgatccagtgagtaataagtaccaaacactagactagaggtcatttctacctcgttcagaacggtgaaccattttatcccctctgtatgtctagctagtttgttcacagggttagtagaaaactccgttacattggcagcaaccccatttacgtgagtaaaatgttctagggcgaaccttcggagttgccgagggtttgcgagagcttgccacaaggtaaaggcccgcactcacaaattgggctaaacttcgcgcggcggatgcagaac

SEQ ID NO: 674898 - DNA, 148 bp, Homo sapiens
ttaccggccgccttttttaggtgccacacttaatagcttcatccacgtcctcatgtactacttactatggtttgtcgtcagtcccttccatagcgtccatacctactagtggaagaagtacatcactcaggggcagctgcttcagttt

SEQ ID NO: 674899 - DNA, 326 bp, Homo sapiens
  misc_feature (15)..(15): n is a, c, g, or t
ctgagaagcagtctngctcttgttgcccaggctggagtgcaatggcgtgatctcgtctcacggcaacctccgcctcctgggttcaagtgagtctcctgcctcatcctcccgagtaggtgggattacaggcatgcgccaccatgcctggctaattgtgtatttttagtagagatggggtttctccatgttggtcaggctgcttgcgaactcccgacctctggtaatccgcccacctcggcctgccaaagtgctgggattacaagtgtgacccactgcactgcgctggctgcagtagcttcttgtcctcccccttctgtcgtcttcta

SEQ ID NO: 674900 - DNA, 384 bp, Homo sapiens
gaatctgtctttaacaaatctccaggagagtctaagtgaacaaccaagttaagaaaccagcagaccagttctcttgtgaccaggtcaaaacaatggcacagcatgcttgtcgctaacacagaagatgtgctttctggcctgtgaaacgcgcctgctctccagtaaaacacagccaagtcaggtgctgggttccagtaagagaagttcatttgagaaaaccaatggtgtcttcgtaaaacaattcaagtgcaattggagataacctcccctaaaatggagtaatgaatgcaaatattcctgttcggaatcatggcaacggacccttctgagaacacacaagagctttagtttgagccgacagtggccttgcaaaacgggctctca

SEQ ID NO: 674901 - DNA, 153 bp, Homo sapiens
gccacaagccgtaacttggccttagcagacccatggagcagctcaagatgtgctgtagaccttctccaagacttcctagcctgtcaattgacatgatgtgagtacacctatggaggcagcaggtggctcgccgagctcttgcctcttttgggc

SEQ ID NO: 674902 - DNA, 517 bp, Homo sapiens
caatgtgcaggcgctcactaactaactggctaagggagctcactaactaactggctaagggagctcactaactaactggcaaggtgcgctcactaactaactggcaagggcgctcactaactaactggctcaggtagctcactacctaactggctcagggagctcactacctaactggctcagggagctcactaactaactggcaagggcgctcactaagtaactggcaagggcgctcactaactcaactggctaagggcgctcactaactaactggcaagggcgctcactacctaactggctacagggagctcactacactacactggctaagggagctcactaattacactggcacgggagcccactaactaacaggctaagggagctcactacctaactggctcagggagctcactacgtacctggctaagggcgctcactaactacctggctaagggagctcactaactacctggctcagggagctcactaactgccaacgcagctcactaac

SEQ ID NO: 674903 - DNA, 122 bp, Homo sapiens
gaaacccactccaccttactaccagacaaccttaggcaaaccatttacccaaataaaggataggcggtaggaattgaaaccttgccggaattaattttggccccccaaggggaaggttgaaa

SEQ ID NO: 674904 - DNA, 371 bp, Homo sapiens
  misc_feature (199)..(199): n is a, c, g, or t
gccgggggtctggaaacgcgcgcatcgcggcggctggtatggtcgaactacacggatctgatcgtttcgaacctccgatttcgttcttgatatgaaaacttttggcaatggtttcgctcccggtcgtcttgcgcggtcccaagaatttccctctagcggcgcaatacgaatgcccccggtcgtccctcttaatcatggnctcagttccgaaaaccaacaaaatagaaccgcggtcctattcccattattcctatgctgcggtatccaggcggctcgggcctgctttgaacactctaattttttcaaagtaaacgcttcgggccccgcggtgacactcagctaagagcatcgagggggcgccgagggctgag

SEQ ID NO: 674905 - DNA, 171 bp, Homo sapiens
gggggtgcattgacagacagacagcaagtgtgcggagtcatctaacattcatgtcatgacactggctctaggacgagcgtttccaacctgtttggactgtttccccctcccttttctaatcgaagaagcttaagcagcaaatgtgggcttttcccagcacaagaacacacg

SEQ ID NO: 674906 - DNA, 377 bp, Homo sapiens
gtgggaggagagctgagaaagagtagagagaatgtgtggtcaggagcacacagtccttggaggactgttcgttagggtagaaatgttttttgtcttgtatataggacaaggagaagactggtgagaaaaagatgaagacagagacagagaagagaggggaaaataagtgtgaagtcttggaagttaggaagggatgactttgacaaggaaggagagacttcttttgtcctcggagcaggggaaaggagacggaacacaggagtgtataccaaaggaatggagtattgacagtgccgtttctggaggccttgactttctcagggcagcagcaggcaaggatgtctgagagtaagtgggaggggtgtcacagagagaat

SEQ ID NO: 674907 - DNA, 515 bp, Homo sapiens
aaacgatatagagccgcccgtgtcatcatgcatgctggtttcacttcaatacttgcgtggcttacaatcaatctgatgttgtccctcaatagatccagagactgctatcggtctggatagtctgccgacacctagtattcagacgcactactgctgatgtcgtgaatggtggttcctcacatatgatccaggacactgtacgagagtctaatgttgtccttcacataggatttagaacactgctcccgtggtctgaatgttgtccttcacatagcattccagaacactgctgctggagtttgaatgtctttccttcacatagaattccagaacatggctgggagggtctgaatagtttgtccctcacatgggataccagaacactgctgcgagggtctaaatgtctcggtccctcacataagattcaggacactgctacgaggttctgaatgtttgtccctcacattgagattccagagcactcctgactgtggtctgaatgtttgtccctcaag

SEQ ID NO: 674908 - DNA, 682 bp, Homo sapiens
ccgttcgagcggccgccctatcccaccgcttcgactacccccaggggacttcccatgccgaaatggggccccctcaccaccaccctggccaccgcatgcctcatcctggcatcaacgagcacccgccttgggctggaccccagcaccctgacttcggcacctcccaccccatggcttcaccgggcagaccccacacatgcggcgacagggcccgcccacacatacaaaacacgatgaccccagactggtccccaagtgtgccctacgttcgatctccctgactgggcatgagtggacacaccccatcgtgaagctggaagatcacgagatacaacgcccattggaccacataaagacatccgcactcccacacccgcatgaccgaccagcagagaggctgactggcctgcaagatggaggacatcctaacacgaacgccccgatccacaccgaccaggcgccaggcaacagctgaacggcatgagagacacgagccgaggccatcatagtgaaggattccatatccagaagacacaacacatgacggggccccgcgagggcagcgaacaaggccaaagcacacacgcaggacacaggcaggacccctccgaggcacatcgcaacacagaccccaacagaaatcaaggggccgtcataccgaccacggccgaactcaaagatc

SEQ ID NO: 674909 - DNA, 163 bp, Homo sapiens
ttttttttgctaacatgtcagtccagtgagagtacggcagcaatcaagtcaccaagtgacctgaattgcttattatgaactgggtgctttctgacccatctagccatcaagggggccatgcacagcagcattcagcatcaaatcatcaaattaaaggtcgacg

SEQ ID NO: 674910 - DNA, 382 bp, Homo sapiens
agttaaaatgttagctattgccatcatcttattacatgaatattagaagacagagcgtacgactaatcatcaaagacaacaacgaaagcaagcaacagatcacaccacaatgttcaactgatggaaatggctaaactaagaaccagaaccggcatttatggcaaatttccccatatcatccttttctttccttcctggagtttttaggtttttaggatgaagtgagctgccttgtatattttcaaatgtggaaaaggtagagaaagaatatcaggtagtaaaaattaaaacatttgtaagtaacagcagaggaatgagggccctggaagcaaattccttggttgtcttagggtcctacttacatggtctcttatttcaaaag

SEQ ID NO: 674911 - DNA, 610 bp, Homo sapiens
  misc_feature (380)..(380): n is a, c, g, or t
agcggagtttggcggctggagaggcagtatgtccggttcaatggcgactgcgtgaagctagcggctgcgatgggaaagggcaggaagtcgagacctcagtcacctattaccggttggaggaggtggcaaagcgcagatctccttgtaaggaactgtggtcttgtgatccatgtggcgagtctacgtatgtctacccgacttcctctaactgatgcacccgtggcaggcagaagatggttctgactggagacaaagtctggtgtatgatgcaatgtgaacagcgtttgaaagatgtgaggacatactcttctgaatgccaggagaagatgctaagagcaggtactacatttggtgatatccatccgagatgaccttaaacnctgaatagtggtagcaatggaacccttcagacagatgatactatgcgataagttggctgggcactagttggagttttaacccattcatacggcgcgtgttcctctttacggtttcccgtggtaccgctaactagcacattcgggaagagcaagagtcctcctggagggagggccttgtgtagaaggttagaaaagttgcattccacgtttgggggccgaaaacttagaga

SEQ ID NO: 674912 - DNA, 149 bp, Homo sapiens
cctctggtgcacatcgaacctggcactcgcgccgtcctgtactgctttcttgattgcaaaaaccccttccgtcagagcagcaggcagagccggcgcttcttctgccgttgtgccttcttcagagcgctgagagccacctaggcgcctaa

SEQ ID NO: 674913 - DNA, 439 bp, Homo sapiens
  misc_feature (282)..(282): n is a, c, g, or t
tctacttcggcgtgagataatggcccgagaaaaatattaaacctgtcgcgtctgtgcacctcaactaatgataccctgcgttttttcttaaacccgactgttataataggcactctctggtgcgtctctacttttaaataacctgcgactgcactatcctgggcgcccaataataccctcttgtataaaaacactctttctcaaacgaaccactacctggcgtttaccttggggggttgtacacaaaagggcttgtgtcacttccgctcaacatctccctgngcccatcaatgaactgtcactcactcgctacaaggttcaacaaccaggtttatcaagcaccttaccacggcatctttgttacaatgtggggtacacataaccaactgtcctatagctttctcaagtattcgccaaccagcatcgtctggtcccctaa

SEQ ID NO: 674914 - DNA, 356 bp, Homo sapiens
ggcttcattaatacagaaaaaagaaaccgtctcccagaaaaccacccactgcgaaacagagtgtgtccgcccatcaacacacaagagcctctttgtgactcaacacgtggggtcgcaagacagagctggtggcactgcggatcacttccatccacctttagaacgtgtactcgcttcccgccctaaagtagtagacgtggcacttaaagtccagcttgaacacgtagtctttctgaatgttctcggactcagagggaatggtaagcgagtacccgaccagagccagcctgccaagggaataattgtcctggtgtgatttgtagaagatgaatttccacagcaggtttccagacacc

SEQ ID NO: 674915 - DNA, 1135 bp, Homo sapiens
  misc_feature (591)..(591): n is a, c, g, or t
gaatccatatctcttcagagcaagtgtggttccgatgagtctcttgtagcacgttacctccgttgtaccatagaatgatttacgttgacgtcatgggtcataactgagatgtcaattagcgttagattgcgagagatcctatcagttaatatttaaatcgtcgaggtcgtataccatcataaggttctctgatgatctctgattgcgaaggctatctcactttgatgtctatagatacgtagtttccgtgctgtccttcttcggcctattgattgacatcgtatcttgggcaattaaaggtcgatcgactcatatccaaagaagttggtcaacgtagtattatataacaaatcgtgacgagtctggtagtctcatttattacatcctatcgctttgttcctggtcgtcgactagcccttggagcacgaaagaccctaatagctttacgaagtggtcgattcgtgctaagaaattatatatggtagggttatattaagacttatatcatatttatacttaattataactagcatcgatggtcttcagggggttgaaagtgaatatatagtccatggtttataagaagaaatnttgactggagagtggttccagagacctatttagtcagggcaagggtgtaaataagtaaagctacttttgggtctgaaaaccataagagtatggagaggttgaattatgatttcactctctaatcataaaagtagttggatttcataatccgagaagtgagaagagtatctaaagttcataggaggtgggactattgggttgagaacaagttaactccttacttttgtagttcctgaggatgaggttggaatatcttatttttcaagcaatttgcggtgcctaaaggaattcaatgataaaattggaatccccctaaagaggaaaccatattgtaaaagctaaagggtgtggaaggtactttaatctaaggggaaatttccgaagataaggtggacgaagagataaaggggagaggttgtatgtggtccatttcgcgagaggtaatagggacattgggtgacgcggcgatgggtttccatggatagaatatagaagacaaacctttgaagtatggggaatagaacttctggagaatgtgggtaac

SEQ ID NO: 674916 - DNA, 122 bp, Homo sapiens
cacgaggggaaccatggctttcctgagggatgtgcatatgttcaagatcggaaattttttgcgacccaggaattttatgctgcttttaatactcaacatcacccccttctcctttgggatgg

SEQ ID NO: 674917 - DNA, 785 bp, Homo sapiens
taaaataaaggataatatcatggtaaggtcttaaattaatttataggggaagtaaccagggggtcttctttaggggatacccttgaacgttatgggggtgttggatttctctattccacaaaggaggggattcagaaaattcggtgacagacaaaaacaatatcccacatagagggtggcatcgaggtacctacgtggtctctcgagagaggccacatggtgtggggaagggtggatgggaggtagaaatccatccaattcgaggggccgtggagagagtgggtcacaccacaaagcctgtgtgtgagttataagcgagggtacaagttacaccgcgtggagcacaaagagatataccactgcgtatcggagcctaaataacgatgtggtggagtgtggtgttatatatgtaggacatctctcagacaaggcccagctctcactaaagagggagacagagaatcaacacccttcaggtggcgagcaccccccacacacctgcgcagagaaaagtagtaacgagaaacaagaactacaacaaaagtagtagggtgtaggggcgagtggcgtggtggcggcatgatgtgaagaggacgagacttaagaacacacgacgtctccacaccagtgtcggctccacaggtgatggtcaactaaacaaccacgtgatgccgaaccgggaggacgtgagaagtaggcggaaaaaaggggggaaactctcgacaaagaagacttctggaggagcaaagagagcatcgcaccagattaacacgaggggccacagt

SEQ ID NO: 674918 - DNA, 152 bp, Homo sapiens
cggcacgagtgaagttacaggtctgagcaataggtgtataaaaatggatctgtcttgagacatcagaagtgattttccagtccttgacaacctagcttgttgaaagctttctgggtttggggggattcagtagtacccttaaggtttagcag

SEQ ID NO: 674919 - DNA, 189 bp, Homo sapiens
ttacattgctgtgctactattattgttattgaaattattattagcaacacttatgtatcaggaggctaggtatgtttcttttggagtcaggtttcactctgtcaccaggctggagtgcagtggcgctgatcatggctcactgcagcctcaacctcctgggctcaagtgattctcccacctcaggctact

SEQ ID NO: 674920 - DNA, 510 bp, Homo sapiens
atcactccccgctgcggggggttgttatataatatagacaacggggtcctttctttgtttgtggcgcgcgctcctcatgctgctcctcgtggggagaccccacttcatcaccgggctcgcgtttgtgttacgccccctctgataatatgaaccagccgcggggttcaggcttattcctcgctctcctccgcggtctgtttagtcttctttgctgccgcgcggtggcgtgagtgaatcacacttctttttcacccaccgtgagtacgcctctctttgttccaccgctgggccgtcttttgggcggctcctcattgtgcgacgttttgtcgtcgagaaaccacggtggtgggtccccgtcgcgggtattctcccgggttagttcttctggtcccccccccctcctccgctcgtggattagttttagggttttggttccccgcggggggggggggggccccccacggggttcctccccttggggccccctgtgaaaaaaaggcccccccctta

SEQ ID NO: 674921 - DNA, 496 bp, Homo sapiens
  misc_feature (11)..(11): n is a, c, g, or t
  misc_feature (46)..(46): n is a, c, g, or t
  misc_feature (88)..(88): n is a, c, g, or t
  misc_feature (99)..(99): n is a, c, g, or t
aaaagcctgtnacagaactgcctcgtgtttcctcattagggttgcntccaccttgagcacacgtgtgggagcaagcgagggaagtcancctaggagggnagctgccgggcctaatgggcggatgggccgcaggggagggaaggcatgctgttggtgactcagagtcagcgagaggtggatttcgccagcaggaagttggattcaggaggcactgccgggtacttttccatcctccctcctctccccctccccaccatgatcctgtggttcaggatgccaaaatgcacaggccaaactcagcttgtttcctagaactgcacgaactgtttggactgacttgaactggtcaaaataaaacaaccgaggaacctgtcaaaatccagtgaagaatgtacactctgcttttgtgcaggtgattgttttgaatgacagtgtttgtgaccaacaacccaccactattttctaccatcaatcatactctactccaaaccaataa

SEQ ID NO: 674922 - DNA, 854 bp, Homo sapiens
ctccaaggaggtggtcaccggcatccgtggggccatcatcctggccaagctctccgggaggcagaggtgctggtggcgcggggagtgcgcgtcacggtgaacgaggcctaccggttccgcgtggtactgcctgtgtacccagcgtcgctcaccgacgtctccctggcgctgagcgagctgcgccgcaacaggactcaggtatctatcgctgtgaggtccagcacggccatcgaatagacagcagcgaccgctgtgagaggtcaaggtcaaaggggtcgtctttctctaccgagagggctctgcccgcctatgctttctccttttctggggcccaggacggcctgtgcccgtataggagcccatcattagccaccccggagacagactctatgtcaggcatatcccttgggtgggctagtgagtcaactgtgagtgctggtctggctgtcggcatcagacccgtgaggtatcccatgccagatccaccaacgagagggccgtcacggagacatggatggacttaccccggggttccggaactagtggtgtgtgtggacccggatgacgctctactgatgtgtactgttatgcggaagacctaaactggagaactgttcctggtgtgaccccgccagagaagctgacattggaggatagcactgggcgtactgcaggagcggggtgctgcagattgtcaccagggtcaaatgtatgcgacccggggatgggtgtctgtaccagtggaggcaaggtgggagcgtgatggcagtgtgggcgtaacccatagtacacccagccaggctggggtgggggctgctggtgtaagaactttcctctcccaacaaagggttccc

SEQ ID NO: 674923 - DNA, 541 bp, Homo sapiens
gatgaggccgttgtccaggatagtgcgtagtacttgagctgccggagttcccggcccagtgacgccaaagtgatcataggcctagatactgggatcgcgagactactcggggtcgtcaaattctgggtggatccaagtgcccttgtaatctgagttgtcgatctgccggggtgttccacacacccttgtactcagggttctgaatcactgggggtacccagtctccgtccatctcttcatcccagacctcgggctatcttagcatcagggtcagggatatgctcgggcttgtcccagtcctcaggcttggagtctgtgggatcatcgatcttggcccgctcatcccagtcttccggttttgaagcatcaggatcctttatcttcttgggtggcaggaagtcccaatcgtcttcccaaggagccggactccacctggctgtggtcaatcttcacctcataggtgtcgtctggccgcacaatcagtgtgtacaggtgtgtaaactcatcatccttgcaagggatgtcttgttgatcagcacag

SEQ ID NO: 674924 - DNA, 1104 bp, Homo sapiens
  misc_feature (607)..(607): n is a, c, g, or t
aatgtcaacatggcttcgcgagaacgtacgtgtcacttccctcttgccagccctcagactcctagcctacagtatccatgatcatgatcaacaaatcgtgaccttgagctgtcgtactggcggcctgttcttacatccctttagtcaggcatacatcataatgtatggaaactcatccacgaaccatctcgctgaacgggtgagttttacgtacctggaatctccgaaccctcataccattcacatacggatactcagcgctgtgcatacgtcgcgactaatagtccgagaggcctgtagtagaatccgtgtcccgcactgtgggccaccacggtgccagtctggagtgtagtaaattcgagcaagggatatctcttataagcctagaggcctcgaattgcaagatggcagctctgcgttaacgagataagatgtgcgaacaggtagagacctggttggatccttagtcggggcgaaagacctctagaccgtggactgtgtggaggacgcgttctggttgtgtacgacccccttggcggtttgatagcggtcggaagcatctcttcatccccccatgtgactattacttgttcacgggaggaagtcnggccctgtcactggtgacgttagcatttcggctcgcaaccgatgggttctgacatccccccagtggtcgcgcggtgttggtggggcctgcgacttgtttcgtccagccggggctggtggtgcccctccctggggttattggggcggtagcctgtgcccgagggaaactaaccccaaactactggagagtggtcatgtgtgccctgttcctgcagtgcgacggtcgtgccatagagacatcgaaacgtgcaacgtcgcactgtccaagtatcgccccaaagtggaagccatgctgctggccttgcacatggaatccgtgggcgcaccagtgcgatccccctatgcagggcgctccgtgacgagtcatttgctccaagttgccccccatgtgttgtccttggaactccaggactggtgtccccgaaagtgactcttggcctagggccaaaaatgggcaatttagctgtccccatcgtacccgtacacctccctggaaca

SEQ ID NO: 674925 - DNA, 339 bp, Homo sapiens
ttcgatgaggtcgcaaatggctgtaatgacaggacacccgtcgaccacgcccaggataattgcttgtatatctattagtagagatggggttacaccaatcttggccagggttgtcttgaactgctgacctcgtgatccacccacctcggtctcccaaagtgctgggattacgaggtgagagccaccgtgcccggccttctttctttttttgagatgctctgtcacctacactggagtgcagtggctctatctcggctcactgcaacctcttgcctcctgagttcaagtgattctcctgcctcagcctccagagtagctaggaatacaggcgcccaccac

SEQ ID NO: 674926 - DNA, 88 bp, Homo sapiens
acagcgaatgtgtcagtagaggtgtgatgactgacaacgacacttgatagatgtctgacgtgagtgttgatgttgagtctatgctctt

SEQ ID NO: 674927 - DNA, 292 bp, Homo sapiens
  misc_feature (32)..(32): n is a, c, g, or t
  misc_feature (46)..(46): n is a, c, g, or t
  misc_feature (84)..(84): n is a, c, g, or t
  misc_feature (86)..(89): n is a, c, g, or t
  misc_feature (129)..(130): n is a, c, g, or t
  misc_feature (166)..(166): n is a, c, g, or t
  misc_feature (252)..(252): n is a, c, g, or t
  misc_feature (279)..(279): n is a, c, g, or t
ctcgtgccaaaatatattatctcaagtatttnttaaaatatatganttctctctccaaatattaactaattattagattatatntnnnntgaacttgttggcccatctattacatctacagctgacccnngaacatgggggttaggggagctgacaattcgtgggnccgcaaaatcttaactacctaatagcctactattgaccataaaccttactgataacataaacagtaaattaacacatattttgcgngttatatgtattatacactatattccnacaataaagtagg

SEQ ID NO: 674928 - DNA, 235 bp, Homo sapiens
aaggggtactagaggatccggaaaatagcgacgcatgggtgggaaagttattccttttcaaattcctttccctctggttgtaacgtgaagaaagaccctctccaggctggaatagccttcgcgctctgacgcgtgttagtctcctgctttgtaaccgagaggccagccccggggccacatcagctggaaagaaggaacacggccgtcggctacatttgcccgttcggtaaatttt

SEQ ID NO: 674929 - DNA, 136 bp, Homo sapiens
aaaagggcaaacaaagctcatgagtgtaaagtccaagattagtttgcgcataacatgaggatatattgcattttagcatggctatcttctgacctcttccagcagttcgtctgccatcattctccctttctggtgg

SEQ ID NO: 674930 - DNA, 614 bp, Homo sapiens
cttgactaaatagcatatctgcaggaaaatatcttgtttgtagtgatatgccccaagagtgaaatcaatcactattggggcatatcactacaaacaagatatgccccagtagtgatggatttcactctagagatgagttatatcacttaatttgttaaatgtatgagtggagagacatgtacactgttcagaagcactgctagcagtccatagtataccagttgatcgctcaaacagctctactcccgtgtctcaacagaactagcgtataagttgccacgcccatatcacgccgtctaccatcacccactgctcgctacaccaacacatctctccgccagccaacgcctcacgccacctttggccagctccatcaatgctggattccgacaaacgtgttcacaacagcagacagttgtccacagtacaacctggaatacgtcagttcgatcggctcactctactcgatagctaaaatgcacacatggggacgcgaccagcggacaagaagttactggtggagaataccaaggcttcgtaacccctgacaggcggaacctggataacactgatctcggtgcagggcacacgggctagccacgtggacacgaaag

SEQ ID NO: 674931 - DNA, 558 bp, Homo sapiens
ggcgccatgtgctgctgcacgcctcgctgtcctgtgtatgtgctgctcttctgctccgccttgggcttcccgcggccactgggggcgctactggtgctgagatctcggataccaactcatctcgtggcaccttccacctacgtggagagagggcaccaccaaaagtgaggtcttctacccaggggagacggttgtacactggtgcctggtgaggcaacagcttgtgtgagtgggggccaaacacatggatgcgtgcgagtacggccgaggcgtcatcccatccatcctggccttcgcgctggccgacatgtgtcttcagcacccagtgacttcctcaccctctttctatactcttcgctcctatgctcggggcctccggcttgagctcagcacctatctctttgggcaggagccttgaccagccaggcctgaaggaagacctgcgcttggagaggagcgggcaggcccgcacatatccacttgctggagcccatgtttacagacagggacatacaccatgcagatcctgagttcctgctgtatgagcagggatatcca

SEQ ID NO: 674932 - DNA, 829 bp, Homo sapiens
gtaggactgggctgtgatatggcaaacgtactgctacgtggcacagcatagttagtgtataattctctcatatgcacactattcatgactaactgagagcatgaacatgatgaggtgcagagttgcagcgtttcaaccgcacgaagtgggtcctgtcattgttttccgtcattctatctagattcagctgtctgattgccaagcacaagggcaccatttgccctctaagcggaggcgtgacttatcataagactggcgttcatgagtgcgcttgcgagtggagaatacttcgcatatgatcagtcacagatatgagccatctgatgggagaatcaagtgatatagagagctgaccctggacttgagtctcgcacaagcgctcaagaatcgtaccatggagatagaggagcacgcagagcctctgtgatgaaccaggtgctagaggctctctcagaatagagttgtggaacccactatgcactagagtctgggtacctctcagcgtgcagtgagtatgcatcttgcatagttcggtgcagagcatcctgcagtgatctggggtactgttggtcgtttgcatttatattctgcctacttgagttcgtcagcagtatacccgtgctcgctgctccacaggagtggcaccagatatagtaaacagcggagctacgtttgagtctggctgttgccaccatctccattgctggtgctaatgcctgctactcgggatgctgctaataggccctgagtctactgggggaagagagatcattccaaatggacacaatcatagggggaagacccttacctggcaggggtgggccaccca

SEQ ID NO: 674933 - DNA, 311 bp, Homo sapiens
  misc_feature (33)..(33): n is a, c, g, or t
  misc_feature (48)..(48): n is a, c, g, or t
  misc_feature (125)..(125): n is a, c, g, or t
  misc_feature (240)..(240): n is a, c, g, or t
  misc_feature (286)..(286): n is a, c, g, or t
  misc_feature (289)..(289): n is a, c, g, or t
cttgaacgaaagatgccgtaagtaccgcaatgnagggaacgaatatantccagggccaaggctcgggcgcaagaggcaagcgcctcctccatcaagcccagcactggcctcaccactgccacttntgcagctgcagctcatgccaccctcccgctctgcctcctggttctcttgcctgcccagggccgtttgctgggtgaaggggcatccccaccatcctcggcccatttccgtttgggnctcagccgtgcccctgggctgccaatcgctggcaccccttggtganccnactgcagcgccttcactctgca

SEQ ID NO: 674934 - DNA, 213 bp, Homo sapiens
catatacgaatcgagctctgtacctgaacattcgtgtccatcaaatgggatgatccccattagctcctcgcgcagtgccaatcatgattgttgcagttcccctatttcaactttcctgatatgcagggggactctctttgccccatcatgtttaaatgcctttgaccactatagtcgatccactgtaatatgctggtatgtctcgagatatat

SEQ ID NO: 674935 - DNA, 618 bp, Homo sapiens
  misc_feature (368)..(368): n is a, c, g, or t
tcattctgggttctatttgccccacacttttcagaagtttccaggcagttgacagggccttttcacctgggttccaatgtttgctgtgaagcaaatgcagcgcctccccttttttttattcccaagcaaaatttctgggttcggcctgtttgttgacccggggtgttcatcatctttggcgggtggggtgtccagtgtacaatcttctcccaatgagtgtgcacgctccacggaggttgttgtccaagagcgttctccgtgctacatacgtccctaaatatactcaccaattggatcacgggggttctgcaaccactctctcaaggtgaccctgtacgcggtggatacatgtgcattttcgcatgttnctatagactcaaggggcactctgcccaaaccaggccatcgggctggcggcgtctccaccttgtttatgagatggtgttcaaatagtctaagtgccggcagggtcacacgccctctgctgtgatgcctgccaaccacatgtcagtccttttctggaatacaaaaaccaattttgcagacctttgcctttgagccacaaacaaattggctggcatcctttgtgccacgatgaaggtctatgtcccgggtagc

SEQ ID NO: 674936 - DNA, 220 bp, Homo sapiens
cgagcaggcacactttcgttagtaactctgcccgagaaacaagttcagcctcgctcaccgggctggccacgatacgggagaagagacttccatggttgtgttgggtttcatttatctccaggcatcatcgccgtgcctcctcacctcacctctcttctctcccgctctctcctcctccacagatgccacacgctggcagctctgaccagccccatccctc

SEQ ID NO: 674937 - DNA, 194 bp, Homo sapiens
ggggggggggtttggccccccccccccccgggggggggttttttttttttccgggtttttttttggggggggggggggcccccccccccccgggttttttttttttcccagagattttttgggggggccccctttttttttttttcccgggcccccggggggtttttttgcccccccccccccccgggggggga

SEQ ID NO: 674938 - DNA, 213 bp, Homo sapiens
tactctagaggatcgttcaggagagagaactggagcctgagcttgctgccaccctccgtgaagctccacttggacaacaacaagttggacaggtgccctcaggctcccagacctcaagctcctccaggtggtctatctgcactccaacaacatcaccaaacgtgggtgtcaacgcacttctgtcccactgggcttcggcggtgaagctgggcc

SEQ ID NO: 674939 - DNA, 435 bp, Homo sapiens
cgatggattgtctggctcaccttcagccctgtgttgagaacacacgtgctcctcctagctgagccttctgagtacactgggactacaggatgtgcactcctcgcgggatacattctcatcatggtcacaggcaggatcttgccaccttgcccagggtggtcttgaaactcctgagctcatgccatctgcctgccttagtctcccaacatgctgggattaccaggagtgacgccacccatgcccggctgccagttgcatggacagagaacacctctttatggcttaccctctagaatttctacattatgtgttctgtggacactttttgtttgtttacctttatggacacacacaaaaagtcagtatggaaacataatctcctgtccactgttgtcaaatgatgatactgtgccatgatgtatcatatcatatcat

SEQ ID NO: 674940 - DNA, 265 bp, Homo sapiens
  misc_feature (167)..(167): n is a, c, g, or t
tcgtcaagagaatactgggaaagggcatgaaagaatctctggatggtaatatcctttatcttgagaagggcatttgtcaaagctcagcaaatgtacaactaagatttgtgctttttcataggtattaaatttttaccctcaaataaataccatagcgccaggcacgngtggctcacgccctagtaaccccgagcatttgagggaggccaaggcagtgtggacacgcttgaggccagagagttcgagaccaccctccgtctttcga

SEQ ID NO: 674941 - DNA, 435 bp, Homo sapiens
caagaattctctaggccccagtggtttcactgatgaagtttaccaaacattgtggaagaaataataattttacataatctcttccagataaagaagaggaaggaacacttctcaattgattttatgagattggcattacccaataaaaccaaagacattacaattaagaaaatgtcaacccaatatcctttaagaacacagacacaaaaatcttataaaatattatcaaattgaatccaaaaatatatttaaaagatattaataatatggcatgatcaagtggggcttatccccagaatgcaaggctcactcaacatttgaaaagccatcaatgtaattcaccacatcaacagtctaaaaaagaataatcacatgaatatcttattggatgaagaaaaagtttagaataaattcagtaatcacttcatgatacac

SEQ ID NO: 674942 - DNA, 145 bp, Homo sapiens
tcattcctacgtatttctggtatgaatgtgttggtgaatgtatgtgtaaaagtctttcttttgcctaagttgcttaggtggggtccgttaaaacatttcccaactaaagaatagaatcgtaaaggaaaagtggtactgttccaac

SEQ ID NO: 674943 - DNA, 470 bp, Homo sapiens
  misc_feature (3)..(3): n is a, c, g, or t
  misc_feature (37)..(37): n is a, c, g, or t
  misc_feature (42)..(42): n is a, c, g, or t
  misc_feature (52)..(52): n is a, c, g, or t
  misc_feature (134)..(134): n is a, c, g, or t
  misc_feature (159)..(159): n is a, c, g, or t
  misc_feature (346)..(346): n is a, c, g, or t
  misc_feature (358)..(358): n is a, c, g, or t
  misc_feature (370)..(370): n is a, c, g, or t
  misc_feature (432)..(432): n is a, c, g, or t
  misc_feature (437)..(437): n is a, c, g, or t
aantcaaaaaaattagccaggtgtgatgttgtgcgcntgtantcccagatanttgtgaggctgaggtgggaggatggtttgggccccggaggtagaggttgcagtgagctgagattgtgccactgtattccatnttgggcaacagagccagaccctgcntcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtttttaccaaaaataaaaataaaaattatccaggcgtggtggcatgtgcntatagccccagntactcaggaagntagagcacgagaattatgtgcatcctggaggtgaaggttgcagtgagccaagatcacaccantccantccagtttggacaacagagtgagaccctgtgtc

SEQ ID NO: 674944 - DNA, 124 bp, Homo sapiens
gcgaatgaggcaatttattaacccagcatggttggctataaggcatcttgttggcagataccacctgtccgtcgatactgtacagatctcagtgtcccttctgtcgtcgtcttgcagcagtata

SEQ ID NO: 674945 - DNA, 121 bp, Homo sapiens
cgccgcagaatcctaatctaacattgtgtgtgaggcggaagggatctctccagcgagagggaatgcggcaattgccagacggacattgcatctgcagaaggagggggtaggatacacgcgg

SEQ ID NO: 674946 - DNA, 157 bp, Homo sapiens
atcaatggtagtacactagaggatatgcaccatactaagattggatccggcgtggagactgcaagactcaagaggcagcattggacacgtaggaatatatatatgacagtggagtagttgttgctgagggctgtgtggttgagtatgtattagctgg

SEQ ID NO: 674947 - DNA, 450 bp, Homo sapiens
  misc_feature (282)..(282): n is a, c, g, or t
  misc_feature (287)..(287): n is a, c, g, or t
  misc_feature (401)..(401): n is a, c, g, or t
  misc_feature (420)..(420): n is a, c, g, or t
  misc_feature (427)..(427): n is a, c, g, or t
  misc_feature (448)..(448): n is a, c, g, or t
aatttcagcatttttttttctatttcagtgaagaatgttattggtattttgatagggattgcattgagtctgtagattgctttaggtagtgtgaacattttaacaatattaatttttctaatgtatgaacatggaatttctttccattttttggtgccctcttcaatttctttcatcagtggtttatagttttcattgtagaaatccttctcttctttgggttaagttaattttgagggtactttattttatttgtgggcaattgggaaatgggaattcccnttccnggatttctttttccaggattgttttctgttgggcatataggaaatgcctacctggatttttggtatgttggatttgtatccccgccaacctttaccggaaattgttgatccagntcccaataggtttccgggngggagtnccaggggttttcccccaatantt

SEQ ID NO: 674948 - DNA, 127 bp, Homo sapiens
caactcttacgaaatcctttttctgagtaactaattagtatctgtccaactctctatatcggtgacaccacaacaatgcaacgtatttggatcttgtctactgcatggcttctatccctgaagattg

SEQ ID NO: 674949 - DNA, 195 bp, Homo sapiens
ccgtgatctcgttctcttcatcttcactctcagtctcactgatctgctctgcttcctcttcttctcgctcttctgtctttcctgggccatctgtccatcccttctgcacgaagattgccctctcctaccctgtccactccaagaaactccctctccctccagcatggctgttccttcccgcacgcttcctctctc

SEQ ID NO: 674950 - DNA, 178 bp, Homo sapiens
  misc_feature (66)..(66): n is a, c, g, or t
tgcaacaacacacttggaccctctgggctggggtttgactgacctcaagctgaaataaggggaccnataccagctgtgataacccatgggagagcctaggcaggaccagtggggcccaaatcttgctgctcttgcacttttaggcactgcccttgcagactcacctttctccacctgc

SEQ ID NO: 674951 - DNA, 133 bp, Homo sapiens
gcacagtagtgggtcattggaaaaagggcgaggtctgggtgattatcccaggatctggaactctcccacccctcctgcagttggactgaattcttccctttcatccgaaggacccacttgctgtttccagccg

SEQ ID NO: 674952 - DNA, 112 bp, Homo sapiens
ggtcccctctgagcagagggcctctggtcagtcagtcctctccaggacctaacgaatctggctctgcctgaatcatcgatgacggggcaaaggcgagtggggcagatgggag

SEQ ID NO: 674953 - DNA, 172 bp, Homo sapiens
ttagaggatccccggtacttgcgcctgggatatggaggttgcagtgagctgagatggcgccactgcattccagcctgggtgacaagagcgagactctgacaccaaaaaaaaaaagtaagcttcatgaatttaaagtatttttcccttgtgcctgtgaaggattttctggttt

SEQ ID NO: 674954 - DNA, 307 bp, Homo sapiens
tacagcttacaattctgatacggagtggtaaatccagtcgatggaatccagcgtctcgtactcaaatgccaccttttattgtcctagttcttatttctcgggaaaggagggttctactttagcacattttatgagccagcagtggactttagttacaatgtgtaggttccttgtggtcctagctgcagaagaagccatcaaattcttgaggacttgacatctctcggaaagaagcaaactagtagactgatgagctggattgcttagattgataacatttacaaataggagtccagttgacatgcta

SEQ ID NO: 674955 - DNA, 1065 bp, Homo sapiens
ggaaaatgtggtcatcctaaacatgccgtatttacttgacaggaaggacgagagggcaggccctaacatccagtgatcctgtgggcaagtgaatgctatgctttcctttgtgctcctgattgggcagtactgagccccacggaaccctgagattctcattagggaaccttacagggccagatattctaggcagcaggacaagtgacccaaattcttttattaccttctggacctttaccccatgatagagtcttgcagacacaacacagaagtgggatgcagacatgtaccaggcagacctagatgacagactctggctcagagtctggctcgtagctgcctcctgaaactcaaatgctcatcatctctcttcttcaactggccttgccatacttaccaccaaaccaccatctccaccatttcaacatctaaaaaaaacgatatcaaaaactcacatgagcataaggcccaaactgacactcacactaaagctatataatacaatcagatcccaccctccagaccacttcgaagataggataccccgctgaaataaccccccaagggcaatcgagaaagcccacagatcggaacaagacaccaatcagtgaaaacataccaacccaacatactcggagacacccacctgagaccacaactcagcatccattcaacaccatgacacatggcatccacgatcacaggcctcaagaacaacacccaccccactacctacccaacacgccaagcccccgaacacccaaaagggggcacaccataccgccaccctggacagccatcaccccgcgaacaccccccaccacaaaacaccacagacaaccaacacccgaagaattaagaaagcatagaacacgaagcaacacccagccctaacgccccagacccagctaacaaaaactacgcacggtcaatccccgacgccaactccacgagaagacgcaagcaacatcacacaccccaccaccacccacagaccgaacatctcgaattgcgcaacgccatctcaacacaccaaaccaacaccgccgccaatcacatactccc

SEQ ID NO: 674956 - DNA, 126 bp, Homo sapiens
aacaaggtcgtgaaaaaaaaggtattgggtagaggtcccgccatttaaatctgtccctcaattctcttgcgccttgcgcaagagcttccagcagcggtaatgtgggccaagaagcatccggaggtt

SEQ ID NO: 674957 - DNA, 881 bp, Homo sapiens
aacggacgaaccgcagaggtgacctgtttagagaggcactacacccgcacgttggggcaagaaggggacacattcggcccggagaattagccctgggaaaagggacccctctggaccgggcatcccaccggggggcaagtgagcatgtgaaagtctggtacaccaaggaggacacttgtgagaccgcgccgacaccacttcaagacctgggcgccctgccccccgggttgcatgggaccggaacagcagtgaggcacaattgccccgggccacgcatgactataaaggggtcctccgtcgagcaacagattaaacagcgcggtacccccccaggagcaaacgcgaggggaagagttcccggcgacaacaccgacaagctaggggttgttgaacaacaaaaagcccccaggggggctaattcctccaagaggagccctcagcaaccccctccccagagcgatcttgcgaggccaaatctcagtctgcgcccacactccttcaagaacgcgcccccgcggtcataccgggtgcaaacatggtctccaaaaaacaccggaggcgatgttggaaccccccccccagaagactgcccaagggctgccaccagtggcgctccgtcgcaacaaacttgcccgatgcacgaacagtgcaacagggatcagcgtgctcgcttccccacgccacgtcaataatgggtactcctcacaggtgaggggaaaagcatgttccctgcaaatatatattcgaggcgaggcaccttatatctggtttggagaaacgccccttctgatgctctcccagcgttggagggttccccccccccattttggtccctcctttttcgcccgagtaaaaagcccctacttttcccccaaaaaaca

SEQ ID NO: 674958 - DNA, 201 bp, Homo sapiens
gcgagcccccactactactaaatttgcggccgctcgacttcaatggcttttagtatattcacagaggtgcaaccatcaccacaatcaatcttaggacatttttattaagccctcccttctagatcacttagccatcaccaaaaattccccccatcccacccagcccatggaactactaatctcctttctgtctctacagat

SEQ ID NO: 674959 - DNA, 896 bp, Homo sapiens
acttcaggagcggcagtgctgaccaagcgcgcgcctcctcttgggccccacggtccgctgccggaactcatcatcttcctgcacacgctcaacaatcgatctttgagccatacgtggccgtgagagacgcagccaaaatgaacgatcccacacagtgggcgagtcagtggacaccaaacatgctaaccgctcgtgcctcatcaccgtacccatgtaacccggcaatgacgacgtctccgctggcttgtgcaccgtcgtactgcgaggctcttccagaccggccatcaccctgggcacaaggagaagcgcgaagcaggttgaggcttctctatcgcctgcagggccagaaggagcccggggacccacgggccaagtccgcacctctccatggggctgacgatgagccgttcccgtgtgcatgttcgacatcatccatcccaaaagcaaactcacacgtccaagcgctgtcgtgagctgggaatccctcgttcccgcagacctgggtcagcggcatccatcagtcgtcgttacttactcagctgatgtcgcagtgcagacatccatcgttccacactctagaaccatgtggctgagctggaccaaccgttgccatgtgcgttgcaactgtaggggaacagagcacagagggtgagcgacatgtgcacaagaggcgccttgggtgcacgttaggactcagtggcgtggtatgcgcgagcctgctatgaagatgctgcgtgtccatgtgaacccagcaggccatcccttcaccgtgacccctgtgacctttggtcaggaagggtgcaagctattcttcgcaatctaaaatgcctgtcaacgtggtgccggtttcgttagggaacctgggtccaaggaggctggaaagaaacggaagaatg

SEQ ID NO: 674960 - DNA, 187 bp, Homo sapiens
caaaaggtcagagggaggagtcagaactgtgcctattccctgccacttttgttccagttcttttattcatttatttgtttgtttgagacggagtttcactcttgttgcccaggctggagtgcaatggcacaatcttggctcactgcaacctccacctcctgggttcaatcgattctcctgcctctgc

SEQ ID NO: 674961 - DNA, 410 bp, Homo sapiens
gaagatgtagtcttacacattcttacaaatagaaaacacacacttcaatttctgaaaagagtcagatacaacaaaactggataggaaaatataaaaaagatcacctaccaagactgtaaacaagaaaacaaggcctatgaccatctgcagagaagttgaatccaccatgatcatacaaatatcatctcctaggtacccactgccaactagctaatcaataatatctgcaactgtttctgaaatccaagtttcttaatcttatttaatctacctgcagaaattagttttacaatcagaagaactaggttaaaagactatgaatagtatacctaaaatataaatggcttacccttcttggctattttttaaaaatttaaaaaagaagaaacccaggtttgggggctgaggag

SEQ ID NO: 674962 - DNA, 402 bp, Homo sapiens
  misc_feature (39)..(39): n is a, c, g, or t
  misc_feature (67)..(67): n is a, c, g, or t
  misc_feature (71)..(71): n is a, c, g, or t
  misc_feature (82)..(82): n is a, c, g, or t
  misc_feature (88)..(88): n is a, c, g, or t
  misc_feature (122)..(122): n is a, c, g, or t
  misc_feature (126)..(126): n is a, c, g, or t
  misc_feature (141)..(141): n is a, c, g, or t
  misc_feature (190)..(190): n is a, c, g, or t
  misc_feature (193)..(193): n is a, c, g, or t
  misc_feature (197)..(197): n is a, c, g, or t
  misc_feature (204)..(204): n is a, c, g, or t
  misc_feature (209)..(209): n is a, c, g, or t
  misc_feature (235)..(235): n is a, c, g, or t
  misc_feature (243)..(244): n is a, c, g, or t
  misc_feature (256)..(256): n is a, c, g, or t
  misc_feature (284)..(284): n is a, c, g, or t
  misc_feature (291)..(291): n is a, c, g, or t
  misc_feature (297)..(297): n is a, c, g, or t
  misc_feature (299)..(299): n is a, c, g, or t
  misc_feature (328)..(328): n is a, c, g, or t
  misc_feature (381)..(381): n is a, c, g, or t
cgtagttcttgagcagtgcgtcgatggttgtgcgacgtntgtgtcaaacttgctgtaggtgctggcntgangatctggcgcnaggtcncgggcggctgccgtcgttcgaggcctccgccatnaggngtttggatgccttgntctaggtcctttaggaggtgatagtcatcgctgtcccgaggtgtcatanacnaggntgttggngaagntgctcctgaggaaccgcacggggtcnagccacgnntcgatgagcagnagggtgatgcggagagctctagattggntttctgnggcggntnctgcatgttggagggtgtgggaatagagngtgagaagcagaaggaggtctgggggtgatgcaggaatgggtagttgtggtgntttgggatataggtttcttca

SEQ ID NO: 674963 - DNA, 879 bp, Homo sapiens
  misc_feature (41)..(41): n is a, c, g, or t
  misc_feature (91)..(91): n is a, c, g, or t
  misc_feature (119)..(119): n is a, c, g, or t
  misc_feature (125)..(125): n is a, c, g, or t
  misc_feature (128)..(128): n is a, c, g, or t
  misc_feature (159)..(159): n is a, c, g, or t
  misc_feature (354)..(354): n is a, c, g, or t
  misc_feature (410)..(410): n is a, c, g, or t
  misc_feature (415)..(415): n is a, c, g, or t
  misc_feature (424)..(424): n is a, c, g, or t
  misc_feature (427)..(427): n is a, c, g, or t
  misc_feature (445)..(445): n is a, c, g, or t
  misc_feature (464)..(464): n is a, c, g, or t
  misc_feature (467)..(468): n is a, c, g, or t
  misc_feature (479)..(479): n is a, c, g, or t
  misc_feature (493)..(493): n is a, c, g, or t
  misc_feature (516)..(516): n is a, c, g, or t
  misc_feature (525)..(525): n is a, c, g, or t
  misc_feature (531)..(531): n is a, c, g, or t
  misc_feature (568)..(568): n is a, c, g, or t
  misc_feature (581)..(581): n is a, c, g, or t
  misc_feature (608)..(609): n is a, c, g, or t
  misc_feature (621)..(621): n is a, c, g, or t
  misc_feature (641)..(641): n is a, c, g, or t
  misc_feature (647)..(647): n is a, c, g, or t
  misc_feature (659)..(659): n is a, c, g, or t
  misc_feature (669)..(670): n is a, c, g, or t
  misc_feature (727)..(727): n is a, c, g, or t
  misc_feature (755)..(755): n is a, c, g, or t
  misc_feature (789)..(789): n is a, c, g, or t
  misc_feature (798)..(799): n is a, c, g, or t
  misc_feature (804)..(804): n is a, c, g, or t
  misc_feature (816)..(816): n is a, c, g, or t
  misc_feature (822)..(822): n is a, c, g, or t
attgtacttcataaacagaaaagagaaatatcctgggagcnggaagtgaactcttttctcagataatgttctctaaatccgcgagagcganggtccatgctcccggctcttagcaggtngttggnggncacttggttatagcggcggggggccagaggnctgcgtctcactgaggaatgtgttcagggaagatgtcaacactggccgggaaaaacatcaggctttcacctcactcatggcctccataaggcgagcgctgtttgtgactgctgtcgtcaggaaaatgaacctgtagtcctttctctctgcccaggaaccggagggctgagatctcagagaatgtacaaccacccnagaacaccaccaagatgagtgtcgtcgtgtgactcactgtgaagtccttgtgcttnccttnagttgcatnatnctgttgtaatgtcgaaanttcaactgtcagtttgtantcnntccgtttaccnaccttcaatctaantgtcccctgtccagtctttcgcncgtctactnagtcancctgtctaccaatgtatttcgtgtcagtcttcagtgntgtcaccataaantcaaccaaccgtaagtacgttaagtcnnatgttcttcgtngtgtcacttttacagtatcnataacntcgtccgttccnacaacgttgnngtattcaaaatttcagtctttttttgtctgtatgtgtcacgtaaaaaattgtctccntctttgtgtccagtagtaaactgtaagngtcattcagtttaattcttttccctgtcagtccnttgtttcgnnttcanccagtctttgtnttcaantttttacttcttcccacgtgtctgttgtaggtgttgttccccgttttttttcctgtc

SEQ ID NO: 674964 - DNA, 639 bp, Homo sapiens
actacggcgctggtttctcagaacgaggttgtcactgtgaatcgagctggcaaggttccagcgccacttagcctatgaggactaaatcttaaatgtgtcagactgatggaagacacatagcatgtaacacatcagactaacacctgatgctatttgacaataccaatgtcccaaaatgagcatgatcgtccgcacaaaggcatactaaatacaatctacacgttatattgctcactgcacattacaacttatgctcggctagaatactgatgatatacaactaccgctctattagtgcccgattgctctcgctaactcacttcactaacctttcatagagcataggagcattacccatgatctgatggacttagaattacggctcaaaaaccgctgttactcaaacgagggtcattgataactctatcagaaacgtttaggaaagtgtaatagtacttcctaaataggagcataatccacttaagcactctcatcggaatggtacctactcgtctggacccttatgcacgatgtacatgaatttccctcacgacgattccataacaactaatgattaatgaacgttcagtgcaagtagggcaaactcataccatcgcacggtccgtgatgcacgtccca

SEQ ID NO: 674965 - DNA, 1384 bp, Homo sapiens
agcggggtccttgaggagacatcccgtccctggcccggcggatggacgatagtcgtgtgcgcaccgtgttggtctgtcgcatgctgcagtctcccgtaggcaccggatcagctctttgcctgcactgtccgtatgccgagtccgggttcgcctcttctcgccgagttgacgtgctggctcgccgcctttctcggtgtgtcttcgccgtatcgtcttcgcgacgtgtggcgctcgtgatcttgttcggcgtacgtaggtcttggtaccttgccaacggggctgcgcacgagtatgcgaacgtatccaggattgtatgctagttacctctacgcggcgagtgcacactacgcgatcgcgagggaatcgcactgtgctccaacggctgcgagcctcccagcagcatccctgctgtctcgttgccttcttcggtgagtcacacgctcgcctgagaagccgctatgtctgggcggaagtcaacgcagactcatcttactcgagtgggtccctttcgagtagagtacggtagcacgaacacagaacaccgctgaccgacctcgctagaaaccgcgttgaggcaacacgtccacccacgcgcgcgggcagagcaccccctctcctggccctcgctccaactggtcccgcgctcctgtgtagtgagccccgccctcggcgcacacgggcgccgttctccctcacctgtgtccgccccgttttcgcccgtcactacctggcggcgacgatcggtccccacctcctgtcctccccgcgcttctttgacgtcgccgcctaccgttggcccttgtccttctggccttgtgcattcctgccgccgtcccccgtgggcctaccggcttggcccctcgcgttctttgccctctcttcgtccgcttggcgcctaggcccttggctgctggcgaacacaccccttggggcacgccgcccgggaggttgagtcccccttcgtggcgggtccctcgccactgagggctcctctttccactgccgaagctgggactcgcgccgctacccggcggtttagcttgatcgccgccttggggcccccggcgtagcgtccgtacctccgaatttaaagagccgtttgcacgagattcctcgggttcccacgtttggtgggagcccctctggtaattccctgggtgtggcacttcccccgcgcccccttcgcgggccctctcggaggccgcccacgtctagcaggcccctttggcgagaaactgctgtcgctctgtcgctttcacgctgtttgtgggggcccctcggcctgggagaggtgatcgtgtctcggtccgaccactgccgctccgtccgcgctcgaccatccccagcactcccgccatctgtccccgctccgtcgcccgtccct

SEQ ID NO: 674966 - DNA, 362 bp, Homo sapiens
ccccctccccggataattactgaaaagtttgactggctttgttttatttaaagggaattatggaggtttggtttggagacggagtctaactctgtcacccaggctgccgtgcagtgttgcgatcttggctcaccacaccgtccgcctcctgcattcaagccattctcgtgatctgcccgcctaagcctcccaaagtgctgggattacaggtgtgagccaccatgcccgaccgccttatttttatttttttgagacagtgtcttgttctgtcacccaggctggagtgcagtgttgtgatctcggttcactgcagcctctgccttctgggttcaagtgattcttgtgcctcagcctcccaagta

SEQ ID NO: 674967 - DNA, 296 bp, Homo sapiens
  misc_feature (51)..(51): n is a, c, g, or t
  misc_feature (63)..(63): n is a, c, g, or t
  misc_feature (95)..(95): n is a, c, g, or t
  misc_feature (132)..(132): n is a, c, g, or t
  misc_feature (246)..(246): n is a, c, g, or t
cacccaggctggggtgcaatggcacaatcttggctcaccgcaacctccgtntccattcaagtnattcccctgcctcagcctccaaagtagctgtnattacaggtatgcaccaccacgcctagctaatttttngtattttaagtagagatggggtttcaccatgttggccaggttggtctcaaactcctgacctcaggtgatctgcctgcctcggccttccaaagtcttggggattataggcgtaancacttgcacctgggcctctaatcctcaattttgtaggtgtcaatttcaat

SEQ ID NO: 674968 - DNA, 195 bp, Homo sapiens
accacgcttggtatgcagagtaacaaatttatttccagcactttgtcagtcgccttacaatgtatcctttttctccccctagaagtaagagagagtctaacttgtttcccgatgtaagaaggttatgtctgccctctgccactaacgtctctagatacattgtttctccagcgtgtgatccctgaccaaagtctt

SEQ ID NO: 674969 - DNA, 259 bp, Homo sapiens
aggagtcccgctacgattctccaggtgttttcattggtcgtgtagcgccgctcctgtttcctcatcttcagctgtccctcggtccctgtgtgagctttgttctcgacagagggggctcagatggtgcggcctgagtgtgcggccggcggcatttgggatacacccgtagggtgggcggggtgtgtcccaggcctaattccatctttccaccatgacagagatgcccttgtgaggctggcctccttggccccttatcgag

SEQ ID NO: 674970 - DNA, 1193 bp, Homo sapiens
cacaagaaaagaatcccgcgggagtctacaggaaacatgtgctcagcagtgacagactgtctgtaaaaataaacccaagtatgtcggatcctgacggaatccagggcgaaactgatgaactagtgaacgcagcgagattgctggttacagatactctgcagggactgcctacagcgttctcccggtaacgacttacagcagtgccattggcaactcatacagcaagatgatgtagtgagaaacacatactacacgtggctgcacggagtgtgcattgaactttcctttgatgataggtacttccatactcttggcggctacgcccatggtccgctgtttcggctgctgcgcgcgtactgcttgcgctctcactctgcgtctacaggcagccgtggcatgtcgcgcggacagtccgctgccttacactgtccatacacagaccgatagcttctaaccttcatagctcgcaaaagagaggaacttctgacgcagatgtcccaaggcgccaagtgacttatgactttccagatatcatcgtcgtcgtgcgtgcctacgtggattgccctcggatctggagaccaatatcaagatgatctttgcagcgaacatttctcatgatgaagctattgatgcaagacacggactgaccttgagaaccgagcaagttgacccacgcgtgcatgctgcggagctggggcctaccgcagaaagggtcagggctgcctgttccttctaggacgcgctagtatcctgctgctcagtggctttccttgggcatttgatcggcaccgacaggaaacagtcgagacaacattgatgaggaacgcacaatcttaggacacacaacatgagttgaagaccatttagcggcttggacttgaagcaacgatttagccactagggacttacacgggcttggacccaacacagggtggtctccaatgaccccaatatgtcccaaacgagatatacgagacacgaggagcaaaaaggccgttttctcctagggggcaatacggttcaaccacgacagctaagagagacgtgactctaagaggaccaccagggattagttctaagaacgaaatcggacgcagacaagactgcaaaacaaaggcgtattgagctgcgcgcaaaaacacatcgttgtaagccgtatcacaacatgattgtcaatgactccatcgatctac

SEQ ID NO: 674971 - DNA, 1158 bp, Homo sapiens
aaaaagactatgttagcaagtgtcacgccatgcatagggcgaacatattccaattaaaggttgacatatcctgcataagcatttctctgtgaaaatgtccttgcctcattcacagaggcagcagcaggcaacacaagcattgcaagcagcaatcgacaacaaggctctgggccgcagcagctgagcaagttattggccagccaacgagcatctagcaggactagctcgggcacctccatatgctggcaacccattccaggaccaagcaaggcccatcccaaaatttcccaagggagatcttgtacagccagtgcagccatggtgatcatatttcaagcaaacagaatctcagtagctccatctacatgctgcaccacaagacctacatgcattccccaaagctttcacaaggccacaagggcacatatggccaacaagccagcaagacaatgcccaacagccatgcccaggccaacagtcccacgatacgtcacaatgagcatcatcaactggcacatctacatcctacacctagggccaacaaaaggtcctaccagaaggctccactaaaacaacaaccatcattgaacttatgcagttcacagtccacaggttccatgccatcaggctatcaacctgacgaatacacggtacacaccccctcttgctaacaccacaacctccatacaggccttcatggcccacacacaacgaagttcccaagcagaacaacagctcattccctccagaggacaaggactcccccaaggaaatacgaacagtgcagcaaggcccacgaaccaaccaacagacctgcaccgtctggcggcaagaacactgactataacttccattactacacatcaaaaaaaaggtaaaagcaccaaaaaacaccggaaaatatccaaaccgaaaagaccaacggaccccacacacaccacaacacggcaaagcactcaacaaacagcagccacggaagccagcgaaaagggagaaacccaaacccagaacacgcaaacgacacaaaaaacgcaaaacccacgaccaagagaaacacaagtaagcaccaacaaactaacccccagaccacacaagcaccccacccacacaaatacacaacaaaaaacccaaaccacaaaaacacacacacaaacaaca

SEQ ID NO: 674972 - DNA, 460 bp, Homo sapiens
tgcaatattgaggtctatactcacgtggtcgcttgccaacatactttattgccagctgttcaggtgtcatcttatcttctatcttctacagaccttatagtaattcttggctaatccaacatctctttaccactgatacatatgtgttacaatgttcactgtagtcctgaagttgtcaaaccttccatccaactcttcttatgcaaatttagcaacatctatctgttccagtacatttgtccgatagttaatagtaatggagtcataatgtctgtttagtccatgaattacatgcctggatagatggcttgtctcagtgacccagattcgaagtagtacgtcttggttcatgtcctaagaacatcatatgagcattgatcaatctgaaggcctcaataacaacctaacctttaacacactgaatgggatccacaaacactgccacagatctctccgaaaa

SEQ ID NO: 674973 - DNA, 193 bp, Homo sapiens
tccggggggcccccccccccccgggccccccccccccccctttttttaagggggggcccccccccgggggtccggggggggttgcccccccttttttttccccccggcccgggggggggggggggtttttggaagtttaggcccccccccccttccggccccccccccattaaaccctttttttgggggggga

SEQ ID NO: 674974 - DNA, 920 bp, Homo sapiens
agcgtggtgctgagtcagttcctgggtggggccaacaagatcaaatgaggcagtttattgatctgggtggtaccagctgatccgtcaagtacagggtctgcaaagatatctcaagcactggatcttaggagcagatttcgggggagggtcacgaatcttgataggtctaccagtatgcagtgactcgatctcctaacaccgtaacttgtcgtaactcattgtggcatacaatgtgtatagatccaagcaacacggtagatctagacaccccagtgcaacgaacggtggctctagttatatggagaacaggacgtgtatagtcgatacttggatctattaacactcagtaagcgtagagttccgtcgccagaaggttgagttcacgccgtagtgccgcaacgacatggacgacagaagcagactatgagaggcttcagaagccaacgaatgcgacgtatggtatacggatcacgaatcatcttgtcagctgagtcttcagattagtaagtgtttgacaacatggtggaatattcagacataacttgaggacggactgaagcgcagtgcagaactcagctagggaccacagagcaggtcgcgcaggtagccagagcaaccgaaagatacacgaccaatagcactgacacgattggcgtgacgcagagtcgagcactctggtctacaaaaacaggacaaaaaaacagcatctacgacaacaaacctcgtggctaggcctacactggggcacaaacctcagcactgcgtatccccaacgtacagaaaccaggggaatcaaaggaagcagcagcacagaatccccatgcaccacgacttgcacaagacactactgaggtacccgtccgtagagaagatacaccagacgacacagcggaatctaaagccaataacaccagcgataa

SEQ ID NO: 674975 - DNA, 1166 bp, Homo sapiens
  misc_feature (691)..(691): n is a, c, g, or t
taactctcagatatttaatttttcttagtctgacattaggttatgagaagtacaaaagatccacaagtacaaaaaaatctgtatagcttggcggtagttgaaaaaaatgcaagagaacaaaaaaatttttaggagtaatattcatctctgcagatctgagtgacagtccgcttgaaacaccgctgtacaaagtgggtaaaaaagtgatttcatgtggtgattatgtttaaaattttggagtgtctctttaactgtggtttaggaaatcgtgtcttcgtgacatttatacgtggatagtctcttttccgtggtatttggctgaagctcaattcccgtgcctcttcaggggcttcaagtgagtgacactttgggtttttatagtcaggctaggtgagtgtttggtccaaaggaagattctgacaacaggcttcagcagaaagaaaatcgtggatatagggtttatagtatatgggtcctttccaaagtaaaaaaaaaaaaaaaaaaggttggaaaaatttggggtgacttttctagaggggtaaatttctcttctccggcagggatttaacattggagggaataaatttcccttggatgcagttttttccccaagagttttttcaaaacactttcttgaacagatgaattcttttacatatccctaggattcggggtaacagatgacatacgnggacatagggaaaaagcccaggataacacaggcacctatctaaccaaagatcccgggtggcacacacaccacggagaaccacaggggaacatacgaacctctggaaggggggacaataagaaacaaaccaaaaaaaccacgctgataataaaaccaagagaatgatacaccacggggccgcagagggtataaaacacacaggggccaaatgaacaaagaaaaagcacaatacagcgggtcgcacagggaacaaaacactattacccggaagagaaaaaaaaaagaagtaaaggggacaacaaactaccgcacaacaaccacaaataactaagagacccaccactcactagaagaagcaactacgtcgaggagcgaatgacgaacgccagaaagagaaaagcacgaatgtgaaacacgagacaaaagaaggcggcagaacaaccaaagaaaggagagcacacaaagaaaaatgatg

SEQ ID NO: 674976 - DNA, 265 bp, Homo sapiens
cccgcagtgggccacatccaaggaatttttgatccaaagccatcccagcccttcccgggccccttttcctggcaaatgactttccccggttttgggtcctgcctgcccattcataccagtttgaactgcaacagcctagctcctcccctgtgcccccccttccccaggggggcacgtttccagccccgagggggggttttcctgctcatttgggtttcctgggcaaaaaggggcccccaataaatgtttgttgagtgagaacata

SEQ ID NO: 674977 - DNA, 160 bp, Homo sapiens
cgggctggatgggttatgtggcccaaacaggaatgagtgtagccggcccaatctttcctctcaattggttttcctggttgccaagacttattaacggagaaaaggagagagaattcaattagagggattaaaaatggttaaggggaatatccccacgggg

SEQ ID NO: 674978 - DNA, 518 bp, Homo sapiens
  misc_feature (1)..(1): n is a, c, g, or t
ngggcggtaactccaaagtctcctttttttctcaaccctttggtgaccacgccaccttacttttcagtgggcatgttaatgacccttacgttcccaagattttaatctgagacattcccctccaggcagacataggccccctttttaaaaaggagggtcaatcacagaaccaatctgcacttgttgagctcgtaaatcacaagcgcaaggcatcaaaagagcaccttaaagctgttatgaatgatttcccagcttttgtagagaagtgctccaaggctacaattaaggagtcttgctttgccgaggagggtaaaaaccttgttcctgcaagtcgagctgccttaggctcataacatcacatgtaaaagcatctcagcctaccatgagaataagagaaagaaaatgaagatccaaagcttattcagcggtttttctttttcggtggtgtaaagccaacaccctgtctaagaaacataaacttctttaatcattttgcctcttttctctgaaattcaatt

SEQ ID NO: 674979 - DNA, 221 bp, Homo sapiens
tgcggtccgtcgataaactgctatctggtgactcttctaagagaacgaagagttgtcagcagtttttacaagaatcgggacctccgctgcttcttttttccaagattggacacttagagtggtatcggttttttcttggcagatgttagtgtgaacgtccttgtgaggggatttagaggtctcggtgtatcggtgtccgtgaataggcagttacatcgagt

SEQ ID NO: 674980 - DNA, 224 bp, Homo sapiens
tcaaaaatcccaggtaccacatccttgcagcctttccctcatataccccccctaatatctggagccctgtccttccctccagcccccctttggccctgggggtggggaagtgtttgtgtccaactgtttcccctgacctcagggttccttggggggtgggcttaggcctcagtacaaagggggctttggaagtgtttgttggctgaataaaggaattcagtgga

SEQ ID NO: 674981 - DNA, 107 bp, Homo sapiens
tcagtcggtacccctagcattgtcatttatatacattaatgaaatcctgatgaggacctgctttttgtttgttttcctttgaaacccagctgccaatggttccattg

SEQ ID NO: 674982 - DNA, 705 bp, Homo sapiens
  misc_feature (301)..(301): n is a, c, g, or t
  misc_feature (395)..(395): n is a, c, g, or t
  misc_feature (402)..(402): n is a, c, g, or t
  misc_feature (404)..(404): n is a, c, g, or t
  misc_feature (410)..(410): n is a, c, g, or t
  misc_feature (455)..(455): n is a, c, g, or t
  misc_feature (457)..(457): n is a, c, g, or t
  misc_feature (511)..(512): n is a, c, g, or t
  misc_feature (517)..(517): n is a, c, g, or t
  misc_feature (532)..(532): n is a, c, g, or t
atgatcatcctacccgagatggtgggcagcatggtgggcgtctacaatcccagctacttgggaggctgaggcaggagaatcacttgaacccgggaggcggaggttgcagtgagccgagatcgcaccattgcactccagtctgggcaacagagtgagattccgtctcaaaaaaaaaaaaagaaagggaaaaaaaaatagctttatacctctttcctggtctcaaccgccatgaaaatttctgaacactccaaatttcagtggaattaatccaaaacaaaatttataagtataaaataatttnacttcttatagtaatagtatactttaaaaagcctcagggtatattatcttctaaacagctacaattcagtgcagctactttaaccaactatgtnctctagntngagaancaattaggcctatttcactgctgtgtagcctcagtgcctaacatngngtgccaaataaatattccgtagaattaccctgatttggtaaaaaccattcgttnnggttnacaattggccaaaantctcaaagggcccggttattttagtgtaactcctttggaacatcattatttaacattaattcctcagtatatggactggctgggtgtgacttagttccataagtacctcaatatttttaaaacctcaaataatttgaccttgattttacacaaaaatccttccctttttctac

SEQ ID NO: 674983 - DNA, 705 bp, Homo sapiens
tcctcggcggagctgggcagtggggagcctggggagtgcgaaggccttgtgtgccctgagtgcctgagcccgctcttgtgtgcgcgcagaaatgaagaagatgagccccccctgcatctcggtgtgaaccccctcgtgaggacgagggctcttgctgctggccctcctgctggcatgatgtggctgtgcatgcaccaacactagatgtgctgcatgtgaccccggtcctgtgatggccactgcctcacatgtgactcccttgtgagcccacatgatgtggctcatgtgctgcctggggtgtgtgacccttgcatgccaatggtgtggagcggcttggggccagtgcctcctgcctgggcttgagcacctgaccgtccccagctttgcctttgagccgctggacctcgtgggtccccagtggagaccctttcttggactggtagccacagtgtgaccccagaatccagagctttcctcttcagggtgccatagtgcccctggaacccccagaatcagagcctcccatgcccgtcggtgaccccccagagaagaggcggaggctgtacctcagtcccccagtgtcctctggagaaaccatggttccccctcagcacccctgccccagggtggtggtgcagattgaccccgtgtagctcggggcttggtgcgccacggtttggcctgggtctggggcccgctgggtga

SEQ ID NO: 674984 - DNA, 356 bp, Homo sapiens
  misc_feature (302)..(302): n is a, c, g, or t
ccggtcgactctaagtccccatttttctgaggctgcgtcgtctgggcaaggtcccgggcggccgtctggatcagcagctccaggtcgcgggcctcgaatgtatctggttctgagggtccaggtgttcaaactgtttcaggagattcagatgatccacctcgtacattggggatcctcgctcggcgtccatctatgcgccttgagcagcatccggcagccgtgacaccgtcctgtcgctatgagctcatccatgcttggtgcggacgtcgtggctgacaatagtccagcatctcaggctcagncttcccggctcttgaatgtcctccggcattgggcagccttcagaattaaatggg

SEQ ID NO: 674985 - DNA, 605 bp, Homo sapiens
gccgaagggcagagcacgataccaaggcgccgcacgagaggccctctataacccgcgcagcgcgaaaggctgcaacaaagcgcgccttgtttgcgcccaaaccgcctgcggagagaggccaaacaaaatcgtcgcgcccccaccaggtccgcatcagtccaacaatttcgccaagatttttcaaaaaagtcctctcaaagagtgggcgaaacaccacatcttgctcaccatacgtaatggaagcacattactttgaaaacatctgacgacaaattcgggtcaaagcctcctggttggcataacagtgcggtatgctaccctctatgaccccgcccccaacgggggactccataatgaatgtcttcatgggtcctcctcctgtcttccctacgaaggctccccttcggcactcttttatcttatttttccttcaagatgtgttcccccgcctctcccaggggagccacccgctgccccgccccctgcgggagctgtctcacaaggacgcgtggagaagaacttgcgaagaactctcgagtgccgggagccaccccgccccttctttcaatatatgccgctgctattctcaaaccacaatgtaccaa

SEQ ID NO: 674986 - DNA, 185 bp, Homo sapiens
ttagaatttgggggggaattttaaaaaaaatattgcccgggtttttgggaatttgttttaaagaaaggaaccttttgttaaataagatttatattttcttttttaaccttttataaaggaaggggggggggggggttatttgggttttttttgttcccccaggttaataaattttaaaacttgga

SEQ ID NO: 674987 - DNA, 289 bp, Homo sapiens
cagtacaacttctgcaacaattgcacccccacctccatattaaaagttttctgcatcttgtcagtggtattaccccgttctgttgtaaccaggtaggccgctttggtaattatttccttaagattctctgcacagtcggctacagtagagaagtgtgggacttggtctctgttcccaggctgtgtcgctacaattccagttctgctgtgagctggtcacacagttttgggataacttcctcctctgtctcagtcctggcttcctaagaggagagcaagacacacctggc

SEQ ID NO: 674988 - DNA, 402 bp, Homo sapiens
ggctcgggggaagattttctattaatgctgcccaggctatgactccagccagggcagcactaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctcta

SEQ ID NO: 674989 - DNA, 226 bp, Homo sapiens
  misc_feature (8)..(8): n is a, c, g, or t
actgcttnggatgtaaagcgaaatattatttgtcggatgaatcacatagtgaggaaagtggagccatttttgacctgaaaaccttggaaccctgtggcttcaaaaaatgttgagccgtaaatgccgcctcaaatggggaatgggagactccaaatactctgcggcttgtaggagggtaaaatagagacccagcaaaatggcaataaccggtgcttgaattattagg

SEQ ID NO: 674990 - DNA, 654 bp, Homo sapiens
tgatgtagtatactagctacgtacgcactagaatggccaagaatccagatcactgacagcaccaaagtcaggtgaagatgttagaacaacaggagttattgtccattggtgatggtaatacagaatggcacagccactttgaaagacagtttgacagtttcttataaaattaaacatactcttaccatatgattcagccatccagttccttggtataaacaaaatgagttcaaaacatatatctgttcaaaaacctgcacactgatatttatagcagctttattcatactttcccaaacttggaagcaaccaacatatccttcagtaggtgaaagagtaaattatggcgcacctagacaatggaatattatccagcactgtaaaggaatgagctatcaatacatgaaaggacatggaggaaactgaaatgcatatttctaagtgaaagaagccaatcatatgattccaactatatgacattctggaaaaggcaaaactatggagacataaaaagatcagtggttgtcaggggttgagggtaaggagggataactaggcagagtgcagaggatttcaaagacagtgaaactattctgcaggagacagaaagttggatcattgtcctatttattatccaacccattaatgtcagta

SEQ ID NO: 674991 - DNA, 235 bp, Homo sapiens
ctgctttgcactgtgggcccaaggtgagaggaccacttgagctcaggagctccagaacaacctgggcaacacagcgaaaccctgtctctatcaaagtgggaggctgaggtctcaaaaaaaaaaaaaaactaaaattataacctattgtattttaagattttcccattaggcttttaaagtaaaacgaaatcagttgaaattaattataccttcatttacctcagtatttccaaaa

SEQ ID NO: 674992 - DNA, 187 bp, Homo sapiens
atctggtcacctcctatgccctggcgacgacccacctgccgcgctggtggcgcgactggagcgcgggccagcagctcagctgcagcctgcagacgggcaacgtgcatgacacggtgtcggccttcacctcgggcgcggccgatctgctgatctgtttccaccaggtggcgcagccgctgccgctgga

SEQ ID NO: 674993 - DNA, 382 bp, Homo sapiens
cgtggccagtcggatgtggagtgtgtctagaagcatttgcggtgggcgatggaagggccggcctcgtcgtactccgtgcttggtgactccacatctgctggaacggtggacagcgaggtcacggatggatgccgccgagtccatagccgaagtattttgcgctccggacggtggcgagtgactcttgatctatcatggatgcatggagttgccagcgctggtgatctcgttatctgcatgtcggtcagcgtatcccaggggtacattgtggtgtgacgccgtctcccggagtccagcacgtatgccgtgctggtcctcgccggaggcgtaaagggacagcacggactggatggccacgttctgtcccgaacatccgtactgg

SEQ ID NO: 674994 - DNA, 445 bp, Homo sapiens
  misc_feature (408)..(408): n is a, c, g, or t
ggcacgagcatcttacaccagtacagcttggccctcatattaaaaatccatgacctaagctgaattttaataacttggaagaggaacagagagatacacaggaggttatatctaatggttacataaaaggacctcaaaggatatactttaaattcttttttttttttttttttgggggcagagttccgctctggtctcccaggagggagtgcaggggcgcaatctcagctcagtgcaacctcggcctccggggttcaagcgattctccagcttggcctccggagtagcggggataacgggcttccgccaccatgcccagttaatttttatacttttaacagagagggggttcaccatgtgggccaggagggtctggatctctggacctggtgatcggtccacctgggnctcccaaggggcggggattacgggcgtgagccacacg

SEQ ID NO: 674995 - DNA, 328 bp, Homo sapiens
  misc_feature (312)..(312): n is a, c, g, or t
ttttactgaaacatcagttaagaataaccttgtaatcttttatttaaaataaggctctcggccggcacagtggctcacacctataatcccagcactttgggaggccaaggtgggcagagcgcttgaggtcaggagtttgagaccagcctggccaacatggtgaaacccctcctctactaaaaatagaaaaattagctggcgtagtggtgcgtgcctataatcccagctactcaggaggctgagtcaagagaatcgcttgaacccaagaggcagaggttgcagtgagctgagattgcgccactgcactccagncctgggtgacagagtg

SEQ ID NO: 674996 - DNA, 201 bp, Homo sapiens
aagaatacgaattaactaggagaagctaatagcatggccacgcgatatgaaggtggcctatggagccgcggtgaggcggcatactcatcggcgacaatcagagaatgtgcaggactgcggctactcgacgtgaccccgttgtcgctgggcatcgagacagctggcggtgtcatgaccccactcatctagagcagcaccacg

SEQ ID NO: 674997 - DNA, 166 bp, Homo sapiens
cactgcagacacctcatgtccacaaatattaactgaacactccagacataattcatacagttctacatacgcacatcatttagagcagcatgatgaactctgccattctgctccatcttgcccaggatgtgagtcctcccttcgtccggtaatatctatgctgctg

SEQ ID NO: 674998 - DNA, 660 bp, Homo sapiens
  misc_feature (15)..(15): n is a, c, g, or t
gtacatcagcaaganaccccaaggacaagaggcatgtctggttcggcgagagcatgaccgatggattccagttcgagtatgcggccgggctccgacctgccgatgtgccatccagctgaccttcctgcgcctgatgtccaccgaggcctctccagaacttcgaccttaccactgcaagaacagcggtggcctacatggaccagcatgactggcaatcctcaagtaaggtccctgctcctccagggctccaacgagatctgagatccgcgccgagggcaacagccgcttcacctacagcagtcactgtcgatggctgcacgagtcacatccggagcctggggctaagacagtgattgaatacaaaaccatccaagacctgcccgcctgcccatcatcgatgtggccctcattggacgttggtgccccagacctaggaattcggcttcgacgttggccctgtctgcttccatgtaaactccctccatcccaacctggctcctctcccacccaaccaactttccccaccaacccggatacagacaagcaacccaaatctgaacccctctcatatagccaaattatgagagacaattttactatggacatttgtataatactttttttcctttgcattcatcataatcaccggtagttattatc

SEQ ID NO: 674999 - DNA, 560 bp, Homo sapiens
aactagggcttggttcgacaagactatacattctaaagcagtatactgggtcttacaacccaaatcattgacactctctgtactatgcccctaccctatcacaaatgtgggaaatgtctctttgattcaatagcgaggctgtgctgacaaagtggggtccacgcctccccatcacagccgactcccagcctgatgagaggcgagacggagtgggcggtccctccccacactgggaatctcaatggcaggcctcctggagggccaccattgtccaggccccgactgaccttcagctcccctggtggccaccttgaagaccagctctaccacgcagcccaacgccaggcgggctgcccccgccgcagtgcacctcgtcccatatggtgtcctgtccaccccaaaaccaccgcaagggagccggacgaacacggaggcgagcgcgctgtccagtttctgccggttagagggggtacggtgccataccggagggtgtgggcttccgagtgcccgtctgtagctcccccagggtggccttgcagtacgagatgcactcgcctttg

SEQ ID NO: 675000 - DNA, 736 bp, Homo sapiens
gactaattctacatgcctgcatttgttacctaaagtctggagagggacatgtaatgtcagatgacgacatctctaccctccttgccacctaggtacaaaacctcagtcatccctatacattcttctctttcttacttttcaaccacttgacatctaagtatatatgtatggttgttatccctaaaataatagccaaagttgtcctgcattgaatttgtaaaccaatctgagaataactgaaatctttataaagtcttccaatccatgaagatgatttattcctccatatatttgagttcttttaaatatcattcataaagtttgttgttttacaggtttattccatggtacttggtattttattttgcacatttttgtgatgctgctatattttgcctgcaactaaccaatggaaattacttaaaatccttcaccaaacctttcacttaggcattgatagcacccatcagatggacaaattattatttgttggaccaggccttttcaaaactatcaagcagatagtcaggtcctgtgaagtgtgccaaagaaataatcccctgtatgcaggccatacatttcaatctctgtatctttaacctccttgttaagtttgtctcttccagaatcaaagctataaaactacaaatggttctccaaatggagccccagatgcagtccatgactagatctactgcggacctctggacggctgttaccagtccactttatgact

SEQ ID NO: 675001 - DNA, 312 bp, Homo sapiens
  misc_feature (25)..(25): n is a, c, g, or t
tcaattccccccctatggggtgagnacatggcgggtgtcaaacaagactttttaaaaaattgggggaaaatacacataacataaaatttactgtcttaaccattttttactgtacagttcagtagtgttaagtatattcacattattgtgtactatattttcagaacttttacatcttgcaaaactgaaactctgtacccattgaataattcctcactccctctccccaccagcccctggtaaccactattctacttcctgtttttgtgaggttgactacactgtatatctcatataagtaaagtcatatag

SEQ ID NO: 675002 - DNA, 196 bp, Homo sapiens
acaatactgcggttgttttgtatggggatcattatggtatctcaaacacggatgcgaaatatttagcgccaattttaggcaaagatgaaagccaatggagtgacttggacaacgcgaacttacagcgtgtgccatttatgatccatgtgccaggcatgacggatggttatattgatcatacctttggtggtaaacg

SEQ ID NO: 675003 - DNA, 276 bp, Homo sapiens
attgtttgcaaggcagtggctagaggaaagttcataccccgtaaacacctacatcaaaaagactgaaagagtacaaagtggcattctaaggtcacacctcaaggaactagagaaacaagaacaaaccaaacccaaacccagcagaagaaaggaaataaccaagatcagagcagaactaaatgaaacaaacaaacaaaaaaatatccagaatatgagaacacgccaggtgagtgatccagaattctgatccgggggatggggatgcctccccatctg

SEQ ID NO: 675004 - DNA, 108 bp, Homo sapiens
tggtcaatctccagcgctcccgaaaccatcgcacgggggaccaggaggagcggcaggactatatcaaccgggatgagagtgaggccgcagcgttggatgacgagtggc

SEQ ID NO: 675005 - DNA, 404 bp, Homo sapiens
tatttgaaagttatagggctccaggagccttgggcacaaaaccccagagaaactagccgggggacagctgatatcattccacgccctctccgggctttccaatagtccccaggagctactgcagcactaacagtgggctttggggcctgtatatgttaataactgccatagttgtttgagggtgaggagagtgccatggattcttcattactattggaagtacttctacatttagaaacatacagagggtagtcctatttttctactctccaacagctaaatagaggggaggccaagtatttcgagtgatctcagcttcagaggtctacacccgagtccaaccatagtcagagtggccaactacatcaccgtcactgggaaagtctcgccttggaaaaaagggg

SEQ ID NO: 675006 - DNA, 116 bp, Homo sapiens
cacgagggggaacgggtatggtattccccgaaactcaacatgtctgcgggtcacacctggtaacttgaacatcaatatgcaagcaaaatctccgcccccaatgaatttaggaatga

SEQ ID NO: 675007 - DNA, 708 bp, Homo sapiens
  misc_feature (359)..(359): n is a, c, g, or t
gggctggtctccagctcctaacaggcgagtgatccgccagcctcagcctcccgaggtgccgggattgcagacggagtctggttcactcagtgctcaatggtgcccaggctggagcgcagtggcgtgatctcggctggctacaacctccacctcccacccgcctgccttggcctcccaaagtgccgagattgcagcctctgcccggcgccaccccgtctgggaagtgaggagcgtctctgcccggcgcccatcgtctgggacgtgaggagcccctctgcctggctgcccagtctggaaagtgaggagcgtctctgccccgccgccatcccatctaggaagtgaggagcgtctctgcccgngcgccatcgtctgagatgtggggagcgcctttgccccgccgccccgtctgggatgtgaggagcgcctctacccgcgcgcgacctgtctgggaggtgaggagcgtctctgcccgcgcgcccatctgagaagcgaggagaccctccgcctggcaaccgcccgtctaagaagtgaggagcccctccgccggcagccgccggtctgagaaagtgaggagcctatccgccggaggcaccccgtctgggaggaatgcagtacatgtaaatcacggttgatgtgcacttcggtttggaggttaccaagaattgttcaccatttgggaaaacacgcgcttcatggcacgctgctctg

SEQ ID NO: 675008 - DNA, 151 bp, Homo sapiens
ccatggactaaggctgcccctgtgaaaaagaagggaattgacggactaagtggaagaacctaagtctagggtccttcagtaatctcagacttcatagatttctcacgctgcttctgggatagaaccgcagtctgcaagccaagcagggcag

SEQ ID NO: 675009 - DNA, 1507 bp, Homo sapiens
ttcgagcagctcgggagtgcctatgccctctgacgggggggggtttgatgtacgcccgcccctgttagtatatgaatccctccccggtgctgtgggggcaccaacccaagcaaagcgggcgcgggtgatattggatgtgagcgatgcatgtaatgtaggtttggtgtcccaatcgagccgtgctgtgtgtggttgttgctccgccccgtgtgttagatagaagagacgatattatgatgggaggggggggtagctgaacccgcgcgtccggtgattgaatgttgggtgtagaaattcatttgtgtgggcgcggtgtgtccacccaccctcccgacagggagcggccggtttgttagcacagcaagcaccctgacaggtttgttccttttcttcggttagtaaaacaagccgttctgttttgtttaggtagcaggcccccgacgcggcgtgtgtgaaggaaagaatatgttttgtgaagatacgtccctttgggtgtcccaccccccggctgtggggaggaaataggaagtaggggcaccggtcggtggcccaacatgtggaagcagctaccagcctcctggcggccacacacaggagttaccgttatgatgaacaatatggatgctgccccccccctctatcttagtagaagagggcctgctttgttagaagagtggtgtgttaagaatgttagaagtagtggcgctaccgacgagcgcccacacggggaagtacccccgttggaccgccacaacatgacgcccccacgaccacagcggggtgtcttcctgctgttagtattacgcttatgcccccgacaacgactaccccctgaggcgacgatgtttataagtatatttgttttccgcgctttttgtgtgggcgcgagagcttctctgcgcggagtgcacacagcagattacccgcacacgcgtcttctctcgcagagccacacgctgagacaactcgtgtctgatatagagactgtggtcaacacacacagctgtcacatataccgcagaactagtagcgatatatatacgctcacacgtgtgaatccacatctatacaccttgaggccacaccgcggacacacacggtttataccctcatgggagatatacaacacgcgcgccacattctctatatagttcttaggagtcccatatatccacaccaatattagggtgttttaccgcacccccgatatgtttggagtaccaaggacacattccccgatatggcgccacacccgcgttatattaaaagtgtcatgtgtttgttctcaccgattataaatctcttaacgtgaatcttgagagttctcagacccggaggtaaatcccaggtccggtttcttattttatcattccaaaattctctcccctgtatccgaaaaggacacaagaagaaaatataggcctacttccccaagcgcgccttcccccgtaaatgaaatcatctccacttagtgatcatacccccaccccccccaggacccgggttt

SEQ ID NO: 675010 - DNA, 168 bp, Homo sapiens
cgagcacagtgctccccaagacccgtactagattaagtatgcctcaaagtgctgctgtcagtaccaccccacccatatataccggtaggcaccgaggctgttactgtgacataaggccaacatagaagacaagcacagttagatactgctcatgcctactaaagtaca

SEQ ID NO: 675011 - DNA, 804 bp, Homo sapiens
  misc_feature (1)..(1): n is a, c, g, or t
  misc_feature (302)..(302): n is a, c, g, or t
ntatggtcggttggagtagtcccctattggtttttctaaagccggtgtctcgcaattctcaggtgggcgccaacagctgatcctccgccgtccgaatattaaactgggcgacaaaccggaaacaatttctcttgatagcgtttcctttaattgtgggggaccaccgctcagaataattattggagtactttcggaggtccgttgtggtcgaaacgacgaatgagcttgtctccccctggcatgagttcgccaagacgattttcattagcgagctgtcattgccaggagtcaccattatcacncgcatcactgacactcacgcgcttgttgcccacaacaaaacgcggccctctcttttatggccaaggagatatccttctcggtccccccccccgcgcgctttgtttaattgctgtgatgcccacggcatggctctcactcacgaaagtgtcatgtgtgttagagccccctcctccgcctatgccaggtagtggaacacttgaagggggtaacatagtggcctatccccattgcgccctccgagccgattattggtgctggtcactccaggctgttcttacaacagatgctcaccgggaggaacacagtttgtacccacgcattgattcgacaaaaaagggcttgatcgaacaccccagtgtccctccataactacctgctcttctttcgtgacacgcctatactccactcgccacttccatgatgaggacacatatggctgagacggacgaattagaaggggattttcccaaaaaaaacaaagcaaacacggacaaaaagtca

SEQ ID NO: 675012 - DNA, 196 bp, Homo sapiens
gacaacccagagctggcaatctgggctggtcggccgttcacttcctcttcggggttcttcttcatgcagagcaggccctccgtgagagcctctatctctgtcgtccagctgcggtcgtgtgatattggtgtcgtcaatgaccttgaggagcgcatggatgtggttctccacagagtgcagctgaggaccatcgtgg

SEQ ID NO: 675013 - DNA, 102 bp, Homo sapiens
aaaaagggtgattatactgaatgtaatatataaacttataattgtaaaaaagagataatgaaggccaggcatggtggctcacagcctgtaatctcggaggta

SEQ ID NO: 675014 - DNA, 818 bp, Homo sapiens
tgaataatagcagttctaccggtacagaccctaacataaccattcttaattttaactatttactattatcctaagcgtactaccgcattcctactacatcaacttaaactccagtcaccacaaccctagctactatctcgtcacctgaaaacaagctaagcatgactaacaccctttaagtaccatccacgcctcctctccctaggaggcctgcactcgcgctaaccgggttatatgccctaaatgggccattatcgaagaatttcacaaaataagaatagacctcatcatccccaaccatcatagccaccatcagcctccttaacctctacttctacctacgacctacatctattccacctcaatcatcactaatccccatatctaatcaacgtcatagacactctaaagtgacagttctgaaacattacaaaaagcacagccacagttacctctgccaagcaattcgaattcgcccatttaacctagagcttcactgctcattgccgtattcttcccgcctgtgtaaattacttatataaagcctttatacactccaaaacacgaatcagctcaacacacatgacaacaacacaacagagagtaacgggccacaacgcacttacggaacaacacacacaaagaatagcaccactggcaaacaccaatactaccagcagggaactacacgggcggccacacaactcccccatgcaaaacttccaaccctgagcgaaaaggcacttcgaacaaacagaagcattggacacacctacagatagtagacgcgccgcaatcacaggagaccatagtactaa

SEQ ID NO: 675015 - DNA, 237 bp, Homo sapiens
acggctccacctcggccaattccagacgggtctacaaatccgcagagacatgggagtgtgagctgtctgggaataagcagcaagtagtctgggagagcttccagaagagtcatgtgggatatgcaggtatgggccctggatgtgcataggctagaggtatcaacatgtcttggtcggtctctgtagccagtcagagcagatgtgcagtgagtaggacagttcgcgcaaggctcaatg

SEQ ID NO: 675016 - DNA, 657 bp, Homo sapiens
gatcccggcacatctgacccagaccaactcagaggcctggctgggaggggctatgaagggaggagcatcagtgaggcttcaggagctgagctttaaggccagtaggatggggagaggccaggtgacaggaggaggatgggagagaagtcagggaatggaggcaaagcacagagatgagggaagacctgccatacttctgcagtgttgcccaggtcctaatgactgagacgatgcagctgtcaaggacaggtgggaagcttacgcagggccagtatcttgctaacgggactagagggtggggaccttctggggggtgctggacaaactcaaaacggtttacgcaggtgaacaacaatttcagataaactcccaggtgagtgtgtagacattggaacgggaagccctgaaaggtgggggcagggagatacttttattgttccctgtttgcagaagtagaagttgaggcttgagaggtgaagaagcttgtgggaggtgtcacaggcctaggtgtggagtgcggctttacgccttggctgttgggcccctagcacaggcccgcacccaactgccctgagccctgctgtaggttcaatcgtgtcttcacaagatatgtcatatctaaccctggtcctttgactgtgactatctggaatagcg

SEQ ID NO: 675017 - DNA, 503 bp, Homo sapiens
tgaggtacttaaggatccgtgtcatccccttcgtcatgatacctaagctcagctgtctcgccgcctgcccgggacgtggccgcacccttgctgtggctgtgtttttgaggctgctgtcccagcacccagcacctctggaagaacaaggtctctgggtccccgagggccagcgcgccaggatcaccgtggctgctctggatgcctccaatctcttgggcagcgttccatcacccccagcgctcagagcatgatgtgctcttccaggtcacacagttccccagccggggccagctgttggtgtccgaggagcccctcccatgctgggcagccccacttactgcagtcccagctggctgcagggcagctagtgtattcccacggcggtgggggcacccagcaggatggcttccactttcgtgcccacctccaggcgccagcaggggctccgtggcttggaccccaaacctcagaggcctttgccatcacgaagggggatcggacac

SEQ ID NO: 675018 - DNA, 224 bp, Homo sapiens
ctctagaggatcactcttcgacggtgtctgctcttgtggcctaagctagagtgcaatggcacgatctcagctacactgcaattctcctgtgtcagcctcctgagttgctgggactacaggcatgtgccaccacgccacggctaattttttgtatttttagcagagatggagtttcaccgtgttggtcagggtgatcttgaactcctgactttgtggtccacccg

SEQ ID NO: 675019 - DNA, 378 bp, Homo sapiens
  misc_feature (12)..(12): n is a, c, g, or t
gtcggcccgcgntagcgctcgacgaccgccgacgtgcatttccgatcttttggttccgagtccaatatagcaactctaatggatcagctgatttataatcttctactggaagaacagacccccccgaataagattacagttgttggggttagtgccggttgcctagcctgtgccatcagtatcttaatgaaggacttggcagatgaacttgctcttgttgatgtcatctaagacacattgaagggagagattatagatctccaacattgcagccttttccttagaaaaccaaagattgtctcttggcaagactattattgtaactgcaaactccaagctggtcattatcacggctgaggcacgtcgagcgcgccgaca

SEQ ID NO: 675020 - DNA, 128 bp, Homo sapiens
ggagagcctgacctgtttccccaatatgcctgtgaggagacattgggtggggatagacaggaggttctgggtctccagttgggccctcaatgttgctcctatcctagagtctgacaagtgtaagcctc

SEQ ID NO: 675021 - DNA, 178 bp, Homo sapiens
ggcaccgctctcgtgaactgtcagtcatcaagagcttgggatgaaacatctgtcccgtcaggtgttcaaagtcctctccttctggggttcccgctggggtgcagtgggttaggaatccaacggcagaggctccggtggctgcagaggggtgggttcgactccgggccccgtgctgtgg

SEQ ID NO: 675022 - DNA, 870 bp, Homo sapiens
acttccggttctctgtcagctcgcgagcgaacgaccaagagggtgttcgactgctagagccgaggcgaagcgatgcctaagtcaataggaacttgtcatcttcccatgctcttctgggcatctgattcgtgacaaggtgatggcttgatcgacatataatgttacagaagaccgaaagaaagcacaggttgcttccggaacaaaccgtgtaaacgagaactaagatagacaggtgagactgtcgagagccctgtcattcttcgtaagcgagagacgatgcatgccatgctaggagatgatgaacgtgtttcagatggggacagatgaggtacgttagatgttcgcgtattttaaaggcacaagatgcgtaattgatattagagaactattggatggatccgtgaaggtggaaatgaaaccaggaagaggaggtatttctttaaatcctgaacaatgtgagcctgctgtaaggaacagattgctgacaatcgatgatgcatgtaagaatgaactgtaagattcgagccatataaataaaagctgtactgttctagttgggtttaatctgtcttctgacacttggcttagttttctaaattgttctccatgtctattcgtgatgtttggatttgcaggaagactcgttaagatgaataccttgccttagtgtgcattcttaaacagttttgagtgacacgttacttgtcacccgttattaggaattactttgtctgccaacaacctgaggtcaaataacgccacgtatcaactaacggtgggggcctttgatcataacgcggactggctaaggggcaaagtacgttttaaacctaggtccccccgttaccaaagagtgccggtgaggaaact

SEQ ID NO: 675023 - DNA, 567 bp, Homo sapiens
cctcagtttatgtatgttcaatagcacgtggaatggaatattagacacattcgctacggctcctagagccaggacactaaggcttcggtgagacaccctgggacacctgctcgtgcaattggcactcgctctccagtcctgggctgctattgaaacttctaaaagtaggaatttgcagggcctcgtgcaagaaactgcagaggttcttgtaaagaggtgattcatgatgactgcagagcagagaacaactgagagcaactttttgaagggcggtggaatgtcatcaggatagatcactctctcctcgaccttccctctggctggattcagacttggcatgtaccctgctcctttgacactgagcgggatgcagatcttgactgggcgcggtcatggagacctgtccgtaggcaggagggcattagtgtagtgtttaaaatgctgccctttggagggcaaggtcggggggacaaaccggagatactgcatccgccttcagattttctacgtgcgctctgccattcaagtcggaagaaagcctacttctgatgaccattcggtgtaatc

SEQ ID NO: 675024 - DNA, 105 bp, Homo sapiens
aatgcgttagtattttacttctgtaagctgtttaactttgtaagatgcacagaggtaggatcaagttcaactgacagtgctgccacttcacatcacagaactact

SEQ ID NO: 675025 - DNA, 188 bp, Homo sapiens
  misc_feature (13)..(13): n is a, c, g, or t
  misc_feature (37)..(37): n is a, c, g, or t
  misc_feature (87)..(87): n is a, c, g, or t
gacaatggaatgnttaattgggagtggtaggatggancaatttggagaagatagaagtttgaagtggatatctgcaaaacaaaagtncgggaaggcgaaggaaagaatagagaagatagggagcttaggagatagagacagacttttagaagaagaaagataaatttaaacctgaaaagtaggaagca

SEQ ID NO: 675026 - DNA, 112 bp, Homo sapiens
acctttaacagtgagatgtctgagatgtcaggattttgtagcattcttagaaaacaacatccactgtgtgggcatacttttttcccttctggaagttttaaacccacgtctg

SEQ ID NO: 675027 - DNA, 370 bp, Homo sapiens
cgctcagttcctataggcggctgaggactattgggtcatcaagactgacctgttccagactgttgacctctttgaagggcaagacatggcagcagttgcagacgaccctgatggctttgggcagcttggcagtgaccaagaatgatgggcactaccgtggagatcccaactggtttatgaagaaagcgcaggagcataagaggctattcacagagagccagctgcaggaaggaacgcatttcattggccttcagatgggcagcaacagatgggcctcccaggccggcatgacaggctacggacgaactcggcagatcatcagttacaccggagagggctagccctgagcccggccctcccccagctcctt

SEQ ID NO: 675028 - DNA, 921 bp, Homo sapiens
aatcaggggtatcgacgcaaagtggccattacggacgggggcgctataggagtcaagcatggggagagtacgcgcgagtatccttgcccatgatcgaatagtggatgagtgtggctgcggtgcctctatacgaatggggtgaccatttggtggtggatactcttgccaaggcatgtcacagaagcgtctgcgcttggtctcagccagatggggagataagaacccacagacatgcgacgggagttttgagagcgtatgaagaaaccagggtctcctactatgcttaagagagagtacgtgttttgccaggttcaggggacgggctgtatgccagtgattgattggtagtatggttcaagtcagtaggaaaaggtcagatcccgtgggaaactccatcagcacagtgagtgaccgtataaggggagcctatagctgggcagccgcatgacgtagtggccccagcgcgccatcgcgtgtggtgtcaggccgcagttgggtaggcattctcctatgtttaattgaaggaggctggtatcttgttgacaagatttgctctctggcacagtttccgcaaatggtcctcagtttctgcggaagaacgcctcccagtgtggccctttcgacatcagtataagctttccctcatccttgttaggaggactagtcgggagcacctacttaggtcgcgacttacgtttggcctattgactttccctttaacaggacacgagttgtgggtccgaccaaggctttccagaaagaatccacggtaacagtcctgtctttaacacccatatgggggacaggcgtagggcaatggctctcaagagaacgtttggacgttttgccattgcaacgggacagcggcgaggggcaccgcaaaacgtcttttcccctggcgcttgtcccccacaggtctcc

SEQ ID NO: 675029 - DNA, 540 bp, Homo sapiens
ctgatacttaaagggggtggggaggtttctgtgaaggaatgtatttgaagcccatcaatgatagacatttgggttggttccaagtctttgctattgtgaataatgccgcaataaacatacgtgtgtatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgtccctatttctccacatcctctccagcacctgtggtttcctgactttttaatgattgccattctaactggtgtgagatgatatctcatagtggtttggattggcgtttctctgatggccagtgatgatgagcattttttcatgtgttttgtggctgcataaatgtcttcttttcagaagtgtctgttcatgtccttcacccactttttgatggggttgtttgtttttctcttgtaaatttgttcgagtcatt

SEQ ID NO: 675030 - DNA, 345 bp, Homo sapiens
tatagagggttggcccggtgcagtggctcacgcctgtaatcccagcactttgggaggccaaggcgggtggatcacctgaggtcggaagcttgagaccagcctggccaacatggtgaaaccccgtctctactaataatacaaaacaatttgctgggcatggtggtgcacgcttgtaatccaagctactccagaggctgaggcaggagaatcgcttgaatccgggaggcaaaggttgcagtgagcccagatcacaccactgctctccaacctgggcaacaagagcaaaactccgtcaaaaaaaaaagatacagggtcaactgtacacattaaacacttctatcaact

SEQ ID NO: 675031 - DNA, 106 bp, Homo sapiens
cgcaaatactcagtggacatgacctacccaggtagggactctgacacactcatcttcatggctgcctggggtattgtataatgctactgaaacttctaaaactagg

SEQ ID NO: 675032 - DNA, 416 bp, Homo sapiens
agagaatgccagacactgtgtaactgattaaggcttacatggtacttgactaccttgatgacggcgataggcgatccatacgcaggtgcgtgctagctatattctagctggactagatccactgcgcagtgtaacacgggtactgacgtcacagtgtattatatacatacgttactcactagctgcgtactagcgagtgcatgatcactgcattagagatgccaatgtgatacacattgattctccgctttataatatctgacctgtaagttgtgatcactgctccatggccgatcatgttcgagtgattgaactacttcctatggcagtgttaactagtgttactcttccaacactaagcattcctgacgatcgtcacgtgctcaagcactgacatagcttttctcatgtgctct

SEQ ID NO: 675033 - DNA, 202 bp, Homo sapiens
gccacatctgccagagcctggagtctgcgaggccgggacccggttccccggcccacagtgggggtgtgcaacccgagagaactgggttgcaattcgtgaagatcagcatcatgtttggcagctgagtattggagccaggagcctccatgaggttttgagacagagtctgttttagagctgcagcagatctagccaaggaagg

SEQ ID NO: 675034 - DNA, 251 bp, Homo sapiens
gatagatgctggaggatcaagatgcttgcactgtgagtgatagaagacgacatgtcagtggatatgttaaggcagactggctacatgctcgagatacgttctgtgtaactccatcactctggaacagcataatgatggctgtgaccttaagacagtcaggatatataccctctgcaagggattcaatatacattgagctgtgcaactgttaccggcatagcgaccccacgattgtaccatctgccatggcc

SEQ ID NO: 675035 - DNA, 304 bp, Homo sapiens
ttacgcagggctggatgaaaactgaaaatacaacatatcagctgggcgtgatggcttgtgcctataattccagcactttgggaggcccaggcgggtggatcacttgcgatcaggaattcgagaccagcctggccaacatggcgaaaacccatctctaccaaaaatgcaaaaactagctgagtgtggtggtgcacgcctgtaatcccagctaatcgggaggctgaggcaggagaatcacttgaacccgggaggcagaggtagcagtgtggctatcatgccactgcaactccaggctcactatcgc

SEQ ID NO: 675036 - DNA, 244 bp, Homo sapiens
tgagtgtctgaagtcaggtctggcaagtgtgttggtgtggccacattggaaagatcaccacagtgcaggtgcttcagaaagtggtggctggtgtggctaatgcctggccacaagtatcactaagctcgcttcttgctgccattctattaaaggtcctttgtcctaagtccactactaaactgggggatattatgaagggcttgagcatctggatctgctaataaaaaacatttatttcattgca

SEQ ID NO: 675037 - DNA, 183 bp, Homo sapiens
  misc_feature (38)..(38): n is a, c, g, or t
  misc_feature (60)..(60): n is a, c, g, or t
  misc_feature (163)..(163): n is a, c, g, or t
tcctgcggggatcattgagaaagtccaatacctcactnggtcagctataagaagagcgtngaccattgaaatgcctcaacaagcacgtcgaaaagctacagaatgcgatgtatcaattaagtactgtactgatgtgtgggggtgctgatcgtgggttgatctngatgctctctgctgaagttg

SEQ ID NO: 675038 - DNA, 199 bp, Homo sapiens
cggttttaccgctgcacgatgactcgcattcatgcagtgttggcttccttcagagtctggctctcatcagccagctctttgttcgggactggtcgtcatgaggatgactgctggtggcagccactgctcgccgggcatccaccctgaacagtcggatgtcgctgctcctgtggctatggttaacttgctagcaccagcc

SEQ ID NO: 675039 - DNA, 211 bp, Homo sapiens
atcggccggtaccttatgttctgacccaccaacaaaaagattagaaaacaaatggatgaactgttaacaatgacagtaatatacagcgagctataaagtcacagtatggatgtcattaatgctcacagaaatatgttttgaagttaatcaggaaatgatcccagcctgtggaggagctgtatagaaagtagctgtttgctggtacatatca

SEQ ID NO: 675040 - DNA, 132 bp, Homo sapiens
  misc_feature (10)..(10): n is a, c, g, or t
tagtgtaccnaatttggggagtctttcacgagactctgttggtgggaaaaaaaaaaaaaaaaaaaaaaaaaaaaaaaaaaaaaaaaaaaaaaaaaaaaaaaaaaaaaaaaaaaaaaaataaaaaaaaaaaaa

SEQ ID NO: 675041 - DNA, 615 bp, Homo sapiens
gcaggggcttctgctgagggggcaggcggcgcttgaggaaacggcagataagtttttttctcgttgtgcaaagcatcagcagcattcaatcacaactcacttttaaaacaatcattagtccacatcagggttcactcaggcatcattgtgacttagccggttaagtcttttaaacggtcaattttcaatcagctttaagcatttccaagcagcaaaatcatgcaagcacttcagcaagcagtccagccatgcaggcacacggcacaaagcatcacacacaggtcttcgtcaacaaccatgcacggcagggttcgcagcatcgaaagccttctctccatcgcgcagtaaaaaaacatgtattttcacccacagcaacaattgcagagcaaagggcactcacagagcccccgaattaaataccaaatagcaagggcaatggcgtctttcagcattaaaatggcaaggtgagttcaaaccagcttcaaagtcttcagttgtaacaagtagtcaaggtgattcaaaatgaatttagaaggccgatcatttttaaaaaagagcattaacaaccccgaaaggtggatttcacacgcagcagcgtctgcaaacatcccactg

SEQ ID NO: 675042 - DNA, 335 bp, Homo sapiens
  misc_feature (99)..(99): n is a, c, g, or t
  misc_feature (257)..(257): n is a, c, g, or t
  misc_feature (290)..(290): n is a, c, g, or t
  misc_feature (293)..(293): n is a, c, g, or t
  misc_feature (304)..(304): n is a, c, g, or t
  misc_feature (315)..(315): n is a, c, g, or t
aaggatacaaaacaaaatcagcaaaggaaaaaagacaccatggggtgaagtcaggggaaactaagtgcaagcttccaagaatcctccgccagtggaatnacagaggatgagcttaattctcccagcaaccagttgtaacagcacttgtgaaacactgtcaaccagaaaagcttgttagagactgagtgcctggggtttttactgggagctggttacaaaggtagtctctgcctggcacataccaaaattccagactnccagaaggaaagcaggtgttccaggagaaactnatnattgttttacnagtttgagatnattagtaagctactttgatc

SEQ ID NO: 675043 - DNA, 222 bp, Homo sapiens
aaacacaatgtacaggtcatccgtcggttgggaaaactcggggagtgcattctcacccagcaactgagctctgtatacaggctcaggcagagcctgccttctctgggctatcgtttcaatgtgtgttgtataaacagcctccctttggtgcgagggcttccttctgcataaatctgcagctgctgaagagccagagttgaaggcaggcgcggtctgccgccg

SEQ ID NO: 675044 - DNA, 100 bp, Homo sapiens
tccgggtcctcatggatggtcaacgtcactgaaacgagatttcacgatcttcgagtacttccgcagagacacagagaagcgggacttcgtctccgcaggg

SEQ ID NO: 675045 - DNA, 1042 bp, Homo sapiens
aagcattccggccttttgtggttgatcatttctgctgccgactgccggttgtgaaggatatcagcagtcccatgtgatcgtgcgctaggtgcgagtctccatcttcacgggatgctcttcgatcacttgagaccatgcgtcgttgatgcaagggaacgagttcgaatatagcgagaacggcaatatcctgggtagctagcttcgacgatgtacatctaagctgaccgaagttcctatccctgttgtcccgtaccaacttgggatcatgataggcgatcaggtgtggcccatgtttcgacgacgaatggattgtgctgatggggcgggacctgggatatgtgagcaggtccattcccccagagagaggagagaagattgctacacggcaaggtagagttcgtctattgtagcgaggcttcgttgggcagacacgaattgcctctttatttacctctagtatttgcgctgaacggtactgagaggactaccgtggttaccgcgagaggaggctgacttgtgagactgcagaagggttgactcctcttgcagtcggtaagaagacctctagtaatactcgttcagtgaactgtaggtagaaagaagcttacaccgagagaagttccaggccttgatcgagacaccaaggaatgcagcatatgatggctggaatgcccttagtagaatgtgagtgagatggtgcgttggggccgtatctcccctgtagttatagtgacgtaattccgagcggcataagacgttcaactttggcgtgagcatagcggttgccagtgcaagtgttgtgttgcaagagtcgcttctgtgctcgaaatgccgaggttttgccaatcagccttcgacaacagcgtggggcagatcccctccccgtgccttcgtgcgctgcgagtttttggcggaggtaaacactactgtaggttacaaatacaccgtgcgaaacacctttatagtgcacccccgtgtggtgggcttcttccctgcgcgctcacaagtgagaggggccgcgcgggccgcagctgcaaaagtg

SEQ ID NO: 675046 - DNA, 449 bp, Homo sapiens
  misc_feature (201)..(201): n is a, c, g, or t
  misc_feature (211)..(211): n is a, c, g, or t
  misc_feature (213)..(213): n is a, c, g, or t
  misc_feature (233)..(233): n is a, c, g, or t
  misc_feature (259)..(259): n is a, c, g, or t
  misc_feature (268)..(268): n is a, c, g, or t
  misc_feature (271)..(271): n is a, c, g, or t
  misc_feature (276)..(277): n is a, c, g, or t
  misc_feature (315)..(315): n is a, c, g, or t
tatgtccattaacctcttaaaatcagtgaattcttgattgttttaacacagtccctaagactaatgctttccgtggacactgagccccgcctcaggcgccacgctctgggaccggagagccacgttcctggcgactgctgtcctcgcagacactgagctggctgtgcctctggaggaggaagacagtcctgagacgggatngttgtccctncnggaggaacagtggccttgcntctagacggtcttcactgtgtgtttncaaacaacnacnacaanntaaaactcttttgacctgtaacttaaagatcataaacntcaggcaataatattttctgtgtaagcttttaaaattatttttggggatcatagcttgttttattttgtgctataaaattaacagtattaaatgacttatattcttagaatacatcgagtgtcttttcttaaaa

SEQ ID NO: 675047 - DNA, 210 bp, Homo sapiens
cgaggagggagaatcattctgaggccaggagttagagaccagcctgggcacatagatgagaacttgttcttcttactcttacaatttataaaactaaagctggcgtgtggtaagcatgtgcctattgtcccagctattacattgagcccctcgatgccgcacctagcaataatggaataggaccgcggttctattttgttggctcctcgg

SEQ ID NO: 675048 - DNA, 1498 bp, Homo sapiens
  misc_feature (1498)..(1498): n is a, c, g, or t
tggcagctgctgcctgtgaccctgtggcctgaagtggagctgctggtgactgtccttgagctgctggaggtggctgatgctctgcctgtgctgttgatgctgcctggagcaatgctgagatgtgctgcatgtgatgctgtgctgtgctgactgtgctgtgctgtgctgtgctgtgctgtgctgcctctgatgcaatccctgatgtgggtgtcctgaagtcccctgtgcatgcctaggccatgcccctggtgccaaaaagatgtgtgatgctgcaccacaggtagctgtccctgtgaaagctccccctgagcgttccacgtcgcacagcagatggtcagctcggggagcattcagagaaggggaagggatgcccttgaggaccccctttcaagaatgggaaaccaggtgtggattgatggttgcgcttgcatggattcacacgccacaagtcacctttgccattggagcacttgcctgggcatggatcgctttcgccccagagacaaaggacagcactttaggaggaggagccacagtataacctctgccatttggaaatggtagacaattacagaagccaaggttagctttggaggccaacgacgtgggatcttagaccatttagaagcctgttgctgacccttactttgatttggtggtcctttgaccagtggccgtggcgactgctggcaagcgtgttgtgagatgactgtggcatgtcccaattccataatcataagcaaaaaggaacgtgggtgcaacccgggataaaaagcctgttcattggccccagctggaaagaaaactgaaccttaagtccgttccaaggtacgcctttatgtgggggaggccaaagaagtaagcgggcgactcatacatggagatgtcccattttcccatgtgatggtaagacataaggaccgtgtgcgacatctccagagttgacccccatctaatttgacaggcgagttgacaaccacacgttgggccgtgaggctttgacagaggagagcaacacaaagaagagtgtgttacattacaaccacattttgttgaagacgtggattacttccctcggagtgtgtgacgggacccggtcagcaatgtggattcgaggaggacaaacgcccacaagatttcgacgttggcatgagatgcggaggattggcaatccaagtaaatttaacctccttgcgcattttctgaattccgcacagaccttttccttgtgacgaccagatctagcttggattgtgcgtcaatgacacaggcgacacgcactttccttacacgcgaagtttggtgaacccttaaaggagacttcacaagatgtgtgcgcaatttgaacatcacttgaggcggacccacgacgacagtgatccaccaccggggaggagcacgaatctcattgtggatgggaggcagagagtttgatcgaagagtcgtacgagaaaccgtgcccagttattccgacgactgtggagaacattcgattgcn

SEQ ID NO: 675049 - DNA, 245 bp, Homo sapiens
tggtgcgggcacagaggaagtcacttgcagcgtcatcatccctatgtccaccatgtaggggagggacttatgttcaggaagaaatccgtgtctccataccacactatctacccatcagagacccctttcctatcactcaaggccccgagcctggcacaaatggatgcatacagtcctgtgtactgccatgaatgtggatatgggtgcatgtggggtgtaacagatgtgcctacaggtatgcatga

SEQ ID NO: 675050 - DNA, 254 bp, Homo sapiens
cggcattaaaagctatccccaaaatgtccacgactgtggttatcagcagccaagtatatgagagcagctattaaaactatagtcatggggtgacgaaaaacaattctcatcatgaatgaatacatgtggaatctccgcagagaaacgcacattattataaagaaccaaatacgacccgactacatgacaatttaaatagtacctttacggttgacttcctacgactgacgacaacaagaccagaaccacactgg

SEQ ID NO: 675051 - DNA, 307 bp, Homo sapiens
ctcataactgtcaaaggacatgctcctgtcaggcatttaaccagacgtgattccatcttgaacaggggctgagtaaaatgaggctgacacttactgggctgctttcccaggaggttagacattcttagtcacaggatgagacaggaggtcagcgcaagatataggtcacaaagaccgtgctgataaaacaggttgaggtaaagaagctgccaaaactcaccaaaaccaagatggtgacaaaagtgacctctggtcatcctcattgctcattatatgctaattataatgcatcagcatgctaaaagac

SEQ ID NO: 675052 - DNA, 274 bp, Homo sapiens
gcatttggctcccgtttggggtcctggtcctttgtgcaaatgctttgggattccagttttgagctgaaaaaaataatggcctttttgggcctttcctttccctttactgaaagctcagtgcttttggggttgaagttggccaaaggcctgcttcagggaagttgggagtcccccggccctccccccttttaggtgttccctcccctcccccccccccccccccctgggttggggttggggtggagggggttttcaaggtacccatgtgcctgga

SEQ ID NO: 675053 - DNA, 135 bp, Homo sapiens
aagaaacagacaagggctaagggctttgaggcagggaagcaaccttgggcatgtcttcacaagtaaagggaaggaaggcctacgttttggcttaaatttccaattaaagggaaaggcaaggttggggggggtggg

SEQ ID NO: 675054 - DNA, 487 bp, Homo sapiens
agcggagtgggtagcagcatcctcccgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagcacgccgccgaccgactgcggggatcgcagctgatgccccattccactacgaatgaccagagaggatgggaaaatatcgcacgcacggaggccgaaagcgagaggggctagcagccagctatgccgggagctgagtcccatatcagccgaccccagacgtacagaccacagcacggatatcagaaccacctgagcagagacaggaagctgcaggtcccgagaaag

SEQ ID NO: 675055 - DNA, 842 bp, Homo sapiens
  misc_feature (112)..(112): n is a, c, g, or t
  misc_feature (454)..(454): n is a, c, g, or t
  misc_feature (462)..(462): n is a, c, g, or t
ctagcccgcagagctccaccgctgatgccaacgaggccagtgctttattttaatgtgcatagcacaggggagttgcaggagagtgatgggggagtaacccaatggggtacanatacttatagccccttcttccaggggaagggaaaatgggggaagtgtggcaatctgagggataataaatgatttttaggtggaaataaatgggcctaatggtccgacaatggttagtaaattggaaggtgctggccatttggaaattggaatggggcaaaaagaagaaatggtttgggattcttcctctgggatatgaattttactcttctctggttaataaaatttcgaggcaggcaattgtgttcctctttggtaggtccagtttctagatagatgagggaattttagagaacagctttatcctatgctttgggggaggacagaggactggggagatggngggaggantttagaacttgagctgcttatttaaatcaacaatttttgggggggaaatatttagtttttagctctcctgttggaagctttatgtacaaaggggtttccattttaaagtaagaatgggggcctgttggagagagaattggaattgtggtcgcgtgggaggccatcaaaaaataggaggcttggaaggaggtttgagacaagggggaggccatctttcaaagggagtgttggggcttggaggggcagcttccgtcctaaggcaatctggcttgcgaaaagtatggggggacaaggaaaccctgtgtgaaaatccgggggtggagggggggtttgttaaaaacgagggggtgccctggggtgtgaaattaagggaccaagag

SEQ ID NO: 675056 - DNA, 121 bp, Homo sapiens
ggtcccgattgtgaaataggtaggtggatcacttgagtttaggagttcaagatgagtctgggtaatacaactgaaaccctgtctctactaaaaataccaaaattatcctgcgatgtggtgg

SEQ ID NO: 675057 - DNA, 220 bp, Homo sapiens
ctaacctatgataagatagagactggctgggaagactgagagttcactgtgtggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatacaaaattagctgggag

SEQ ID NO: 675058 - DNA, 680 bp, Homo sapiens
  misc_feature (23)..(23): n is a, c, g, or t
cgagcaggtacattgtgacctgngaagaaccgcgcttaacaccaggatgtgtttcgttagatttccttccctaggcgacaagcagggagagcactgattggacacataagtgacattactcactaagctaagaagctataactggtgtggcttatagtttataattagagaagttataaaatcaggaaagaggctctcattacacagcaacagttactaccctaagtgacatgtatgcttaactgtctcctgactgagaagttttggatacagaggcaactcaaagagtagcttggcgaagcactagaacagcaaatttggagtaaagttctgacactgtcatttcttagctgtgggaaccgcgaaaagaggcttaactcctgcatgctcaggtttctcatcatctattttatacatactacttgcgaaaattaaacacggtaaataatagacattatcccaattaatagaaagagcttacgcgttcccagtacacagtatgaaatacttattctactctgccaatccagaattttttaaactcccacaaaagggccctgattttgaaggcacggaaggataggggcttctggatacaggcaagataaggcagaatttgtcatgtgggattaattcttatcccgcgcccggcttgaccagggcacgttggctggagaccg

SEQ ID NO: 675059 - DNA, 756 bp, Homo sapiens
atataattgagagattaaatctatattatagctatatttaggtgacattatttttctgcattatttattgaaataaaaaagatctaaatgtatcttgtcattaatggtggtttgtaatcagttaactaatgtctaactatttctaataaaaagacaaataggagtctaaatttctcatcattgtagtacagaagcatttaaaagaaatactccatgttctaaataaaatatagacctaaacatccttatgggtcataaaatgtgattcttaagtgaagtgagtgctttacctgctgaaccagaatattttaaagccaatccactttgctttcaggtttctttctgcactcctaatgttaaaggttatttttttcttcctagctggggatggcaaggactatgctaagttgtatgtccagcacaattgtattcaatagcaccattttttttcttcatgatagcatatctacttttcctattatctctgttatcctacagagaaaccatcataggaaatttgagatatcaatagaaaagcattaatataggtagtccatcttaaaatcacaggcaaagatagaaacctgaagggatctggactgcataattaggagttcctatagatgttgccttgagggtttagtttaagaaaagtgggggcttagatatctcaagttctttatatattgacccggaattttccgtcccaaggggctttgtctaaaagctattttggattgtgtccctcgggctaaa

SEQ ID NO: 675060 - DNA, 230 bp, Homo sapiens
gcccagcttcccgattccagtggagacggttgaaggagatgattaaagtctggaatgccatgtggtcgtctgacctccatggaactcatgagtcatgcggaaccatcagatgtgcgcacgccggaaagcttgcttctgacccacctctacggccgtgctgtggctctagacactaaggactgagatccactgggccatcaaggcgcggcactgcagaggtggagctgaaa

SEQ ID NO: 675061 - DNA, 382 bp, Homo sapiens
agcgacaccgtacagaacatcaccgcttactaccgccagcgcctcgacgagatcctcgaagaccgcccggacctggcccgcgcttccagcggccgtaccgcgcacttcttcctgcccgacccggaaaaaaccttccaccgtggcagcaccgattactttgtcagcgaccgcaagatcgacatcggtgcctttgacaccccgacctttaccggcctgcccgtgggcaccgtggaaaaagccggcaagcgcgacttgcaggtggtcacccatgagccactgtccaacggcgacggcctcaatgtgctgatcaagcgtgaagtggtgggttttcgcgccaatatcgccgagcccaagggtgagttcgaggaagacggtgagaagc

SEQ ID NO: 675062 - DNA, 401 bp, Homo sapiens
gttttccctaggcttgcttccttcactatgggcaaccttccaccctccattcctccttctactcccttggcctatgttctcaaaaacttaaaacctcttcaactcacacctgacctaaaacctaaatgccttattttcttctgcaatgccgcttgaccccaatacaaactcaacagtacttccaaatagccagaaaatggcactttgaatttttccatcctgcaagatctaaataattcttgttgtaaaataggcaaacggtctgaggtgccttatgtcaggcattcttttacacatcattcccttcctagtctctgtgccagtgcactcgtccaaatcttcctctttcctccacctgtccctagaccagccagatcgtgagtctctatctctttaagcat

SEQ ID NO: 675063 - DNA, 378 bp, Homo sapiens
ttttttttggggttttccctttccccttggaaaagccccggaaacgggcccctttcccaggggtgggggggttttttttaggaagcccccctttttgggggggggggggtcacccccccaaatggggttttttttttttccccccctttttccaatgggggggttgaatttttcccttaacggtgaaaccgggggggaaagtgtgggtccttttgagggggttctttttttttgggtttgttttttttgcccccaggggggtttttaggggttttggggtaatttttaggggttttcccttgtttttttttttttttaaaggttttaaaaaaattttccccctttttattggggtttttttttgggccccccccccca

SEQ ID NO: 675064 - DNA, 128 bp, Homo sapiens
atggggtatctccacaagtattccatttatacacatgaactaaacagacaagcacagagtcactatggcggttagaagtgggcagcattgggaatgggggaggaccatggtggggaatggggatgttt

SEQ ID NO: 675065 - DNA, 319 bp, Homo sapiens
caccatcatgtaagcagaagtctcagggtccagacacttccctgagccaccactcccaccccaattcctgcctaccaagcaagcagccccagcatagggcaagacagggtgagcctcatacagactgtgccttgatggccccagccttgggagaagaatttactgttaacctggaagactactgaatcattttacccttgtctagaagaataagtcataaacaatacatgcccgggaaagtgggtcatctgaattgggggtagcaattgatactgttttgtaaactacatttcctacaaaatatgaatttatactttga

SEQ ID NO: 675066 - DNA, 772 bp, Homo sapiens
ggagaaagcgtgttgcgtggaagataatggcggcgcgggaagtgtagcacagggatctaactgccactctcgtctcctgctggctggacctggaggattgggaggaagatgtcagggtttcatggtggatgagaccttggactttggggggctgtcatccatctgactgtcttgagtgagggaagagcactatacagtgttggtgacgtccagagtaaaccacttcgaccggggccgtctcccagcgaagtgagccaatatgcagtggcagctgagcctcccgagggctgtgaggctcagcactaggaccccgtcagtccagagaagctggaggagatccgtcggatgaggccaaccggctggcacgctcagctggagcagtgtgccctgcaggatcgggagagcgcaggcgagggccatggggcctcgccgagtgaagcccagtcctcggcgggagagctttgtgctgaaggatacgtcctgtccgagacctgctgtccactgtgaactctttgacgtcggagcagcccctccccaagcagcctgacgcctcgactccggagtaatgataggaaggggtcagtcagggcatctccgggctacatcctggaaagaggccctccaacatggaagagggagtcagccagcttgcaatctgtgtgcctgcatccgaaagcgccagcatcttctcctcttaccccgatcgactcccccaggaccgggggagagccggggcccagtgggagagcagaggcaggcgaacgcaagccga

SEQ ID NO: 675067 - DNA, 372 bp, Homo sapiens
cttatataagtatattaacttgcaaaatacgatgtctgttaaacacagctgttaaggtattctgagaccgcttataggattatcataatatatccatgctaccttgcatctgatgttcctggttgcaaaagtcaaaacaagatctaaaaatagtctgtgtgtgtccccgacatgctcgctcctttgatattctcaaacagccagaaccatcccgtctcacggattgccaggcgccaggccggcttcccggtgcctctttctcgaccattttcacttaaaagcactgtgagtagaattagctgtcacgttcctgccacaaggcagtcagcctggtcaagaggcgtggtctggaatccaataagaccactgctt

SEQ ID NO: 675068 - DNA, 901 bp, Homo sapiens
  misc_feature (901)..(901): n is a, c, g, or t
tcttggcctgttctagaaccttgactcctctgtgctctgctctgataaactcctgctcagtttgttcatataatactgttgacccagtgcctgcattaggtgggttgtgagtgttttttttttttttccctccgggggtggagacgatttcggggtggctcatccatttctggcctctgctacccagggcacacgtttcctggcacgcacagcttgttggggggtgtgccagcacacgcctgtgggccacagaagagacacagaatctcctggttgctcacctatgggattacgcccacggggctgggtcgcttaacgctcaggcgctccgggttccaacaccgttttggtaggaatattgtccagggaagacccgcgtaaaataccctccattgagaagacgccggcggaaaggggtccctcccaggggtccaaagggcgcggttcctctcagattctccacaatctggagcatgtttattatactaggggggcgtacgggggaaacgcgctggcgcgacgattctggtccacctacttaagataaattggcccacttgatttctttttaattacaaagtggccctttcattttaaaacctgagatggttaccttccctgggggtgccttcagccaccaaagtggtgccagtccccccaaccgttgaccagagagccacgctgcccgtgtgtcctgtgggtggctcccttgcccccgttcagtccccgtgctaaagaatgtcctgtgccgtgttccgctttggagacaggccccggttcggtcctttatctcggttgttcatccgacggggacccggagggcgtcgcggcccttgtggtgcacccccttgacggggcggtgcccttctccgggtaaaggcggcccggtgtcgggccgtgn

SEQ ID NO: 675069 - DNA, 1292 bp, Homo sapiens
aaaagggggtttacgcgttgtgttccggatagccgctttccaaaagtgccgcgtggtactgccttagtgtggctggtatgatagacgcccctttataaagtggtggttaaatagggaagaaatattcttgtgggggggcagctgatcagcaaagcttttttccgccagaagggcccccccttctgatggggtctatatcccccagatgccccaaggggtcccacccccctgtgtgtccccccacttttgccaccaaagggggggccccccatgaagccgcgccttttgggcccccccaaagagaaggttttgtcccgttttaaagaggtggcgccctgattctccctttcaaagagggtgttttcttccacagcagtttttgggtagagggtggcaaataggcgggttgtagaaagagattttgtcccccggaagaaccccttttgtctcgcactattggccccagagatatctttctgatgcccccccctcgtggtgtgaaatatctcgagaaaggagaaagcgcttggtggccacacttcatctttagagggcaaactctggcacacacaaggagatatttgcggggtgtgataaaggggctgctttctctttttttgcgccacacctcgagagattgtctctcaacactatgtcggtgtatggactctttggaacacaactctcacaagccacatatgtgttgcgaaataatggccacaggggtggacacttgagagttgtcccctcgcgcccacagctgtattccggggaaatctcctgtggcgcccacatgtccacctctgtgtggtggtgtgtgccctctcttggcgcccacgcgtctcctctgctcggagaattatagcttccacacgtggtatccccctcttcaacttccctctcccacccacggctttctggacagcccgccctcattgcgccacattaatattcttctataagagaggtggtgttccccgcgagctctctttgggagcctcatccttaaaccacactgagatggtgtatttttatagaatgggagatcgagatcttattaatgttatatgtaagaagaataatttttggagccacactcaagcttttctgagatatcccacaaatcacaggaggcacttttgtggagatttatttaaaattaatgtaaagaaagaatatgcaccacgatattcgcggagatatattattttggtgaaaatgccgcttttactttgaagtgatttccttgaaggaccccccccagttcccatataaatggctagaaatttgta

SEQ ID NO: 675070 - DNA, 940 bp, Homo sapiens
taaggttggagggggaatgcgggaaatggtaaggggtatggaaacttttcatataagtaaggctagggtgagtggtaggaagtttttccataggaggtgtatgattgggtcgtaccggaatcgggggtatgctgtcgaattcataagaacagggaggttagaagtagggtctgggtgacaaaatatgtggtgtagagttcaggggagagtgcgtcatatgtggttcctaggaagatggtaggggtgagggtgtcatataataatgtggtgtatcggtatgaagaatagggcgaaggggcctgcgggtatcgatgtgaagcctgagatagttcggatccccttcggcaaggtcgaagggggtacggcgggactcggcaacgggggagatcaccatcatatcagggccaagggtcatgagggcaggagtaaccagaggggtctaggcgtgcgacaaggcggcacaggtcaaacgacgcacctaatcaagacaaggtccgacccagtacaaagcacggatacggagcactcccaatatgagactgccgggcacacggccccgaaagggccccggaaaccaagcgagcgagaagacgacacagaacgccccccccgacccacgagcgaacggcacgacacccgggtacggcaccaacgggcggcaccacaacacacaacgacggcccacagctacccagctcacccaggagccagcaacaaccggacaggcagccacacaacaacacaacagcccacccacccaacgccagcgaccgacaacaaaggcagccacacaaacaccacactaacaccgctcgcgcaaccagacgctagcccaccaacgcaataacacgagccccacacgacatcgcgacgaagtcgcgtgcccctcccatacaaacccacacactcagcgccagcgacaccacgcacccaaccaacc

SEQ ID NO: 675071 - DNA, 296 bp, Homo sapiens
catcacgtgcctgctgcacttgcctccataaggctgctgatacagaagttgttctgcagtgtcgagacgccctgatctgtgaggattgacgtgtgccggaatactggacaggataccgtctggttctgggcaggtgtatagtaatggagacatctttcacagaaggtgtgcaggcaaggcacagaaccttggggcactggtaccgatccaggcagatgctgcataccaggaactgcttgtccattggctggacctctgggccaggcctgtcctccctctttgccatggcgcccaca

SEQ ID NO: 675072 - DNA, 293 bp, Homo sapiens
agaggatctcggaattgtgtggtgttatgcctaaaaacatcgttctaataaaaacgacatcatcccattgtatcgccgcgtttttcgagctgtccggcttaaacgaaggaacgccgttactaatcgcctctactcccgtcattgccgaacaaccggaagcaaacgcccttaataaaataaagactccgtatcctgatgaaaagaaatgttccgcagacgcatgctcccgataattgaagccgttccatccttcacgccataattgccagccgccaacataacaccacacaatt

SEQ ID NO: 675073 - DNA, 244 bp, Homo sapiens
  misc_feature (14)..(14): n is a, c, g, or t
  misc_feature (231)..(231): n is a, c, g, or t
ctagaggatcccgnttatcgcccaacacacgcccggctactttttgtatttttagtagagacagcgtttcaccgtgttagccaagatggtctcgatctcctataggcacgtgctactaacccctggctaattttggtcttttaagtagagacggggttttgccatgttggccaggctggtctcaaactcctgacctcaagtgatcctcttgccttagcctcctgaagtgtnggggataacatca

SEQ ID NO: 675074 - DNA, 1013 bp, Homo sapiens
aattaagctaggtacgaggctgggtttgaattcggccgaggctcgcgcccccctctctgctgaccctggcggccatggcgtgcagcctcatggacgagctgctgtgctccatctggctgagcatctaccaggacccggtgagcctgggctgcgagcactacttctgccgccgctgcatcatcggagcactgggtgcggcatggattggcgcatgggtcgcccgcgatctgccccgagtgccgtggcgcacgttcgccgtagcccgcgctggcgcccagaccctccaagcctggccgagaccatcgatgtgagcgcgtaccagtcatccattgcccgctggcacgccaatccgtcaacagcgacgccgcagctctgcgccgacccttgctccaggcgcacgattaagggtcaacggctcttctgctctcacgggatccgtcgccagcttcctctcgcttcattcttgctgtaccggagtcggctgccgaactcgcgatcgcagccgaatgtctatacattgcgtcaagccctgggactaatctggaaccgaccgacctctctgtagccgacgtccttggcccagtaggtgaagctctgaacgttggatccgaaactgtcagcgcaccttgcaaaggtagcaggacgaggcagggtaacgagcgacccagagagtcggctcgcacgactggctctagagtcgagctaacttggcgataggcaccaagtacttccatcgaagagcctgcggaccgactatcgggcgaggctcgttcggagccggctggcgatccggtgcttgctggcgtcgatacggccgagcataggccatgctagaggagctggcaggctggacactggcccggcacgcctgacgcgactatctgagtcgatacaagtcccaagcgcttagcagccagtcagctgcggcctaggtccaggaggggagcccatggatccctgcggaagcgggttgggttgaaaacccgaccgtgccacaccttcctggctgggtg

SEQ ID NO: 675075 - DNA, 659 bp, Homo sapiens
tcacttaggcagtgagtccgtggtctcgtcatacctggtgtccagagtacacgtagagctgatgtgtcaccagcgcatcgtccagtcctgggtggtccagagctaataccccgatctcaaagaataaataaatcaggtgatatacataagggggaagaagagggagaagaaagtaatttcaggtctgggaagggctctcctaagatacaacatttaatccaagagctaaaaggaaccaaccacacgactgttccagacagatagcgctatataatggtggattccataattcatgtaaataatagttaatcaattagctatttaattatcattatgtccaatagccccaagcttcttccaaattccagcttgggactcacactgtagaccaatgagaactgggaacaaaaagggaggggtgggagaagtcagccacagtggctcacacctgtaatcccagcaggcggattgcttgagcccgggactttgagactagcctgggcaacatggtgagaccccatctctacaaaaaatacaaaaattagccgggtgtggtggcacatgcctgtggtcccagctcctcaggaggctgaggcaggaggattgcttgggcgtgggtggttgaggcctcagtgagctgtggacgccactgcattcag

SEQ ID NO: 675076 - DNA, 635 bp, Homo sapiens
  misc_feature (264)..(264): n is a, c, g, or t
  misc_feature (336)..(336): n is a, c, g, or t
  misc_feature (373)..(373): n is a, c, g, or t
tgggaaaggaggcaggggctacccagagaggggggctcgtgtggcacagcccccaccgactccgacgtccccctcccctgtgagccccgggggctgtacatactctactccatccccttgtccatccctgagaccacccccgccgcccttgcgtcgacttagcaaccacctcataggcccacccacctcgggatccgagccaaccatcccacatcacaaactttggtttgggggactttacgttcgtttaatttctcattttgnacggagaaatattcttttcgcgtcttttgactgaagtaactttcctggtgctgttgttaactcgttcctttntttaatttattcccccaccccaggcagccctcctggntcctactcaccgttagtcccattctgaccctacgtaccatgtgaaccattcgctcctatactgttccgtcagatttaggaaacagtcttcactcctacccggcctattcacagcatactgcccgatttacatgtagtcactgctaccaggtacagatgcactgtgaagatttcacgcttaataaaggtgtactggtgttaaccctggtgtcgtactgacaccatgggcggcccggtccccaatctgcctatgaagctgttgc

SEQ ID NO: 675077 - DNA, 592 bp, Homo sapiens
  misc_feature (264)..(264): n is a, c, g, or t
  misc_feature (336)..(336): n is a, c, g, or t
  misc_feature (373)..(373): n is a, c, g, or t
  misc_feature (400)..(400): n is a, c, g, or t
  misc_feature (443)..(443): n is a, c, g, or t
  misc_feature (451)..(451): n is a, c, g, or t
tgggaaaggaggcaggggctacccagagaggggggctcgtgtggcacagcccccaccgactccgacgtccccctcccctgtgagccccgggggctgtacatactctactccatccccttgtccatccctgagaccacccccgccgcccttgcgtcgacttagcaaccacctcataggcccacccacctcgggatccgagccaaccatcccacatcacaaactttggtttgggggactttacgttcgtttaatttctcattttgnacggagaaatattcttttcgcgtcttttgactgaagtaactttcctggtgctgttgttaactcgttcctttntttaatttattcccccaccccaggcagccctcctggntcctactcaccctcctcctctcccccnccctccgtcccatctcacccatctctttctttcctttccctcngattttgnaaaaatgctcctatattccaagtcctgtcgagaccatcattcccaattaaaatctaatcactgctatatgcctcaaacgctctgtgaatatccaagttttactaagggtgcacactttttaaaagaggtgcctgcaaaact

SEQ ID NO: 675078 - DNA, 346 bp, Homo sapiens
cattgtcataaagtcaaaaggtgcctgggaaataaaataaaggaaaaagaatccagtgtggcaaggctcagagccctgagtcaaacaccctcaggaagacaaaacagtgaataaataaacattctgagagttttcatcaatatcaccacatctagaaaaaaacacctgagtagttatccctatattctcttcttctgactagggaagagagaaaacatctgctggggagaaaaggatgagatgatgcataaaccgtggtgttgatcatctctgctgcaaggaatgaagactctgggagtccaacgtgaaacccaaggctgacccgaggccacagaatactgccaga

SEQ ID NO: 675079 - DNA, 420 bp, Homo sapiens
cttaggaattaggcctgaatggagccacttggggtaggaaggcacctccctccatgcagtgggttgtgactcatccacaggatctctctgtgtgagatttctctgatgttcttagggatatataaagggggagtataagctgattccgttttccctgctgtgtgattgtcctgattgtaaaaatttcctagctttattgttggcaaatacttgtatttcaaggattaccttgattagctatatcagaaatgggttggagagaaactacaacagttccttaaatgttcttaatcttcttatattattctatataattcctgaagagatcattcggatatgtttacttgagcaaaacaggcagatggtgttgctacccagtttcccaattctgtaaggcctgtatcagacatttacggtagg

SEQ ID NO: 675080 - DNA, 252 bp, Homo sapiens
  misc_feature (221)..(221): n is a, c, g, or t
tcagagatccctattcgatccgctgatccagcatggaactctgacccaaccggtccttactcagcatacttttgttttattctctcaaatccctcttgggcactcaatgcctgctcgctggcaccttccgcaaggctgctgggcctgtgactgcctctgccccccttgctgccgtgccttggatggcggagcttcctccatccggtgtccagcaagtcacnccagctgcttggtccatgcttgtcaaccagc

SEQ ID NO: 675081 - DNA, 360 bp, Homo sapiens
ccggttacagtgtatcatattcatgatgtaagttgaggatgtaagtcccaggagcagcaattcaatcttgccatctgcaataaaggttatcctgtcaggcagtctcaaatagtcaaatatatttacattgatattttcctcaaggtagtgctccctagctctccatcttaggtgagtaaagccatagatcggttttgtccacataatttcctccctttggatttaccgtttcaaagcgaggcaatcctgtactcaagagtgcccacaatagccctcagcaccatgccgcagactagaaatcccatcaaaggtctgttccttatctacttcgagagtgtgtgtgtagtgtgtgtgtgtgcg

SEQ ID NO: 675082 - DNA, 235 bp, Homo sapiens
  misc_feature (5)..(5): n is a, c, g, or t
  misc_feature (83)..(83): n is a, c, g, or t
  misc_feature (141)..(141): n is a, c, g, or t
aggcntaaagacaactatttaaagtgactatagccataataatttgttaagtatattaagataaacagttgtcattgtgacancgataacaaactgttggggtggggggaataaaagtgcagagtttttgtatgtgagggnatttaagatgttatcagtttaaaaaagactgttaaaacctataaaatgtttgatatgtcttatgaaaaccaaacacacacacacacctctaata

SEQ ID NO: 675083 - DNA, 162 bp, Homo sapiens
aacccaggctggttctcaatactcctgaactgatgtgatttacccgccttccaaagtactgggattacaggcatgagtccaccattaataattttaattatatatttaaactcatttcttaattttaaacaatttaataagttattttaataatttaaaata

SEQ ID NO: 675084 - DNA, 931 bp, Homo sapiens
  misc_feature (7)..(7): n is a, c, g, or t
  misc_feature (85)..(85): n is a, c, g, or t
  misc_feature (119)..(119): n is a, c, g, or t
  misc_feature (127)..(128): n is a, c, g, or t
  misc_feature (148)..(148): n is a, c, g, or t
  misc_feature (215)..(215): n is a, c, g, or t
  misc_feature (228)..(228): n is a, c, g, or t
  misc_feature (235)..(235): n is a, c, g, or t
  misc_feature (255)..(255): n is a, c, g, or t
  misc_feature (269)..(269): n is a, c, g, or t
  misc_feature (289)..(289): n is a, c, g, or t
  misc_feature (310)..(310): n is a, c, g, or t
  misc_feature (316)..(316): n is a, c, g, or t
  misc_feature (320)..(320): n is a, c, g, or t
  misc_feature (353)..(353): n is a, c, g, or t
  misc_feature (364)..(364): n is a, c, g, or t
  misc_feature (369)..(369): n is a, c, g, or t
  misc_feature (391)..(391): n is a, c, g, or t
  misc_feature (398)..(398): n is a, c, g, or t
  misc_feature (411)..(411): n is a, c, g, or t
  misc_feature (438)..(438): n is a, c, g, or t
  misc_feature (453)..(453): n is a, c, g, or t
  misc_feature (472)..(472): n is a, c, g, or t
  misc_feature (485)..(485): n is a, c, g, or t
  misc_feature (500)..(500): n is a, c, g, or t
  misc_feature (504)..(504): n is a, c, g, or t
  misc_feature (533)..(533): n is a, c, g, or t
  misc_feature (538)..(539): n is a, c, g, or t
  misc_feature (547)..(547): n is a, c, g, or t
  misc_feature (554)..(554): n is a, c, g, or t
  misc_feature (559)..(559): n is a, c, g, or t
  misc_feature (568)..(568): n is a, c, g, or t
  misc_feature (571)..(571): n is a, c, g, or t
  misc_feature (625)..(625): n is a, c, g, or t
  misc_feature (931)..(931): n is a, c, g, or t
cttttanctgactaataagtaataagtgttcaaactcaagattttattaaaatcatttttaatttaaattatcatatctctggcngtgaaggaagacttttaataaagcaaaacactcnctcacgcnnctcaaccccccgccccaaancccttaacactcacatttaaatggttacatgattttaattattcttttgataataagcaaccttgtnatatctattcaanaaaagcnagaacccactatggaattancagttgaataaganctttgttccctgcttttggnaatgttaaagaaacaaatggnaatggnttanagagcttataagagtgtgccacctagcaaaagngtctaaaaggnaaggngggaagcattagaaagagagtnaaaaganaaataaaaaaggnctcacacgcagcattgggtttatttgngagagagggcaaganagaatgaagtgttggtganataaggtgctggnaggttagctgatgcnaatnccttccttatctgttcttggctgctaggngtttnnggctgatnttttttnatttnttattattnttnttcggtggttctgggttggtctgcatgtttttgccgtagaggtatttgtatgtntcagaacggatatactcaaaaacatgggacacgccaagctggaactggtctgcaatgggggtcacccagggattgttctctgctttgaatacctgcttctggccagttaaatccaagtttcctagttctgggggcagaacggtgaggcggttccctgaatgtggagctctttaagctgggtaagctccccgatttccttaggcagcgagatcaggtcgttatccctaaggctgagtatctgcaactttgtgagcttcccaatatctggcggcaggatttcaaaatcgttgtcacttagatagagtn

SEQ ID NO: 675085 - DNA, 659 bp, Homo sapiens
ttgtatttttttagtagagacggggtttcaccgtgttagccaggatggtctcgatgtcctgaccttgtgatccacccgtcttggcctcccaaagtgctgggattacaggcgtgacacccgtgcccgaccaatgaattcttattaaattactttatcatctgtcttgttagccttactctttcctattaacttctttgccccctgctccctttttgaattgagtggctaaattttagaggtttgtagcttttgtgtgtgtgtgtgtgtgttttatagatggtaaatgatgcttgtacattttgtacatgaatgaatacgtattttagcagacttaaaacattaacagtaattgaccttatacattttgggaaagaaaaattaaatcttcatgctactacgatttttttaaatgtggcatcaatgtttatttttaataatagtattactgacttaataaaccccaaatgtctctttaagctgatttaatggttatattatagaattttttatttcattgtgtgcttattagaaaaaacatattttagagttgggttttaaatggtagacacagaaagtaactttaaaatatcctaaacaaatatctatttcatttttcttcttaagtaaaataacacacctcattcgtgtgtagtacatgt

SEQ ID NO: 675086 - DNA, 82 bp, Homo sapiens
aattcaagcttctaacgatgtacggggacatgtactcttggcacatttcaataaaattgtttggaaaataaacacagcaaaa

SEQ ID NO: 675087 - DNA, 381 bp, Homo sapiens
gccccagttaacagctaggtatggatgcctctgctcattatacttctcagtgaacacaccatatccaaatcgatcagattgtgctgcataatcgggcgtcaaggactgccgaaatcaatgagcatccgtcagatgtctggggcgcagatcagaattgcgaacccagtgtaaggagtctactgataggcaggttaccatcactggatctagagccagtattagcctggcgcaatatctaataatgtcaggcagtacctcggagacgggtggagtgcggagcagctatgaacgatgcagattcatccataatccctgactgctgttcactcgaacacccatgatccatctgtatatgttgcagtccagacgggtattccgagc

SEQ ID NO: 675088 - DNA, 173 bp, Homo sapiens
tacgatcttccgtacgccactggtacagagagaatcgtccaagtgctggttacaggcgtgacgcactgtgactgcctatgtatcttttattataccaatactatgcttggttgcgtactaatagctctgcttgatatttttgaagtcagctttgttcttttttgatattgctt

SEQ ID NO: 675089 - DNA, 1165 bp, Homo sapiens
gcccgactccacacttactaccaggacaactcttagacgcaagagccatttacgccaaataaatgtataggcgatacgaaattgaaactctggcgcacatagatatacgtaccgcaagggtgaccaggactgaaacacagttagtaagccaagcgataatataggcaaggactaaccccctataccttctgcataatgaagttaatctagaagtaactttgcaaggagagccaacagctaacgacccccgaaaccagacgagctacctaaggtaacaggctataaaggagcacacccgtctatgtaggcagaatacgtcgggaacgactcttatacggtagaggcgcagaaaccgtaccgaggccgtggtgatagctgggtcggtccaagatcagaatcttagttcaaggtttaagatttgtgccacaggaaacctctaacatccccttgtagaatttaactgctatagtccagaaggaggcaacagactccttcggagcactaggaaaagaaccttggtaccagagagtacgaacagacttgaacagccattagtaggcctaaagagcagttaccaattaacgaaagcgttcgaagcgtcaacaccgcagtacctaacaagaatcccaagacattataactggaactcctcagaccgcaattggacccagatctatcacgcctatagcaagaactaactgtaagtataagtaacatgaagaccattctcctccgtcataagcctgcgtcagaatgaaaccattggaactgacaattaaagccaatatctacaatcaaccagaagtccatattaccctcaagggtgaccaaaaaaggctgctcataagcgcccggttcacaacaacgtcaaagggactccggacaatcttagaccgccggttaccacaaaaatcactctcagacaccccggatacaaaggacacgcaggcccaggtacccatggtttaagggcgcggggaacactaacagcgcaagggtagcaaacaccagtgcctatcatggagaccgtgttcttgctcccgagaggatagaagactataattaacccagcgaagtactgccggtacaagggcatgacacagaagaaaacactaggggaataaagcaagccaacacagggcaaacacgaaacaagcgagcccac

SEQ ID NO: 675090 - DNA, 293 bp, Homo sapiens
ttttttccctaaacccccccccccccctttttttcgggggggggggggggggtccaaaactgtttgtttccatgggccctttaagttttgggggaaaagggggggttatgaaacccaggcctggggaccccccccaagggaaaggggaattttttggggcccccctgggttttttttttgggggggggcggttttaagtttttggttttttaaaccgggcctttttaaggggacccccttgccccaaaatttgtccccgatttttgggccccctttaaaaggtttaatgggga

SEQ ID NO: 675091 - DNA, 161 bp, Homo sapiens
ctgcagatactcctatcctgatatatagtcacatactccgatgatccattcaggagctttcgtatacactgtctcctatctggaggtagcactgagctctgtgggacgaaatgattcctcctgaccctcagatatgcaatggctcccaattcctctagaac

SEQ ID NO: 675092 - DNA, 243 bp, Homo sapiens
acaggttgaacatgtttgctggtgtatatattgtaatagagatagctcgaggagaataggttatgtgattaggagtacgggttaggatgagtgggcagacgaaagagaggaagtcaagtttacttctgcctttttgggttgcggtgctgactggacggtggacgactttggtgctgtgacattgttttacggtaactacgcttttctacgtcaggttaggtctaggactacccgtacgggaga

SEQ ID NO: 675093 - DNA, 298 bp, Homo sapiens
tgtacatgaggtcgagatactgtaaagacaacgtgtggtcattggcacttgcgcactgcgtgttgatcatcatcattctgaccgggaagagcagtgatgttggctggaggttcgaggccggcgaagcattgatccctctttggatttcttcttgaagcggttccctttgctgtcatatttgtgactcttgccacgtatctcccggtacatgcaagcttgcatgtaccgggcttgcatgctgcctggatgtacagggatccaaacaccccctaggaatcaactaccattccgataaaat

SEQ ID NO: 675094 - DNA, 264 bp, Homo sapiens
  misc_feature (40)..(40): n is a, c, g, or t
  misc_feature (184)..(184): n is a, c, g, or t
agcggggactcacttggttctcatgatctgactgcctcangctcccaaagtgctgggattacaggcgtgagccactggcccagcctattagttcattttcatactgttgataaagatacccaagactggatcatttataaacgaaaaagaagtttaatggactcacagttcctgcgtggctggnggaggcctccataatcatggccagaatgcaacaaggcacattcttacattggcggcaggcaagagagaatgagaacccag

SEQ ID NO: 675095 - DNA, 307 bp, Homo sapiens
gcccagctatttatagtagttcagcagagatgggggttcaccatattggtcaggctggtcctgaactcccgacctcaggtgatccacctgccttggcctcccaaagtgctgggattacaggtgtgagccaccatgcctggcctcatatcatttataaataagagtaatttgactagttcctttccaatttggatgtctttatttcttccttatgtaatcgctctagctaggactttcagtactatgttgaataacagtattgaaagtgggcatccttgttgtgtttcatatcttaggggtaaggctg

SEQ ID NO: 675096 - DNA, 201 bp, Homo sapiens
gacgaaaacgcgtatggcgctgatgggtgtcgttgttggggtctgtgtgccggtgggtgttggggttggggtcaccgtagtggtggtggtgatgggtgtcaggttgtactctgtgtgccggtgggtgttggggttggggtcacggtagtggtggtggtgatgggtgtcacggttgtactctttgtgctggccgtttccgcc

SEQ ID NO: 675097 - DNA, 253 bp, Homo sapiens
  misc_feature (10)..(10): n is a, c, g, or t
  misc_feature (70)..(70): n is a, c, g, or t
  misc_feature (72)..(72): n is a, c, g, or t
  misc_feature (132)..(132): n is a, c, g, or t
ctcagatttnaggaccctcctcctcgcccacgggcctcaaacctcaggaccctgccgtctcacgcctttntnaaccccaaatatctgagaccagtctcagtttattttgccaaggttaaggatgcacctgtnacagcctcaggaggtcctgacaacaggtgcctgaggtggctggggatacagtttgcctttatacatcttagggagacacaagatcagtatgtgtatggcgtacattggttcagtcagcctt

SEQ ID NO: 675098 - DNA, 748 bp, Homo sapiens
gtgggaagtgggattccgatcccgtggggctatgtagggaagttggtggctgcagctgccgtggttttctcctggtgttcagccagaaacgtgcggcggcgcaaggtgtggcttggggcaacccaggatctcccaggagcctccgctctgcgcgacaaggtggcccgcgcttgccaaggccgacgcggcagtgagtgaacgttgctccgtgggtctgcagcccgataggccaattgtacagaatttaaaccgtctctcagatgttgtacagtagaactcaagaagacagactaccaagggtcatcttgaagtcgtgattgggtcactaataacaccaggacaaagttaatgggatcactactcaagcataagccccagttttcataagactgcttgtgaagatgtttgatataaaggctttgggctgagtatgtttgtggaatgggctgcaaagtgaccctatggcttccttacaaccgttattttgggcctttactccactgttttctagcaaggtgcttgtactgtcttgggaacattgtggccaagattgatttgaggggcagtgtgagaactgcagccccacaggaagaacgcacaaacacgccccctgaaaacacctttgcgaaaggctaaaatcgacttaccacagggattggcatggctggaaccacggcttttgaaccagcatggacaactccttttggagcactcacacctcgtctttgggcaggatcccctaaagttc

SEQ ID NO: 675099 - DNA, 397 bp, Homo sapiens
ggctaccccttttcaacgataagtatcttttgccttatatcatgccaagaaagacttgaggtgaacttcatcaccacagggcatgtgaaggtgggaaaagtttcttagctttctgtttctgtctctatatatattggaattcccaaattccttaaggccaattgatttagtaacaagcacaaaagtcttcctgttttcttctcatacaactacaaggttattttatttaaagacagcgacttggttatttctttaagcatagctatcttgagcatttctaagctcttctttccaccatgaccataccaccttggacctagattagaagctacttctgacactgctgaaattctagatgagattaactgtaggagaagagaacatgggttgttctctt

SEQ ID NO: 675100 - DNA, 979 bp, Homo sapiens
gcgtcagcccgcctgccgggtggaggcgtctagtggcgtcctgagccccccggtggtgccgctacagtgacatgtgtgcttgcccctgagctggagtggggatccgagcgaccaagagccatgaggatgcactgatccgccctgtccccccctagggcccaatctctccaccttggcctcagtcccggggttcctggcggtgctgtgcggggctgggggcagactttgcgagggtcgttggcccctgtgaggcctgaggggccatggtcgaccagacacgttctgaagccggtgtcccgttgctctgtccgtgtctgtaggctcgggcgacatggacgggattgccgaaggagttcccccggcgccgtggccggcctgagcaacgccccgggcaaccccgaacgggaccgacgggcgagaatggcggccgaccgggacccttaccttgcatcgccgttccctgagcgaatggcgtacagcgactgcgtcgacttccccccccgcggtggcgtcgggccggaggggcctggcgggcaggccccggcggggcggccggggggccagagcaagaccgtgaccgcggcgggccagtactcgccagggatgaccattgagcgtgtgatggggcggcagcccgggcctctctgcgggcctaggcttctgcccagcgccctgctcagggcgaggggctgaggtcacacctcgggcaccttggatcctggcaatcaaggttgccagctggaagccccaggaaagactcttaccatttattaaaacgcaggactcagaaagtctttctgactggaccttctgccttggctttgcccgaagaaggtcttgggggccctttaccagacgtcggggtgggccctcatatgggacctgctggcgttggacaacacaccaaagagacacgggacaataaggcgccaacacctactggcaggcctcgttccgccctttacgcgacccccccaca

SEQ ID NO: 675101 - DNA, 539 bp, Homo sapiens
gtggatgagtcgagaatctctcactctattcactgagtggattcagcagggagatgagtgtagaagataatacagtctaaagtttcttcagagctaagactgtctctctggggtcccattgcctatttcagatgctgcaatggtatttccaggctgacccacaagtgtcagcatctggtccagagtgttgttcttcatgtactcatagagtgtgccactttttgagcaagcagtcaagtatggtagttcagagcatgcactgtgaatctttgctataagcatggtggtgtcttgtacatttccagacatgttattttccactttacagacccttgctcttaatagacttaatagagaagaggggtctctatcctttcctcttgactaagcactggctcacagaattagccacaactagattatgaccaatagacatatggtgacagtaatgaacgatgactgaggataagtcagacaaggcagtgcagccttccacttgtgttctgggacacttgcataggatcatatgcgccagggga

SEQ ID NO: 675102 - DNA, 820 bp, Homo sapiens
ctgctggctgagcctgtgcagtcgggcctgctcgccgtctctcgagccccctgtcgtgcctgatgtcacctcgccccggtctggcatcaaggagaccatcctcatgctgaaggagcagaaccgactcctcaccaggaggtgaccgagaagagtgagcgcgtcacgcagttggagcaggataagtcgggctcagttaagcagtctgtttgaggcccgcgccctgatccagcaggacgggggacctctggattccaccttcatctagtccttgtggggccgcgtgggcccccaggccagcctgtctggggagccccattggtatagcggtcggttacttccaggtcctgctcacccgggccgtttgctctcacgcccagcctgtccccaggtttcagctgggagaggcctcctccctcagccaatggaaggacgataaacccccgtgtgttacaggtggaggctggggcaggtccccttggggtgtcactctctcaggcccgtggccaggtctgcactcccgggtggtgctggagtacgtcctggtgggggtggccctgggtcagcccaacctgggaggggtccgcaggtgtcaccagaaccaggggggcggacaccaggcatcgagatggtttctgcttgcccgaagagcccccgatgcggggtcagtgtgtgtggggcgcacggggctccgcgtgcgggggcagggcgttggggggcgccggcccccgtcgtgtccgggcctttgggacactgtcccgcaggcaccggtttcgggggatgtgcctgggggctttttggatccttcggagccggtcgctgt

SEQ ID NO: 675103 - DNA, 304 bp, Homo sapiens
  misc_feature (283)..(283): n is a, c, g, or t
tgagactgcatagggtcggcgtggtagctcatgcctgtaatctcagcactgactcagaccaaggcaggaagatagcttgagcccaggagttcaagaccagcctaggcaacaaagtgagaccctgtctctacaaacaaatttaaaaattagctggccatggtggcacgtgcctatagttccaggtacttgggaagctgaggtgaggagattacctgagcccaggaggtcaaggcagcagcaagctgtaaattgtgccactgcactaccatcttgagtggacagngtaagactctagctttaaaaa

SEQ ID NO: 675104 - DNA, 511 bp, Homo sapiens
cagacagcattatagaggttgagagttctcagttctataacaaggtagacctggatagataaagatgttagaaaatccttattaaattttttgagacaggtctcaccttgcaagcacaaactggagtacagtggtgaaatctcggctcacctactgcctcaacctgctgggctcaagccatcctcctgcctgagcctgccaagaaactgggacatacaggcagacaccaccactacacccatctgttacattttaggaggggggcgtgattagtagagacacgggtttagccatgttatccaggctggtctctaactcccgagctcaagcagtccacccacctcagcctcctaaagtgctaggattacaggcgtgaactactgtgcccagccaggatgttagaacactcttgactctgtgtagcagcataactgtccaaaacaacacaaaacaaaaccaaagaaaagccatgctacaaagtctagtgacggtcattcccacagataggccg

SEQ ID NO: 675105 - DNA, 483 bp, Homo sapiens
gttgcctgagatacattattagataatttattctccatgtatagctttttccaaaaaaaaggatttggggtggcgtggcctggtccagtaaatatatgttaaaccagaatggttcagaatctatgggagttagtcaaggtacaggtgggtaaaaggattcttcgcagggaaatttctgaggatgaggcatcccagggagctctggacagccaggggcagctgcagaaagacagaacttatggtacctcttccacgatgtgcacagagaagacttgtgacccttatacagaacacactctttgcctcttgcccttgtgacagtggacactccagaacttgcatgatatgtgcccaggcttaccgatgcagatgtgctatgaggaagtggctaagagcatgggccccggacccaggagaatcctggctatgtctattcctagtgcagtaatggccttgggaaagttgctcaacgtttttaatcct

SEQ ID NO: 675106 - DNA, 371 bp, Homo sapiens
gcccccaattggggggtttttccaagggggtccccccttccccccccaaaaaggatttttccccgggggcccccctgggtgggggcccaattgtttttccccggtgggtttggggggcgggttttcccccccgggcttttttttttttaaagggggatttttctcccccgggaagggggggggccccgggttttttttgtaacccccaaaggggggggggcccccttgtaaaaaaaggggggcccccaaggttaagatttttggggggggcctaaaaaggggggtaaaaaaaaaaaagggttttttttaattttccccaattaaagggtttacaaaaaacccttggaaaaaagggtttttgggaaacccca

SEQ ID NO: 675107 - DNA, 665 bp, Homo sapiens
ttccgagtggctgcagatttgtggtgcgtctgagcctgtctgtccgtgcgcaggatgcttcaaagtatataaaaacttatggatccccatgaagcctattacaccaaatgtttcaccaggagattggcataggaatggggctgatgggcttcatcgtttataaaatcgcgggctgctgataaaagaagtaaggctttgaaagcttcagcgctgctccttgtcatcattaaccagatttactgtgagtcacattgttgaacagacaaagtgtcagtcctgccttgtaaatttcagcaaagcggtgtacaagatgggacagctgtggaacggtcaccttgtacacgtgtgtcataaatgtaccgggttaacattcaggtgcccttgacatttacactgggcattcttgtgaggatgtgaaacactagaagcacaacgaggcccaagaacacacaccaccatcgtggttgggggggcgcggccaccgagccccactaaaaagagaaacatttttagaacacacacctaccggttgggggaagcaccggcggcccccagacgagtgacaccaagaacccagtgttgctcacaaaagctgggtgccagacaaaaagaacacccggtggccacaaaaacaccaagagcactgagggggatctcgcacccag

SEQ ID NO: 675108 - DNA, 1516 bp, Homo sapiens
  misc_feature (885)..(885): n is a, c, g, or t
  misc_feature (959)..(959): n is a, c, g, or t
  misc_feature (987)..(987): n is a, c, g, or t
  misc_feature (1055)..(1055): n is a, c, g, or t
  misc_feature (1434)..(1434): n is a, c, g, or t
gcggcggcggtggcgaggcgaagcgatatgaggatctgtgtgctggcgtgggccgggtggtcgagttaggaggccatgaagtgctgcaggagaccgagggggatgccgggtgcctggtggtggccgtccgtcctgttggtccactgctagggtaacactcatcggccatgcggtgtaggcatcagtcgatgttttgacgttgcgatgcagtcgcgtgtgagatgcatgctcgtcctgtgtggtgcacatgacgtcttgactcgtttccgccgtgcgactgcgtagccaagattcaagtgccagactgcgtagattgtggtagacagtatctttgtctctggagaaaacggcttcggcgcttgggtgagccaaaagggaggtggacaattgctgtcacggttttgcggcgcagaaagttcgatgttgggttgcacgaaacggatcaggggtaggttcggtcggcaaagacctagcgtagggcccttgggcaggtatgtggcgccgttactgtcaaaggcgacagacgggggggaatcgcaatgagtcgtttggacaggttccgcttgttcactgtggaggggtacgtgtacctattctgtaagcgccaaacctcaagctcgacatcgcggtaacgacttggcgttagcgttatcccttagtggtatccccaacaagtgttttcctgaggtgtggcacgcgatggccaggtcgataaatgcgaacgttggtaaaagtggtttcgcctcctttttcggccttgtgcgcaagctagattcgggaaatgccgcgccggtccagtggtcgctggagaagaggaaatccgacatgtggtagaccgtttgtcttctctgttaatggaggtgttgagttcgaagcgacctggtncttgatgccctatgtcctttggcccgaagggaaccgccacctgaaggttttctcctcgcgcgttcaattggttnatgaggtgggcaacctgggtgtacgacncgctagacatatcggtgaggaatcgcaagaggagtaccgaggttcttgttgtgtgcggttgcaacatnttgtgagccgcctttacgggactggtggtgcaacgttttccgttgggagcgcctggcgcaatgtgggaggggcagcccccatatccggcgatgagctttcacagaggcttttcaaatttggcgaagcgcgccgttcgggaaatgtgagtactgtgacaatccgtatggtcgacccacagatggagtgtaaaagacccgagacgctggacaggcgcagttgccgcattcgccagagggttgtattccgtggaatgtgccacgcgaatggtgtatccaagttggcctgttcgctaaggtacgaagattacgagcctatatgaaggcagaaccctcggcggggcagtgggcgtcacattcagggcggaggtttcaatttgcnacgtataggctccccacatggggcaggtcccaagtgtccgccgggagggccaaacgcccgagtggagataacgccccatggg

SEQ ID NO: 675109 - DNA, 958 bp, Homo sapiens
gctggggtctgcgtctatctctgtcgctcttttcagcccctcctggtattcccctcctaacctgggttttttacacgcccgcgtggcttcctgctcgacctccctgagtctgatcctggtttccacctccagccctgggaaatttcctttctccagactcggcctccccacccgggcctcggactttcaccccagcttctctctcctggccagtgattacccaccccgaatcccaacccgacaccggcgagcaactaacatgctcccttcacccggactgggaacatcatcccacagtccactccgacacagactgggactccaacttggctccgtacaccaatagcacactcaatctctgcttggtctcgttcactctatggcctaatctctcgtctcggacttataggggacggacattctcacagattaggttccaaacaacagatacctggatggattcccgacgatacatgaccccgtcttgcaattagaccggacctcacaactaacagtagacagacccctctacagataagacaccggctcctacactcttagaccgatgtctgctatgacataaggacagggtagtggaagataaaaacacataagccacgatgacagacgcgctcgcacaccgcacacgacggcaagaacaaacctgaacgacagcccagagacgaggaagacggaccatgcactacgcacatatgctccaggacaaaaacaggcgtgagaacgaaaagaaaggataacggcaaaactacaagccaaacgtgcgtgagcgccaacctccgattgtacgagaagatgacaaaacgcaaagcacatagagcaatacgccggcaagactaaggagtaaagcgataaccaaaacaaacgaaagaagctagcacgacgcacaagacatggacaggctgtcttttcttcggttgctctctcctaccagaacaaa

SEQ ID NO: 675110 - DNA, 236 bp, Homo sapiens
  misc_feature (19)..(19): n is a, c, g, or t
  misc_feature (31)..(31): n is a, c, g, or t
  misc_feature (36)..(36): n is a, c, g, or t
  misc_feature (39)..(40): n is a, c, g, or t
  misc_feature (207)..(207): n is a, c, g, or t
tccctcttaagacaaatgngactgattcatntaganccnnttgcatttagactgattgcatttagactgattccatttagactagctacttcataaacagccccaccaagaaaagaaaaatcgcgatcccgatataaaccattctaggtctaaatgcaattgcatttagactcccttgggactgtgtctcatgtttgtgtgaatgtngaccaggaaagggggctgcaaaaatgttg

SEQ ID NO: 675111 - DNA, 150 bp, Homo sapiens
gataaagggaaaggcggatgctgggagaatctaagacggcgctacccccaacagcaagaaactattctccaagttctccccttcctctcgcctccaatgagccaatttaggaagttgttgtcactatccactctcccgctacttgcgcat

SEQ ID NO: 675112 - DNA, 475 bp, Homo sapiens
  misc_feature (62)..(62): n is a, c, g, or t
  misc_feature (188)..(188): n is a, c, g, or t
ggaatagcttttaccagccactggactggatagtacaaatctctcgatgtggttcatggcantgattgcatttagactgattccatttagactagctacttcataaacagccccaccaagaaaagaaaaatcgcgatcccgatataaaccattctaggtctaaatgcaatcatgattgcatttagacntcttggaaagaacatttagcaatctgggatgatgggaaatatagcatgattcaacactggtttttttttttttttttttggtacagttaacactatcatatctatgtgtaatattttaagaccagggcacaaacgtgtttatgtgcatcaaccccagttctctttaaaatattgaatctattttattttaattctcttatattcttaatttgggacccatttgtaccccagtcatcctccctaatctacagatcttatttaactcttaccccacacaaatatcaaaa

SEQ ID NO: 675113 - DNA, 409 bp, Homo sapiens
  misc_feature (21)..(21): n is a, c, g, or t
  misc_feature (23)..(25): n is a, c, g, or t
  misc_feature (27)..(27): n is a, c, g, or t
  misc_feature (29)..(30): n is a, c, g, or t
  misc_feature (32)..(32): n is a, c, g, or t
  misc_feature (36)..(36): n is a, c, g, or t
  misc_feature (39)..(39): n is a, c, g, or t
ggatcccccggactgcaggantnnngnannangtcnagnttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcatttgttacttttcatctctttccccaagtgcatcttaaatatttggaacaactgttttgcttccttgagccagactttgcccattcctccccttaaaatacattcatgaaatctttatataatttaacaaaactgaatttacatccgtctttagtaatttcagctattggcagatctctat

SEQ ID NO: 675114 - DNA, 1548 bp, Homo sapiens
  misc_feature (4)..(4): n is a, c, g, or t
  misc_feature (1524)..(1524): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaaaaaaaaaaaaaaaaaaaaaaaaaaaaaaaaaagggggggggggaaaaaaaggatccccgacagggggcccaaagaaaacgacacacaacaagatctgtgtacacagggcgcccaaaagagggagacgacaaaaaacacaagagacaaagagacggacagaaacaaaaacgaggacaggggaaaaaacggcacacttggacgaacatcgggagaaaaaggacacacccaaacacacagggggaggggcaacaaaacatgtgggacacaaaccaccctcaagacagagctatataaaccccacacaaggacacgcatcacacaccgccagaaggtcatcctccgggggtgtaaaccacacgcgcgaaaaagcgacgacagagagaaaaaaatatagagccaaacagcagnacaagaataatgagcacacttttg

SEQ ID NO: 675115 - DNA, 112 bp, Homo sapiens
tgaaacagctgccaccatcactcgcaagagaatccctccatctttgggagggttcatccagaccaggtgagaagttgacaggcagtgatgggggcaacagcaaaataggggg

SEQ ID NO: 675116 - DNA, 1115 bp, Homo sapiens
  misc_feature (4)..(4): n is a, c, g, or t
  misc_feature (1077)..(1077): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagtccttcaataggaaattgtaattaaaatataattttatagaaccatttttatgtaatctgattttattattatcanctataacattcaaatcagatgtcgacgcggccgcgaat

SEQ ID NO: 675117 - DNA, 322 bp, Homo sapiens
cctgtggtagcacaacctagggtcagttttgcatgtggtaagccatttaccaagatagttgtaggtaaagaagggcagatttattgagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 675118 - DNA, 1022 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgactacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaa

SEQ ID NO: 675119 - DNA, 1423 bp, Homo sapiens
  misc_feature (4)..(4): n is a, c, g, or t
  misc_feature (1260)..(1260): n is a, c, g, or t
  misc_feature (1265)..(1265): n is a, c, g, or t
  misc_feature (1267)..(1267): n is a, c, g, or t
  misc_feature (1276)..(1276): n is a, c, g, or t
  misc_feature (1279)..(1279): n is a, c, g, or t
  misc_feature (1300)..(1300): n is a, c, g, or t
  misc_feature (1346)..(1346): n is a, c, g, or t
  misc_feature (1367)..(1367): n is a, c, g, or t
  misc_feature (1381)..(1381): n is a, c, g, or t
  misc_feature (1385)..(1385): n is a, c, g, or t
  misc_feature (1395)..(1395): n is a, c, g, or t
  misc_feature (1397)..(1398): n is a, c, g, or t
  misc_feature (1400)..(1400): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaagatcccttctgcttactatgacattacccagagccacggcggacagtggtgagagtgcagcagactcactggcactggcaggtgctcatgtctcatgcatatgcaaggagcttctgggttctgtctcagggtactcatgccaagacagcctccgagattgaaagttaacaccctgagaaacaaggctcaaccacaaggattcaggaatcagtgaaggaaagcttcaacctcccatcctctaggggacagttctaagaaggatcttntcacntntcagaagtnaangtagaattgaatccccactgnctatagctgctgctgataatgcacctttagggtggcttttccttgncccctgtctcatttgtgctgntccctactgctatntccnttagtaactntnnanataaactgcaatgcgggcagtct

SEQ ID NO: 675120 - DNA, 623 bp, Homo sapiens
ctctcattagaatctagtgcatgccaagctcgtgtactttgtagcatggcggccttgcgaagcctcctcaggtcggggggccggggagccagtgagccgagaggtcctctgtggctccacttatgcatatgcgccaaaaaaaaaaaggtaaaaaaagaggttgtgttttaagagcctggagcccgttatcacaatggatatacgtggcgccccatcgggacggggtagaacggtgatgctgtggggatctcgcggggtcaagtcgtgaaggttggcaaacagtctaaagtggcctttttcaagagtcctgggggctttccaacaatcgaggagatggcgtacaagatggctcgagaagagggtctctacatgcttggctaaaagaggtgggctcggcatgtgcgcgggttcgatcccgcagccaatgggtgggcgggccccatcccgtgggccacgggggcccccagtttccgagatacgtgctccggagagccaactaggcgggcactagaggcctaggtgctggggccactggggtcacattccctgaggctgcaaggcctgcgtgcgggcaggggagccaggcaagcacaggatgcgttgggaaggctgcaacaacattt

SEQ ID NO: 675121 - DNA, 283 bp, Homo sapiens
gcacttttgtcaggtgtcctccatttgcccaatgtaaccgtattttatttctgagacacagtcgtgccctttaacacagtctgtttttcgaggaggaggattcacttaccgccctgaaaaccaaggtcagtctgggctggttgatgggcatttggactgttccttgggttccaagtgatttttctctaacaagttttcaccctttaaatgcctcgaagacccacttaattaggaagacagtttctgtaattgccgtcctcttcacctctggactgtggtgggc

SEQ ID NO: 675122 - DNA, 1097 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaacttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaa

SEQ ID NO: 675123 - DNA, 1073 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaacaactgctacagttcagcacctgttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaa

SEQ ID NO: 675124 - DNA, 283 bp, Homo sapiens
  misc_feature (129)..(129): n is a, c, g, or t
  misc_feature (210)..(210): n is a, c, g, or t
aagcccgggttcaagcaattctccggcctcagcctccggagtagctgggattacaggcgcctgccacggcgcccagctaattttggtatttttagtagagacagggtttcgccatctgggccaggcggntcttgaactcctgaccttgcgatccaccggcctcggcctcccaaagggctgggattacaggcgtgagccaccaggcctggntggattcctactttaagctcacaatccggggtgggagccagcagagacactggcatggcagtaaactgtgcat

SEQ ID NO: 675125 - DNA, 992 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaa

SEQ ID NO: 675126 - DNA, 443 bp, Homo sapiens
cgtcactgtgattcacgacatgctgtgtttctagcactgagatctcacgtctagacccacgatagctgtgcagtcacccaggccaggaaatacctgtgaaggcagaccttacttggtgcacgttgggtcccttagaaagcagagtctgagatgtcaactaagatatatgagggttatgggagtcgggggagttgctcttggaattcacaactgcagaaaggaaagggagtatacaggaatggacacgagggagaaggtgagcaccaatgcaatttctggagcctaagctattcctacagaaaggttcgaagctgagatgacctttagaggtttacccagatggtctaaggggctgggcctttataccccatgtcaatcaggcattacatgtgggccaccccaggatggggtgaggcagctctttatagctagcgtctccgtgg

SEQ ID NO: 675127 - DNA, 211 bp, Homo sapiens
gtcgacttccaactgaatgactgagtcacagcgaggctaagaaacttgcccaaggtcacacagctggcaggtgccagacctggcattcagacctagtagtctggctccagagccacacactgaacgacaatgctgtgttgacgttggccaatgcaagcatgccctttgtgatggagaattgccaggtgcactattaggctcttcgtcgacg

SEQ ID NO: 675128 - DNA, 116 bp, Homo sapiens
ctttgctctagaaacctagtagtctaaattgtgactttctcatttgaacagcaccttttcctactgctacaatgactagtgccatagggtttgcagggtcatgacccaacaggcag

SEQ ID NO: 675129 - DNA, 264 bp, Homo sapiens
accaatacctttggcgccaccagcgtcgcgcaagacgactaccatatggcgcacctggtgtacgagatgaacgtcgagtcggccaagctggccaaagccgcttgcgtcaaatacagcacgccagacaaaccacgcttcgtcgcgggcgcattaggccctacgcctaaaaccgcgtctatttcacccgatgtgagtgatccggctgcacgtaatgtcagctttgatcaactggtgacgtcatacatggagcaaattcgtggcctg

SEQ ID NO: 675130 - DNA, 120 bp, Homo sapiens
ccggtaccgatgattgtgtttcgtcagtcccgagtcccttcatggctttccgcagcgcttggcatctgcgtcaggttgaagtcatggctgggcgcacagttcccttgtcaggggagaaga

SEQ ID NO: 675131 - DNA, 179 bp, Homo sapiens
  misc_feature (60)..(60): n is a, c, g, or t
  misc_feature (91)..(91): n is a, c, g, or t
  misc_feature (140)..(140): n is a, c, g, or t
aggctttcctgaggcctcggcgcttccatcctggacagcaccacttccacatggagctgnaatcaagcaggctgctaattgccttaaaaantctttgtttttttttgagatggagttcactcttgttgcccaggcttgangcagtggcacaatctcggctcaagtgcaacctccgcctc

SEQ ID NO: 675132 - DNA, 203 bp, Homo sapiens
gtggcagcactatagtgtaggtgctatgggggtccatgcgcacatttatcccctgagcgcagcagtgcctgatgccacatacctgcatgagtggcaggcgagtgaagatgtaagcccaaatcctggaccacaacagtgtcctatctacatacctacaaatggctgggcacccctccagcacacggtgcgttgtgcccaacggt

SEQ ID NO: 675133 - DNA, 181 bp, Homo sapiens
ctaccgacagccgacagatgttgcttcccttcatgcttgtggtttgttgtgtcgatcagaattttgggggaaatggaaagttttcctcaaggagcagctgtcgggctagagctcttccaggacaggttcttcacccgtggagccccaggatacctaccactacctgtcgggctagtcgggg

SEQ ID NO: 675134 - DNA, 351 bp, Homo sapiens
acaggatccagacgacttcattcatcccattctgtaccaactgtgtgttttccattctcttcctccatcactttttgttttgttttgttttttgagacacagtctcgctctgttgcccaggctggagtgcagtggcacgatcttggctcactgcagcctccaccttccaggttcaagcgattctcctgcctcagacttcccagcggctgggattacaggtgctagctaccacgcccgctaattctgtatattagtagagcctggggtttcaccatggatggccaggctggtctcaaactcctgacttcaagtcaaccaccggacttagcctcccaaagtactgggattaca

SEQ ID NO: 675135 - DNA, 238 bp, Homo sapiens
  misc_feature (149)..(149): n is a, c, g, or t
tgggcggccgtgggtatacatcatacatttattagtgaatatccctctgaaatcagcaacaatattaaaaaaaataatgatggcactactttggtcaagcagaactagcaacttctcttttaaaaaaaagtacaacatctctgttaaanaattctcaactcagtatacacattattttttaatacaacatactagtttatgttaaagtgctacaaaccaagtgtgaactcccagtgtt

SEQ ID NO: 675136 - DNA, 179 bp, Homo sapiens
cacgagggcgacccttacggctgctgcggcatgaattctttgcacggccttgccggagtacgactcaatccccatcttggtccctgcacagagatccctgggcccagatatggacgcatcaaatccgggactccccccaagtcctgagggcatgaagaagtacagtgacatcttccgga

SEQ ID NO: 675137 - DNA, 966 bp, Homo sapiens
  misc_feature (182)..(182): n is a, c, g, or t
gccaatctcgagtagaatgtagagaaaggtgtcttgtcggtaccagatcagttcatggctgagttgcagccttgctctaggcgaaacggcgagcaaggaaacttcattaccatgagtagatggtgtgattttggagtttggttgacgcgtcggcatgaagtgggattcactcggtgtgctcnttaagcatgttgatgctagagctgtagtgtctggagagttgtgaggaaatgttgagttgttataacaaaatatcgatgatgctgtggacgagagtggcttaaaacctgtagtgattctcagagagcaggaatctcggtagctgcaagaggaccccattccaaggtaagtccgaagtaaaggtcatgaacatagtggatgtatatggagtgactgaagtatgatgatgacccagtgtgggacctgccagggacatccatggagtcgaacgagtctgatgatgtcgatgacgtgatgattgtcaccagtcctgatgagtctcaccattcgtgagtgaatctgatgaactggtcagtgattgtcccaaggtaagtgccagcaatgcgacagttttaactcgagttgtccccagagtagaatacatatgatggccggacggtgataagtgtgttattaatgggactggacggtccaacattctaaagaaagttttcgcaagaccttgaatttcaggtacccttgatgcttacacagactgaggaacattcaccctccaccacattgggaaaaggcgaggacgttggaatgggtgcttaaaaggggcatctccgttggcaaggacctgggagggggcttttgatgtggactacacgtggcaagggacgttttgaaccgagtcagcgggatcaccaagagtggtgtgacccagagcatagaagcagtttctaggcgggcagctttgagaatacactcaggttggaaaaatacaaggggaacagatttacg

SEQ ID NO: 675138 - DNA, 264 bp, Homo sapiens
ttttttttgggggccccccccccccccggggggagggggccccaaattttgggggggtttttttcccccggggttttttttttttctcctgggttcccccccccccccccaaaagggggggggggggcccccccccttgtttgggggggggggggccccccccggggggggggtgggggcccccccccccccccggggccccccccttttttttttgttgtttcccctttttttaatccttttttagggccccccccgggggga

SEQ ID NO: 675139 - DNA, 1094 bp, Homo sapiens
cttgcagtctgaaagacaaagggaacacatgacatcaaagtgcaggattcccctgtggccctctcccttaccctgggtaaggcctcttggagaccttaccccttgctgtttggactttgtatactttaaataatttaactacccttaacttacttaataaaacaaaaacaacaatgcttgtatcgacttctcgataacctaatttggcggagtacgcagtgggacttcgttactccccaggacccgtgtactcgtatcatcctgagtcgtaccacagactacgcgcgctgcgccaagggaacaacacaaacttcaagacacccacttttctacgccaacaaaaaaaacaaaacaaaaaacaacaaacaacaaacacaaaaatacattaaacacaacaaacaaataaaatacaatacacaccaaagacacaacacgacacacaacacaacacaagacacactccaccacacaaaaacaaacacaataccaacactcatacacactccgcgccacgcggcccctactatccctaacactacacccatacttattaaactcgtatgaatcacctctagcataaatgacaataacttatactaataattcactctcaactatacgccactaatactactaaacaaaaaaaaaaacttacactataaacatcatacactaacatcacatatcattaaacctacttacctctacactaccctacaaatcaaaataccaataacgcctgttatccaaattacatataaacaaaagatgacctcacactgtacaacgtgcccacttatacgaaatcctattcaaaaaaactacaaaatcatacacagcattacaacgacacatccgtcatcgaatctactcatcactctaccattagaaattttcacatccatctaactatattactcgaactgtagcactagtacagtccagcttctaatatcaacacaataatactcttaccgccgcacacacccaacgtattctatgtatttactaactagtgtattatggctgtatcatttactcagatttctatagtttgctagtatgcatctcgtaatctatatcattacacacat

SEQ ID NO: 675140 - DNA, 423 bp, Homo sapiens
aaaaaaaaaaatggccgccgtgacctattcaccctccacttcccgtctcagaaatctaaactgtggtcaccttctgagtagagatggccctgccctgcccacctgtgggcagtgccaccctgcagatgacactgcgctctccaccacccaacccaaaccatgagaatttgcaacagtgggagtgaaaaaagaaccaaaacttccaatggccctgctttaattctcttaaaagtactttaaaaatggacatttgtagagtattttttatttacatttcatatttttggtacatcattggtagggtcagccatttaataatgatctcggatgaccaaaccagccttcggagcgtactcatgtcctacttctgactttacttgtggtgtgaccatgtcattataatctcaaaggagaacaaaaacc

SEQ ID NO: 675141 - DNA, 239 bp, Homo sapiens
atgctttgttatgaggcctctcaggctctgaccgacgccacgtgccgcctcttcgcacctgcgggccgatcatggagctcctcatgtactcccatgacaacatcacctgtggcatcacctctgttgccttctcgcgcagcgcacggctgctgctcgctggctaccacgacttctactgctacatctgggatgccatgaagggcgaccgcgcaggagtcctcgctggccaccacaaccgc

SEQ ID NO: 675142 - DNA, 327 bp, Homo sapiens
  misc_feature (122)..(122): n is a, c, g, or t
ccaaattcctccttccttcccaaatgcccagccccccaccctcctcctggtcctcccaccctgcccctttggttactcctcctagtgtccttcaggtaggtcttgtatttttgtcccacagnttacacatgttatcaatgggaggactgggccccacagtagctactcagttattaattgttgtagctggacatggtggtgtgcacctacagtcccagctacttaggaggttgaggtgggaggactgcttgagcccaggaatcctaggctgcagtgagctaggagtgcaccactgcactccagccagggcaacagactctgtccctt

SEQ ID NO: 675143 - DNA, 522 bp, Homo sapiens
ctgatgtctcaccctgcttaggtgtgcgcctacagctcccgcggtgcggggtctgctgctgctgctggcgcagtgtggcgacgggcgtgtgcacacctgctcgtgggctacgatggcctgactgcgccgcagctgctgcgccctgctacaggcctggcaaggcctggcaccatggtctggaccgtctgcgtcctgctgtccttccccttcatcttcagcccctgcctgggctgtgtgggctgcgtcacgcccgaagtgtggctgccctcctctactacgtgcccgttcatcgtgatcttccagttttggcttgtgcctccacaacagatctcccacctcagcctcatccctggagctcgtcaccaatgaccatgagaaggtggagctcacgtgactcaggtatgctgtcaccgtggtggccaacatcaccgtctacggcgcctgctggctcctgctgcacctgcacgggctcgtcgcgggtggagcccaccaagacatcagcatcagcgaccagctgcgggg

SEQ ID NO: 675144 - DNA, 139 bp, Homo sapiens
gcacccgtggctctgctcaagctatgcaagagcgggccctccagaggtcacgttccccctccaccaggcacgtagggacagcctggcctggagcgtggctagtactgcctgggggaccctgcggctattttccatgccg

SEQ ID NO: 675145 - DNA, 374 bp, Homo sapiens
cttgtagtatattgagttgagtcttgaatctgggagtctaggaaatcacggtatcttctacaaataatgataggtttatctcactcttttccagacatttgctccccttattttatggcttaccactcaggaccttacagaccagtagtgaatacagagcattagatactgtgcaccctatgtccagtcctgcgcttcgaggcggctgcatatgacaactgaaaaccaacgcagcgcatgttaactagaagactgggagactttttaaacaacagaagattcattgaagaacagttaaccaataagaaagcagttactggcgagaacaacttcacagacaccatgaggcacatgttatcgtcccggctgagcat

SEQ ID NO: 675146 - DNA, 296 bp, Homo sapiens
caaatctatgggaaacttttttttaaaatgaaaaaatttaaaaaatttttttaaagcccagaatattataaatatagtattcaggattttcataataaaaaaaaagtaattcaaatcaaacagggtttttggttggaacaacaaaatcgactttttctatttacaggggtaaaaatgccctttaaatcaaaggggtggaaaaaaaggaaaaaaatggggaaatgaaaaaaaagcatcttttgtgggggattttttttaaaaaaatttttagccaaaaaaaatttgtttgtttttca

SEQ ID NO: 675147 - DNA, 410 bp, Homo sapiens
gaggtgcgacagaccaagagtgccatttacttccaacgtggtgtcacggagcgcactggtgcattgccatggcctcacaggtgtcggcgcccttccagctcctcccagtttcttggctgggtcttctgaggcctacgtggaatgaactacacatttggcctcatgcccgagggtttgtaagatggcctctgattctctggtattcaacttgactttttatgccccacgagtgtctttctggaaacaggcttagcttttgtgctggggtgcgacctgccctatgggcccaagggaggggccagatgggggtcaggccctaagggtgtccagggtctgagctctttggctccgacctggttctgccccagaaggaacagggtgttggtagcagggtcctctcccgggagctg

SEQ ID NO: 675148 - DNA, 245 bp, Homo sapiens
caagcagcagatgaagaggaggaattgtctactgccacaaaggatactacacactcatggtgataaacaagacatagtcaagcagaaagcgttttgtggagccgtattttaaaggtgatgaaagagagactagcttgcaaaatttttctcatattgaggtggttcggataatagaggagagaagaaaactgcttgggcacacgtgtaaggatgtgaatttattatgcagatatgccagcagaaga

SEQ ID NO: 675149 - DNA, 317 bp, Homo sapiens
acagtcgcaccaccccatcatactctttcagccacagcaccaattcactagctccatcgctaggctccactagaacagtcaccaagacctgtaacgctgagcccggattgcgtcaggatattcctcaatagttcatcgtctcttttctctgtgaaaacaaccatcattccccctaaataaattaaaaaaactattaaacccatataacctcccccaaaattcagaataataacacacccgaccacaccgcttacaatcaatactaaacccccataaataggagaaggcttagaagaaaaccccacaaaccccgtcac

SEQ ID NO: 675150 - DNA, 278 bp, Homo sapiens
cgtggcgtgcagacaaccaggggctgcagctgaccagcactcaggataaggtggcatcagtaataaacatccaccccaatacaactcactccacaggcagctgccgaccacacactgctcaactacaacacaatagcagcaccattaagtatctagactttgtctttgctgtgaaaacatgaaaaccgattttatctgaaggaagtgaacatcagcatgtatttggttcatggctccgtaatcagcatagcacataacaatctcagctactggaatag

SEQ ID NO: 675151 - DNA, 916 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgcatttagactagctacttcataaacagccccaccaagaaaagaaaaatcgcgatcccgatataaaccattctaggtctaaatgcaatcagtctaaatgcaatcaatttatgtctgcggtctaaatgcaatcagt

SEQ ID NO: 675152 - DNA, 1071 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgcaatcaggattgcatttagaccctccagaaggggctcggcccggggtccgacaggccgacacccatagggtagatggcctgtcatgctctgaatcttgagggatcacctgatagcaccagaggagcggggtatattactactgaaaaaggttttggtagctgaaaatgaaaatatagagaaggaaactacatggccagattttggctgagattaaagcggaatgaaatttgattggtggttgtgtagtaggtaagtaatgagaggtatagatgattaaggtgtgagata

SEQ ID NO: 675153 - DNA, 1152 bp, Homo sapiens
agcgggtaccaacgtcctcaggggctcctggtcagtgaaccaacttactagtttcggttatactgcaaagaccagaaatcaaagaaacgtagaagactaatatgaagaagacatcatggtcatctgcttatctgagtactaccagatcctggatcccctcttgcttctgttaccctaccatgcacacggaaattggccgatctccttgtccctgtcatagtcgcttgggagacagagactgggatgcgtatatactggcactactactgagggagagagtgcgcgcatttagatagctatgtgccctctcatgaatgcgatgcgggaggatacaaggaggaattgcgcggggatttgtgtgcaaggcaagggtaagtgtgttgacttcatagagaaatggagtttgatagaatactatggcgcaagtcggtaactgggtaagtaaaggactatatttgcaaaggccatggactcgaaataatagatccattggtttaaatgatttttgctcggtacagtctgcttggggaaactggacagaattcacctacttttttcgtctgggaaatgaccattaggtaacaatcaatgagggggtttttagaggtagactcttaccttgggttgtatacacccaaattttgcttcggaccactagacgtacttaattaattctatatccaagaacgtaatcgagctatatctccattaatttataggtacgccataagtgacgtcacggcaatggaacgaatatcccgatacatgctttggcatatgttaaccagggggaataaggacatatgtataaacaagttggggtctgtcaacagtaaatggataacacttttgccaatgaaaaacggctaggtcttctggaatcttcaacaccgcgccatggtggatattgccgttaggattcgcggattatgtccctccgtgaaagcgtgaacaccacacatttatggatgagagagccgttgtgtcacattgaacactgttggggaccggaacagcacatacaaactggggcgcaaagcgaatagagttaaggccaagtcttcggttgacaaatttctaagtggtccaaaagtggtattctttacaccctttggggaaaccaatcacaacaaacggtggccgaaacacgcc

SEQ ID NO: 675154 - DNA, 185 bp, Homo sapiens
ggcaagtccagttgtgttgtgtgcacagcagcagcaccacactttcagatcttctctcatcacatctcatgtcagttgtcacagttcagactcaacagcactccgttctgcagcttttcatcagcacaattcacaagcacaccagcgccacccacagcacaaacacttaacatcattgtcatcac

SEQ ID NO: 675155 - DNA, 857 bp, Homo sapiens
atctgggtgtctatagaactgggaattccaggtaggaaaacgtttgttttgtatacagcttgtgcaggaatacggcctgatatgatgcctgctcagtgtgtatagatgtgggaactgataatatcgcactcgttcagtcgacccagttttacaatgggcttgatatctaggaagacgagagtctgcacgagccaacaggtagtgagtagacgctgattgcatcgagttgtactgaaaagcctattactagacagcatagtggcctggaacacgacgtcgatgcagttctgaagagcattggaagatctagtaagtgcagttccaggttgcctatgatgaaagtactcgcgaaaaatatagttactattcaatgaggtgatattcaagggacagcgtgcagtagctctagcgaggtacttattatgcagcacaaaaagttattgagtaaaccaatcatcacgaacacaaaagtcttattccttggagcaggagaggctgcatcttggaattgctaatctaatagttatgtctatggtagaaaatggcctgtcaaaacacagaggtcaaaagacaatctggatgtattgacagagtattggtttaattagttagaggggaagagagaatgcaagagatagataagtttatacaggactccaatttactctccactcaaggcccagaggagcatacctgatactttggaaggatggcggtgactatagtggaagccttcaagtatatgtggaagtgtgaggtgaaggcagtgtttaacagtcgtgatgtaaaaagagcatggttataaatagaaagcgaaaattggttagtaaataggaaaggaatgaggtggaagtaaa

SEQ ID NO: 675156 - DNA, 1218 bp, Homo sapiens
  misc_feature (4)..(4): n is a, c, g, or t
ggangcatttccggttcccttcgtttaggtcggctggaaattatgtcctccgtcggttttccgcagtttttccaccaagcgagatattttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccaggtgagctcggactcttatggcttgatggggttcattatactggcagaaggagagcgttggttccggcagattaagtagtgaagctggggcggcagggaagccgagaccctcggccaagaggcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaacttttatgtgccgaatcactgtggggaaaggtcaggaaggtgtagtccttcaataggaaattgtaattaaaatataattttatagaaccatttttatgtaatctgatttgaatgttatagttgataataataaaatcacttacttggttgactaaaaaaa

SEQ ID NO: 675157 - DNA, 199 bp, Homo sapiens
  misc_feature (106)..(106): n is a, c, g, or t
catccggccagcacacaagtgtctttttgctccatcgacggctgtctgtcctcactggctcccacccactgccctgctcagtgtctgggggggatgaccacaacancccccgacctactgtctttctgcttctcccatccattcgccatggcaatcagagggattttttgcagataaaaacctggcctcgttggcctca

SEQ ID NO: 675158 - DNA, 220 bp, Homo sapiens
attgtgcccctgtgatgccgacgctgatgctggagaccttttgatttggcccgtccagcccctcgttcgttctggcagtccttgaccaccaaaagccaagtgctcctcaacgaccacgaactggatagaaagaggaacagtaaaaccagtttggcatgaacctcttccttacgggataagagccttcatgcattacttctctagagctcattttctgcgc

SEQ ID NO: 675159 - DNA, 207 bp, Homo sapiens
  misc_feature (19)..(19): n is a, c, g, or t
  misc_feature (31)..(31): n is a, c, g, or t
  misc_feature (36)..(36): n is a, c, g, or t
  misc_feature (39)..(40): n is a, c, g, or t
tccctcttaagacaaatgngactgattcatntaganccnnttgcatttagactgattgcatttagactgattccatttagactagctacttcataaacagccccaccaagaaaagaaaaatcgcgatcccgatataaaccattctaggtctaaatgcaatcagtctaaatgcaatcaatttatgtctgcggtctaaatgcaatcagt

SEQ ID NO: 675160 - DNA, 465 bp, Homo sapiens
  misc_feature (19)..(19): n is a, c, g, or t
  misc_feature (31)..(31): n is a, c, g, or t
  misc_feature (36)..(36): n is a, c, g, or t
  misc_feature (39)..(40): n is a, c, g, or t
  misc_feature (178)..(178): n is a, c, g, or t
tccctcttaagacaaatgngactgattcatntaganccnnttgcatttagactgattgcatttagactgattccatttagactagctacttcataaacagccccaccaagaaaagaaaaatcgcgatcccgatataaaccattctaggtctaaatgcaatcatgattgcatttagacntcttggaaagaacatttagcaatctgggatgatgggaaatatagcatgattcaacactggtttttttttttttttttttggtacagttaacactatcatatctatgtgtaatattttaagaccagggcacaaacgtgtttatgtgcatcaaccccagttctctttaaaatattgaatctattttattttaattctcttatattcttaatttgggacccatttgtaccccagtcatcctccctaatctacagatcttatttaactcttaccccacacaaatatcaaaa

SEQ ID NO: 675161 - DNA, 268 bp, Homo sapiens
gaatgcaacgagatatctgtatttgaatgtatagaccgtggtatatattccaatacatattttttaaaaaagtgtatgatttgacatatgaatcctcagtttctgaaattcattacatatctgtcgcatgctgccatttagactagctacttcataaacagccccaccaagaaaagaaaaatcgcgatcccgatataaaccattctaggtctaaatgcaatcagtctaaatgcaatcaatttatgtctgcggtctaaatgcaatcagt

SEQ ID NO: 675162 - DNA, 421 bp, Homo sapiens
  misc_feature (251)..(251): n is a, c, g, or t
  misc_feature (415)..(415): n is a, c, g, or t
gggctcggcgtggggtgtggtggctcacgcctgtaatcctaacactttggggaggccaaggcaggtggatcacttgaggtcaggagttcgagaccagccttgccacatggtgaaaccctgtctctatgaaaaatacaaaaaatagctgggcatcgtgggcaggtgcctgtaatcccagctacgtgggagaccgaggcaggagaatctcttgaacccaggaggtggaggttgcagtgtgtcgagatcgcccngggacttctagcagcaacagagacagactccatcttcaaacaaaaaaaaaggaggctcacccttagaaaggcttcttacaatttaacaccacaaagtggaccacaggcacacagattttgggtaatgtggggttttcctttatttaacgttgttttcaccagcntttttt

SEQ ID NO: 675163 - DNA, 249 bp, Homo sapiens
  misc_feature (37)..(37): n is a, c, g, or t
aatcgctgatctcgacctagaccattctacgatctanatttcaatcaggggatccgtctgatgtcgatctgaagcgtctgctcgtcgtggtactgacatttgtgtcaaatgctgccatttagactagctacttcataaacagccccaccaagaaaagaaaaatcgcgatcccgatataaaccattctaggtctaaatgcaatcagtctaaatgcaatcaatttatgtctgcggtctaaatgcaatcagt

SEQ ID NO: 675164 - DNA, 186 bp, Homo sapiens
  misc_feature (19)..(19): n is a, c, g, or t
  misc_feature (31)..(31): n is a, c, g, or t
  misc_feature (36)..(36): n is a, c, g, or t
  misc_feature (39)..(40): n is a, c, g, or t
tccctcttaagacaaatgngactgattcatntaganccnnttgcatttagaccatttagactagctacttcataaacagccccaccaagaaaagaaaaatcgcgatcccgatataaaccattctaggtctaaatgcaatcagtctaaatgcaatcaatttatgtctgcggtctaaatgcaatcagt

SEQ ID NO: 675165 - DNA, 260 bp, Homo sapiens
ctagaggatccccccaggttaacagctccatatcgacaatagggtttacgaactcgatgttggatcaggacacccattatggtgcgccgtgatattaaaatggttcgtttgtacaacgattcatagtcctacgtgatactgagttcagaccggagcaatgtccaggtcggtatctatcgtattataaatttcctcccagtacgaaagtgacaaaagaaattgggaccaaccctcacaacacgcgatctcagacgataagt

SEQ ID NO: 675166 - DNA, 154 bp, Homo sapiens
agagttcgaagccagcttgggcaacataaggagaccccatttctagaaaaaaaatacaaaaagttagccaggcatggtgatgcgagcctgtaatcccagcctctcaggagactgaggcgagaggatcgcttttgcccaggagatggaggctgca

SEQ ID NO: 675167 - DNA, 193 bp, Homo sapiens
atgtatctctccttattatgactgagttattctatacttactataatgtgagcaagggtcagtccatgtgccacaatttcctttcttatcaaagtgagctgagatcacgccagtgcattcaagcctaggtgacagagtgagactccatctcaaaaaaaaaattatagttatccttgtaggtatgatgtggcac

SEQ ID NO: 675168 - DNA, 538 bp, Homo sapiens
ggagactggaactcttgttgctggaaaagcaagtgggcggagatactaggctggaattacaacgctttgattcccagagttaaagagactcggccctttaaagacaatttgtggccattaacctaccattttggggaaacaatcagttcagtacttatggacaatatcatcctttgtgacagatatacttgcgtaagaaaaaataaatgtatcctttaaaacatgatggacgaatccaattaacacctataacaaagtcatcatatttgtttcagcacagaaggacagctggataataggaaaagaatcgtatgcctgtatgcttttgctcctagaacagcacagtgttttattctgtcaccctactccaataactatgttcagtctgggaagaaataaagctgtttagcctttgtgctggagccggcaagctggagaaaacgagccaaccttatgagagactgatgtccagaaagtggtcctcacaaaccaggggttaaagactcaggctgagaacaatgaacacgagaccccctag

SEQ ID NO: 675169 - DNA, 955 bp, Homo sapiens
tgggacacataggaaacaggatcctatgaaaagagaaaaaaaagagaaacagagcccaatggtgggcgagtaggcgcaaacgcacgagaatgaggggcgcacccaggatggtactctggcacccaccgctgagggggcacacgcgtggacatggcgccagacgcgggggcctcccctattaggtgcgaggcgctgccagacgtgaaatgaaacacaacagaaggcccgacggtgtgcaatggtgtgtacacacccaaagacacacggcggggggtgccagaaaactacctactatgcctcccaggtgcgataacgggcctcggcgcctatctttacatggtgctctatgatctacacgcgaggcacgagagaaagaggcccaccctaagacagaggacccggggggaacatcgcgggtgacacgacctgaccatagcggaaacccacaaaagagtccggcgcgacactacaacttctcgcgacgcggccctatagcgggaacaagcccacaaactatagcgcgtcaccgacagaccacgctgcgacgcgccaccacgggaccccacagcacagttcaacggcgattatccacagaggtatgcggcgctgagaacacacaacgactatggagcataaaccacacgtgagaaacaggggacgaacgcacaatgtgggtgccacaacgagagagacaccgcggggagatcaccatgggccactacttgcgacccgagacgagcccacataacgcagtggacaaccatagtaccctgggccaccacaccacgttagggatgcacccaaaatgaatgactgacgaaagcagcatgcggaaaacgagagacacaccaacataccccatgcgaacagtgcaggaacaaacagctcaccagggatgaagtaaagacaacaaatccccgcgaaagacgatcacgggagcgtgccaacacaaaca

SEQ ID NO: 675170 - DNA, 189 bp, Homo sapiens
ccgagcatacgtgtgagctccgcctcccgtcagagcattaccgtgtgcgctccgcctcccggcgagagcattactgtgctgagctccgcctcccgtcatggctttacctgtgtgagctccgcttcccgtcacggcttttccttttttgctctgcctctcgccactgccttaccgtgtcagctcgctggc

SEQ ID NO: 675171 - DNA, 784 bp, Homo sapiens
tcactcaacattgccacttttgacgcaactctataatgcccagccaaatttccccgtagacccaccgccaaactgttgactcccaaccaatagaatccaaacaccgccgttgatatcttccaccttgccacccctcacgcattacaggtgattacaaccccacccatggttactattatcgagagatgtatgtccaaagaatatctattttggatcttacaccacaccctgttgagatatccaaaacaaatataatatatcgtagtaacatacgctgtccattccacaccactatgccacccacaccccgttagggttatttttcgcaacaaatacttgtgcttacacatacataatgagtaaaatgtacccaccactcacatatgtactacccctcgtcatacccacccgcttgccgagtgtatataacacttgcttggtccttctcttctaattcgatagaatctttctttcgcagactatctatgcatgaccagtagaagatatacatagtatcttctaacacccatcattcggcgaacaatggcgctaatgaccgctattaccgaggatgatctctttctcccccgctccacgtaatttactggcgctcggtccactcatgttccactcgtttgtcattacacgcctatactcttctcgcttcaacaggtgacagaaaaaactcacgctgaggtcgcccccactgctttggtgtttatcagaccaataccccccattaaataaaattctctctgcgccacatcacaacccgcccataaaa

SEQ ID NO: 675172 - DNA, 129 bp, Homo sapiens
tcatttactagctgaaactctagacaatattatcattttctatcttgtttctatcttccaatttatctactaagtttgtacattttgcccttagctttttagtttcctcagcttgagtattgtatcaag

SEQ ID NO: 675173 - DNA, 505 bp, Homo sapiens
  misc_feature (27)..(29): n is a, c, g, or t
  misc_feature (31)..(31): n is a, c, g, or t
  misc_feature (34)..(34): n is a, c, g, or t
  misc_feature (53)..(55): n is a, c, g, or t
  misc_feature (62)..(62): n is a, c, g, or t
  misc_feature (77)..(77): n is a, c, g, or t
tccgccattaatgcccggagcaacaannnanaanttagtgtatcatttttagnnnaagaaanagaataagggggaanggggggagatttatagaaaactctttcacaccatataactttaaccgtccgcctagaattgccaacaaaaaccaacaaaccgcttcaatccaccagtatcataaaaccaaaaccgaaaaaaaatcaaatcttcaacacacataaaactctaccaacctcacccaaacaaaggtccccataaccaaacaacgcccaaaactttcattgaaacagattataaacacaaacatttaagaatttttaacgataacaaaaattaccccctgattaatcaaccggactccaaacaaaaaacaactaccaactcaatctccaacctcccgaacttaaaacatacaaaacacttcctcaatggcaacaaaaattctctaaccaaaccctccaacccaaaaacttagaaacccaacaaatcgatcccgcaacttatc

SEQ ID NO: 675174 - DNA, 970 bp, Homo sapiens
  misc_feature (184)..(184): n is a, c, g, or t
  misc_feature (565)..(565): n is a, c, g, or t
agcggccatggggagcgagccggtgcttgctgcagtgctgagggctgcggcaacgcggtgacgcgcgcgcggtgaggacggacagtcaccgacttactccagcttccctgttatctcgacacacaatcgttgccgtcacggctcctggacacggtctccaagtcaagttgtcatccttcttcgngtgtactagtgttgtcctcattcgtgacttttagtcactcgtgacccatcagacttggactagactccatgcatgagagatagctgagacctaatttgcaagtgatccagggacttccttcaattcctactcactgtcgcctgcttctcatttcaccattgtacacgcagatcaggttagagaattccactatccgtctagcaaagtctaggatagatagatcgctatgtttagcgacaaactcgacttgaatgagattgaataacgtaaaaatactcgcacaagaaaaagttacgtttccaaggatagattcttccaaacgatagggcattttgggaattggagcgactaaatttgtcgctccaaagaaggatttgcttntgtaacaagcaggcgacaatgggaaatactttaggaaaattttcgggggattactgtggtgattaaaggattccattgtaaaggtgttggaaaaagtcataggttgcacataggaagtcgttattttgaaaagattgcaacatttgaaagttaaaagaattaccaacgataagtttggccaccttatagggttgtaggggagtccttgtggtacacgaccttttaagtttggcccttgttaacacatgacaattctattttaacttaagcgtgtaaattccaattggggggctccaattttctttgtccaaattacatttcccccaaggaaaacgtacaacgggcgaacactggcaccattccaaccgcttgtcaatcttgtctggggccaagggtttattccaa

SEQ ID NO: 675175 - DNA, 126 bp, Homo sapiens
tcctaagaaaggtaataagaagccttaaatgtgataacaccagcactctttttttgttttttaatgtgacaagacagaagaaacaaatattcttttgtttttttgaaacggagtttcactctgtcg

SEQ ID NO: 675176 - DNA, 1057 bp, Homo sapiens
cgggcaagtctagctcgcgtgctgtcggatacttggggtgagcggaaagcatggcggggacctccgcgccaggcagcaatgaggctgtatgctgagccccctggcgcctcgccccgagccgcctgccgggcacctgggcaccaccccgatgcaagcgggccctggggcttactccgctagcctgctgcccctggacccgtgacgacccgtatcggacgcgcactggggacttcacttgccgacgagcatggaggcagcttgagacccatcgcgtcaacaggcccatgagccaaatgtccaggccgcggctcgtggacgtgtccagtgatcatcaggtccaccagattattcagatggccatgtcacacaaaatccttcagggcaacaaacagagaaactgttccaattcaaagataatttcgaattagaggtccttcaggcacaatacaaagaacttcaagaaaagatgacagtaatggaagaagaagttctcattaagaatggagaaattaaaattttgcgagactcactaatcagcacggaatccgtcgtagaggaacagagaagatcacatgtactgctgagcaagagaaaacccaagccactcagtgacaaaggacaaggcactctccaaaagctccaatcatgcagtctgcactccagttttaaagatgcagagatgaatgacttacgggacaaagctcagaacagatgaacgaggcaaataaactggctgacacctctgttccccatgtcaagcctaggaacaacccttactggggtgatacaggcagaggatgtcatacaagcgtggaaaacattagtactacaaagagattcaaagcaacatgtctcttccacctgtcagccggggcgctacagcccggcggaccagagaacaagcacaaccaaggcgagcccacaacacagcgctcacacacagtgacgcggcagagcacccacgcgactagagacaaaaacgagacaaacacaaagacacaacagagcagcccaacccggacaaaaagacacaacgccaccaacagcacgagcacca

SEQ ID NO: 675177 - DNA, 307 bp, Homo sapiens
  misc_feature (216)..(216): n is a, c, g, or t
agcggggaggaagaggaggaggaggaggcggcggccgggagccgggggagaggggcggggggtgggccgggggaggggaggagcgggatttgcggagcgccgcgccgctgccgggagccggcaggcccgagagtgaccggagtcacggcgggcgccggcggagctgcggcgtcggacccgcctcctggaggagctcagccccgaccaggcccggcnccattcccgccccgtgcggtcgtagagtaggggtgacgtatatttatctcatctgacgtaggaaatgtacagcaatgataaaaaaagtgaa

SEQ ID NO: 675178 - DNA, 130 bp, Homo sapiens
ttttaaataccatcttgaatgcctaataattaaactggatgaaagtggcatatcattgttcctaacatttatggaacccccataaagatgtttcctgatcctttaaaactcattaatctgagtattaagt

SEQ ID NO: 675179 - DNA, 170 bp, Homo sapiens
gagagagcgactgagccctttggaggtataatttagggttttgcctcctgtccacagatcgtgcatttgcatagttcagactaggagccaaatgaggactcaaaccagctagttattattccagactggattgtacctcagcatttagggcagattccagacctcaaagt

SEQ ID NO: 675180 - DNA, 338 bp, Homo sapiens
atgacatagatgaaaagcttattgtaggccgcacgaggtggctcatgcctgtaagcccatcgcttcaggaggccatggtgcacggatcactacaaggctggaggccaagaccagtctgaccaacctggacaatcccagtgcatactaaaaatacataaggagccatgcagagctaggccatgctatgtagtccacacatacatggaaggctgcagctgagaataggaagatacatagggcggatgacgtgtagagccacgatcaaaccaccttcagtccgggcctctagagcacagctgagtcttattagctctaggttattttagcctttagaccgc

SEQ ID NO: 675181 - DNA, 455 bp, Homo sapiens
tcagagacaaagagcagttactcatctttgcaggtgttcaccaggcaagttgtcattgatcaattcaatggattttaaaccaactgaaaggatttaaaaccagttctggtggttctcttgttaccatggttacataacaattagtcttttcctaggagtatggaaatttttttttattcccttagtgttattagcttgatcctctattctgtttttggttaaactgttttagcaagattatttcacagctaataccgtgtggtccctattacatcaggaggcttacaatacctggttgcccccactttaagtgatgggctccagtggttgcagctgattcctccgttgtaaagttccctggcatgcttttaactaatggttctatccattaataatcattacttgaaacagttattttataaggaattcaaaagtgatgaattgcttttctttta

SEQ ID NO: 675182 - DNA, 110 bp, Homo sapiens
tgtgtcgagatgatatcattagtgggggaaggcgcttgtgaagtaggccttatatctcttgtcctttcgtgacgggaggactttgaagtacgatagaaaccgagctggca

SEQ ID NO: 675183 - DNA, 211 bp, Homo sapiens
cagagctgagagatggcgatgacatgcctacagcacagctgatgagagagaagacatcttgatgctatctgacacgcatgacgagaaaagcttttctatgaagatgatggagcaaaagagatagaaggggcctagactccctaccttcacacttcctgctataaaagcatcgctattatgaggttaatctgcagaaacagaccctatgccg

SEQ ID NO: 675184 - DNA, 119 bp, Homo sapiens
gtcttccactgtgctcatgaggtcaggatacttccactgtgcttcatgaggtcaggctaccgtccactgtgcttcatgaggtcagggtaccttccactgtgcttcatgaggtcagggta

SEQ ID NO: 675185 - DNA, 503 bp, Homo sapiens
ataatgacagttgctgagacagatataagggtaggagagacacaattctctctgccactactggggtgtgtaccctgaatgaggaatcgagaattgggcattatgcatgccctctgccgagtggtctgagggcaggcatcacagctagcgcacacacgtacctgtgcggtgtatcccagaaggtaaattctacttcctttaaatgttattactttaatttctggtactttaacaagttaaatttagtatcttaaatctgataggttggctgcagtagggtcacgcctatgatcccaacagtttggaaggccgaggtgagtgtatcacctgaggtcaggagttcaagaccagcctgaccaacatagtgaaatctcgtctctactaaaaaaaaattacaaaattagccgggcgtgatggtgcatgcctgtaatcccagctacttgacaggctgaggcacgagaatcgcttgaacccaggagacaaaggttgcagtgagttgagat

SEQ ID NO: 675186 - DNA, 247 bp, Homo sapiens
ggtcgacggcagatcacggtcgaatgacatgacccgcccactggcctggttactgttgtgcatcgttcctctgctggcgacggcagaggaagcgcccttgcgctggcctggaaaaccgccgacggttatgagctggtgcagttgaacaccacccaggtgctcaaccgcgagccgttgccggcggatctgcaaacgccgctgggaagcctgtggaaactcttcgtctatgcctggttggtggacacca

SEQ ID NO: 675187 - DNA, 134 bp, Homo sapiens
acagatccccggactgggccggagcggaacgctttttattacagctcatgttctttgtgagacgttggagaaagaactttccaaagtgagggaatatgtccaattaattagggtgtttgaaaagaacctgtgaa

SEQ ID NO: 675188 - DNA, 1183 bp, Homo sapiens
acaacaccagggatggtctcaacaaatatgacttctaccagccttaaagtctacacccaaaagcaacaagtgtttcacagaacacatctcagatatcaaccatccacaatgaccgtcaacccacaatcagttccagtagcacatctgcatgcttccatcagtcaacaatccaccaacaactcatgcaattctgcaagccaacagcaacaggatcgacaacatattgcatcactgggcagcttatgttaggtaggtcattgtcattaacagctggagagtaatatcatattcttatacattggatgcaaaaatgtattactcaagaagaggcattcggtatagaaccatagatgaacatgatgccatcatataaggaaatccatggaccaacggaatggcacataaccgcatgcatgcgtgccctatcaatataattaacaggatttattaatagctccaaccacaaatatactcattattgaaaatagatataaaaaggccatgcattataatgatccagagtatcaacagtacatatgtaaaagatacatacaaggtacaccaggagataggcactcagacactcacacatccggcactctctcatcaaaccgcacatccacatggtaacagcccaataacaatacatacggccccacaaaaggacctaatcataacacaaacagccacagacaaagacacagacacaggagccaaatacagaccaagacacaaggacaacaagcacaatcacacacgaacgaccaaacacagacaacacgaagacacacataagacagaaggcacaaaacacaacacaacagggcacaacagcacagaaaccaccaacacaaaaccacccagacggtacaccaacgcaggaatcaacacgacacatacaaagagacaaagcaataacacgagacaaacaaccatacaccagatacgaaaaagaacaaaacagaaaacagaggcaaaaaaggaagagagaaagcacaacagtcagaaaaacgaaaaagaacaagcaaaaaaaaaaccagacaaaagacagacaaacaagaaggagaagagagacaacgaagcggggcgagagcaggcgacagacaagcaacaggaaacagagaaacaggaagaaaaaaaccgaaaccaggcatcgaagcaaccaaaacactgcgaagaaaaa

SEQ ID NO: 675189 - DNA, 198 bp, Homo sapiens
agtgatcgctgtagcaatctcgcagatctcctcccgacacagagctgctcttattaggaggcccaagagcgatggcattgcccatttccatcaggctctggaacacgtctgtcttgagctctgcgtacccgatgatgtccttcagctggctggtggaagaactccaggtatccctggtgggcgttaccgacgctcgaa

SEQ ID NO: 675190 - DNA, 739 bp, Homo sapiens
  misc_feature (66)..(66): n is a, c, g, or t
cctaggagacagagctagactccatccggaaaaaaaaaaaaaagaaaaccaaattatttcctttgncgagcaaaggtgacattcacgtgaaaaatgaagtgaacgcttccaccagtacgttcttggtaattctcattatatttctaacatattattcacctgaacatgggggaacatagattaaaggtccatcttaaaaaacaagccttacagggtgaggccaggcagggttgcctcaccccgtgtagaccaagcactttgggaggcctaggcaagtggtggattcgcctgtgaagtcccaggaagtttcggcgaactcagacactggtgggccaaaagggtaaaacccctcttcttacagaaaaattacaaaagtttatccagttggcgagggtgggtgcataccgtgtaattccccagcctacttcgtggagggccctgaggttggcgcagaagttggcctggagcccaagtgaaggcaggaggtcggcaaatggagccgaaatcgcgcgccacgggcactcccaacgtcctggtggaggacagagagcgagaagacgttgggcctgcagaagaacaaaaacaaacatgtgggcaaagaacctttataaaccccagtctggaatctccaaaagatgttataaaccccagctgtatttgaaagaatgattgaacaccaaatttgcagatatcacttaagccaatgatgtaccccttctgggggcatcaattccgaacg

SEQ ID NO: 675191 - DNA, 470 bp, Homo sapiens
  misc_feature (9)..(9): n is a, c, g, or t
  misc_feature (59)..(59): n is a, c, g, or t
  misc_feature (170)..(170): n is a, c, g, or t
  misc_feature (173)..(173): n is a, c, g, or t
  misc_feature (192)..(193): n is a, c, g, or t
  misc_feature (212)..(212): n is a, c, g, or t
  misc_feature (249)..(250): n is a, c, g, or t
  misc_feature (408)..(408): n is a, c, g, or t
  misc_feature (429)..(429): n is a, c, g, or t
  misc_feature (442)..(442): n is a, c, g, or t
ctgggttanaaagccgctgcctgctgctcgtgttgaatccagaaccgtagccagacatncggactggaggacgagcaccagatgcttaccgaatccccagatcctgaggaggaggccgaggaagaggaggaattcctggatcccctaacaacaccgagagagcaatgcangcncttggagaaatgtgtaaanncccgggagcggctagagcnctgtgatgagcgtgtatcctctcgatcacatacagannaggattgcacggaggagctctttgacttcttgcatgcgagggaccattgcgtggcccacaaactctttaacaacttgaaataaatgtgtggacttaattcaccccagtctttcattcatctgggcatcagaatcatttcctttatgggttttgggatngtaccattttgtttcctattntgtgtaaactgtnaagttcacatggaaccttcatgggtttg

SEQ ID NO: 675192 - DNA, 155 bp, Homo sapiens
caattgatcggtattacaggcaggaaccaggatgaatgtgtgattgctttgcatgactgcattggtgatgtctactgatctttctttgttcttctggttggtttccctgtctcgctttcctgggtgttggacggattgttgttgggtgtctctgg

SEQ ID NO: 675193 - DNA, 438 bp, Homo sapiens
gtaaatgctatgccttaccttgtggaccaggtggactacagattcggggtactacacggaggtactgggagtactgttagggatgaccgggttgcgttatgaagtccaagctgatctgcaactgctgagctcaaacgattcaccagcctatgactcccaaagtgctgagactacatgtatgagtcactgtgccactgctaggaacaggggtgataagaattctcattttatgtgaatgcgtaatgcactacctatgatctacaaattccctgctggatttgtagattaaaggccacgcaatctattaacgcatatgatgtgacagatgcattacgtatgcctcagtcatccctacgtggtggatctacggacccatgcattacgatataccttgacgtggctgtcctacctgcctagccatgatcctgtacctgcttt

SEQ ID NO: 675194 - DNA, 265 bp, Homo sapiens
ggtcgactctaagcatcccattgacatatttgcatatgctttcagctacgactggtcaagagggacatgaattttatttatccctagaaagaataccattacattttcctgtcgtaatgcagccgaagagctaaagcccaggattaaaaagtgttgtctgtggactctgtctcgggcagagttgtttctctccactctgcctcatctctgtacgaatttgggtcccagccttgttgggttgtcagccatggacatggatttcaac

SEQ ID NO: 675195 - DNA, 243 bp, Homo sapiens
  misc_feature (4)..(4): n is a, c, g, or t
  misc_feature (110)..(110): n is a, c, g, or t
cccnaggtgggaggatttgctggagcccccggagtttcaaggcccagcctgtgcctgcatggtgaagccccgtctcctacaaaaaatacaaaaattagtcacatgcggtnttgcgagcctgttggtcccagctaacctgggaggctgacatgagaggattgctggagcctgggaggtcaagcctgcagtgagccatgagtctgccgcagcactccagtctgggtgactgagccagtccctgtc

SEQ ID NO: 675196 - DNA, 195 bp, Homo sapiens
ccggcccagacatgcccgccaacatgtacagggtcggagattacgtatactttgagaactcctccagcaacccatacctgatccggagaatcgaggagctcaacaagacggccaatgggaacgtggaggccaaagtggtgtgcttctaccggaggcgggacatctccagcaccccctctaccccctctagagcca

SEQ ID NO: 675197 - DNA, 122 bp, Homo sapiens
cggaaatcttatcgtcaccgagatcttctgtgtgctccatcccctcatggtgctgcatccttcctggagagagggaggtgaaagctggtgtgagccagtggttccctgccactcacccagga

SEQ ID NO: 675198 - DNA, 431 bp, Homo sapiens
tagtctactcattgcggatactacggaccttaagacaaagacggctccactccagcagtggggaaaggcagcaagtgccgctggaatccgtggggatcacactcaactgagccctgctgctggggaccgggtaacgtccgcaggctgaacttcatctcaagaagagagttttaggttttcatgctgcagagaaatcctttaaaaaggcaccaaagggcatggaactatcttctaccaaggacctttctcctccattctcctatttcgcagttaactcaagaggcgggagattttctccggggaacaagacattctaagcacctccctaggtcgaagttaggttttaaggtgtggaatagggtgggccccgaggttccgtggggttcgcgcttccatataacccctaggacttgcgcaatgagtacagatta

SEQ ID NO: 675199 - DNA, 304 bp, Homo sapiens
cagatgccagggacctgtgtgctaaagaaaccaagatgctgatggtttctggggacaaagatggggacggcaaaattggggttgacgaaatctccactctggtgggtgaaagttaggaggcactgactgcccatggtgttgcacctgcatgccgtgaacacccaattgcggcccgttttgccaccctcgtgcatttatgttcagttggggaagggtcttttgtactcccccatcccctgtggccttctaatgtcaccatttgtgtggaaattgttggggaggcgataagggttggaccggtcca

SEQ ID NO: 675200 - DNA, 129 bp, Homo sapiens
cctcaatagcagttctttctccttaaaatattgtggcagtgcacatgctaacaggtatcaatttctttgatcaggcacaaagaactccttcaggaaactcactttcctggtccttgtaaaactatcatg

SEQ ID NO: 675201 - DNA, 937 bp, Homo sapiens
tagtacaaagaatagatttagtaagttggctcagtggccttccgccacagagtttctgcctgtacgcggttgtgtccgcccgcccgtgagtgggtttccccgggaaagttgggatattgctaaaaattggcgggcgcctgagtgactataaaacaagacgggggtctactatctgagaaaagggaatactaatttcggggatattctaatccctccaagccccagggacttttatcggaaaatattgctaaaagggcataccctcaccgtcctttaagtgggggggaacgcaatacctttatgaagaagagcggccaaaaaaaatgctcggggaagacaacggtggcacaccgaacttgttcctagggcaacccggttgtattgcaaaagataattgccgaccacagcggtgctttttgtctggcggccggttcaaatggagcttagtcgtgccccggggaactccttcggcccgggtagtacatgcggccctgtccttcggagtatcctgggccacaagtgccgtcctgtttcaagcaccaaggtcccttgggccccccccggatttagatattcgagggcagggcccaccaaacgaaacattctcggaaacgacttgtgctccctcattttcaatctgggcgcttgtggtctcccgcccctttatgcggggggaatacccccgtgccgacacaaattttgggggattagcctcgtggagaaatcatgtgggcagaagcctccacgatattggagcccttggtcagacttaagccctggtattattaggacctcaaccgaaatcacgtggttgtacatggggcaaatagagttagactccccccgattcaaggacaagcgggtgacgaatcatatgtatagttaaaaaagggagttatattatggggaaaaatgtaaaagaaccgcccacataaca

SEQ ID NO: 675202 - DNA, 166 bp, Homo sapiens
gagatagacgagagcttgtgtgttctgtcacttagatgcagagagacttttaatgaaatcaatctttcaagggtctaggttccaaatatttttttccctaatctgttgccaattattatcagtatgtattttgtagagtatactatcctaatatgagctagactag

SEQ ID NO: 675203 - DNA, 265 bp, Homo sapiens
tacgtcgcatgagtaggggaagggagctactcgggtgtcgactaggcagtctgtgcctgcgatacagagcgttctggctggttgcctcatcgggtgatgatagccaaggatggggataagtgtggtttcgacgaagatataacatatgattagttctgtggctgaatgttctcattacggagatatgtagggagatacgtatagagaggtagagttttattctgtgaacgtgcagttagagaggtctcacgtgcgcataagtagg

SEQ ID NO: 675204 - DNA, 204 bp, Homo sapiens
  misc_feature (40)..(40): n is a, c, g, or t
  misc_feature (126)..(126): n is a, c, g, or t
  misc_feature (134)..(134): n is a, c, g, or t
agaaatgactgtctttaccctttttctggagccatggaantaggcactaatcccacttacaccccacgtgacagtgagtttgggctcacagcatctcttggaggcagccacttgactctatgtagntatttccncctgagcctcttctctctgtcctgtgagcagagagctgatatggccagatggccacacctggaccagaag

SEQ ID NO: 675205 - DNA, 975 bp, Homo sapiens
aagctgtcaggacttcgttggggaagcccgtgttcaccgtggagcgcatgatatgaacgatgtacactctgctccggtggtggtcatgggggtctggcctggaccgcattgggaggttccacgtctgtttgtggagacatccactgagacggccactggacaaggatgcccaagggtgactgaaggcatggctcaggcttgggtcaggtgactaggctcgagaatggggggaggtgatggagagtgagtagcgcccgcagagtagctcttacgagctgtcgcctgagaagccatgtcacttcgatgcgagctgacgctccccagccattgtgatcgtaccgtggttgaacctctatgacattcctaccatggcaattgtgccctgagggtcagcccatcccctctaaggcacggtctcctaatgtcgcaaggctgcaaccaactcgtctacaggcacccatgcatgttccacatgtgtcactattgggtcaatggtccgtgtcactggtgccagttatatcatgagccaatgtacttgggcagagatgttcgtcgcctcaacaggttggcaatgaaatccctgccatgtttgcgttgggcttatcgatgcgtatgtagcgacctattgcggccaatgcgctgccttgcggtggtgacggtgcggtgtgtccttgccagccggtgaacaataggggacttctacgtacctggcgggccttgcatcgagcggagtgggccgtggtagtgtgtcacttcggtgttaagcagtacgcggggggatctttccgatctccgcccttccgcggacgcagcaggcatgagggggcttggccgggggaacggtgcgcggtcacccggggattggaggcggggggctgtcggggccggtctgggcaggaatgaggcgtgtggggagggggccggcgctttctggtgtgggcccggggagggtttgggcgggccactcccgggccg

SEQ ID NO: 675206 - DNA, 241 bp, Homo sapiens
gaggatatctgagacaggtagatggacgatctggacaaaagtccaacagggtgatcccagaaagtagaggcttggctgagggtatggaaccgggaatgagtcaagccgggctctgccctacagtgtaggacgcattcccgagtgcgggacggcccaagtaggcagaggacagagtccgagtctgtagaggaagcaaatgcaccctgaaaggcagctccatgtcctctagacctgagcgggg

SEQ ID NO: 675207 - DNA, 240 bp, Homo sapiens
  misc_feature (122)..(122): n is a, c, g, or t
gggttcatcagatcttgtgctcagccttccaagtagctgggatacaagcgtctgccaccacacctggctaatttttgtatttgtaatagaggcgagatttcaccatgttggccaggctgggnccgaactcctgacttcaagtgatttacccgccttggcctcccaaagttctgggattgcaggcatgagctaccactcccggctctagatcgcattttgaatattgaaccggatagcttg

SEQ ID NO: 675208 - DNA, 761 bp, Homo sapiens
tgcccttgtgtgcgagaactacatgatgtgagtccaaactggtaccaaacatgtaccactaataggcatatggagttgatagctccattgcttcacatgcagtggcctgagctaaattcacagtcatgaccagtactgggtattcacgcagtcagttgcatgcacactaacttactaactaattagaactggtagagtgctcaataccatggaagtcggaattcatctggcaatccagatcgacagtcaaccttcaccgtgaagcccagtggccatggacctaccacttgttgccctgtgattacaccactcgcgacatcgcataagacacacacttaagaacagcgcaagccctgctcaaaccaacaatagcgcggagacatcaaactaagagaaccacaccacagaaatgaacttaaaaataccagtaactactccaccaatgtgacagaacacagaccaatagataacacacataatacgatgaaaagacacccaactccacaccaataccgtaacacacaacgcttacgcgccaaagaccccacaaacaacaaacgtagaccaacatcggcgcgaaacgcggccacgacaaacacaacagagaacgaggcactaccaccggcacgagagagaaaacaccccccccagaatacggctcccacggagcatgaggcaccgaaacagcaaagaagccacagaagccaaacagcagaacgcagcacacaccagaacctccagcaaccaaaccaccaagacgc

SEQ ID NO: 675209 - DNA, 517 bp, Homo sapiens
tcgggcaaatattaaactttaagttaaaagggacatgtgcccaatgcgcgggttaattccatattggtacaagaaaaaaactggggcgttgggcccactaacttcaaatctagccgtggggaattttcccactggtatttctgcccggtcccccacccccaaaaaagccccagagggggaagatgccccttccgggggcatgggttccaaaggtgcacaccccccctataattgaaaaaatgcggcggatgcgttcttgtgtcttgggaatgttaaatgtgaaaggagaaggccaggtggaaaatgggccctccaagggcttgaaattttgatttttttaagggggacaaaaatatcaagggggttaagtgcgcccatttttttaattaggcttttatttttggaaattgggggggttccaagggtttgtaatggaaaattttctgaaaaaaaataaaagggctgggtctttttgggccaacaatttttttccctgggaaaatacccagaaaagggg

SEQ ID NO: 675210 - DNA, 369 bp, Homo sapiens
cggggtttcactatgtatacctgggtggtcttgatctcttgacctcatgatccgcccgccttggcctcccaaagtgctgggattgcaggcgtgagccaccgcacccagactatacattttttttttatgcggcttctggtagtttggatcacgccattctacatctactctctgtaaagttagtttatatctttatcatggatcagacacaaggccatttctttatttaatggattacatatttgttgagcttataatgtagtcctactgtaatgaattttgattaaatattctcttgttttccaagggatgaactacatccagtttgcccagaatcttaattcaagagcctgtgggaggactgattga

SEQ ID NO: 675211 - DNA, 171 bp, Homo sapiens
ggcaatctctgtctcccaggcccaagcgattctctggcctcagcctcccaagtagctgagacggcagtggtccgccaccaggtccggctaattttggacctttgggagagatgaggttccgcggtgtgggccaggcggctctcaagctcctaacctcaagcgatccatcgg

SEQ ID NO: 675212 - DNA, 435 bp, Homo sapiens
atccgtggcaaattcaagtcatggaatactcacaaagacggggggaaatggtcagtctaagccaaaagaaacttcctaaacaatgtataggtccacagcaaaattaaacaaatccaacaataactgaagcttagtgtaattgagtggtggaagttatacaataaaattatacccaacaagtgtctctcctaaaagtgcagttcccatgagtcacttcctgaacccattgaccaaaggtggacagagacaatcctgtagaccttgacattcagaaagatgtgagctgcttactgatcatatatgcatacgtatctttacagcagaggaaaccattgtccacaaaactgatgttcttttggggttttatgtaccgacttgtccaatcatgtgtgtggttcctgcgagtatgtgatgactccgcattgaagctctcta

SEQ ID NO: 675213 - DNA, 128 bp, Homo sapiens
ctcctggcttatctagaggatcccatctgtatcgtacttcttcgctgttgaaaacacttggtgtaggacttgtgatcacgctccctctctctctctctggtgcgttctctttctctgtcccgatcact

SEQ ID NO: 675214 - DNA, 977 bp, Homo sapiens
gttactcactggctagactgtgggcttgtgttaggccctgtcttatgcagcttcatggaccctgggctctatatgctaataggcagtcttgcatagaagttctgctgcctgagtaaatctttctctgtacatgtacacaggataaaccagcgaaatgtacatgacactgacgatgcatattgaatgtacagaacttcatgttgatctatagcggccttgcagcctctggcatctctttggacatgatgtcgtgccactgaattacggtcctggatgctcataaaggcaagagctaacttgaggttcggaaagctaaagtcctgcactaaccaggagtcccattcatttcactatcaacactcctgaacactaggaaccaaggcaaggtctctagaggacgcggagcacatggctctccagaatcacaaaaccaggtgttatcacattcacgtaagcagcttgaccaacatgttctgaactacactatgtaaccattctggaataagctatgtgtaccccactacattgagcaagaaactttcactctaaccataattaattgtgctacagacgatctttgattctctacacagcttctgagtcttgtaactgactgctacacgcattcgcacgtagacttgcgcgctcgaactcactcatacctgtacggcagacttattctagccaccgactaatttcatctcacctaacccaccatgtcatggccaactaatccgcatgttgcgacttgacacctttcaccaaaccaaacataatacacccccaccccacacacacacaacacaccacatcactacctcacgatcacaaacaacaaaacacacctcccaaatcaccaaacaccaacaccaacaccaacactactacccattccaacacatacaaccaaacatacccaccccaccaacccaccatcacaccaacaacatccacaatcatcacacacccacgcgaac

SEQ ID NO: 675215 - DNA, 601 bp, Homo sapiens
tcctaataacgtcatgtaatgggaccagggaaagagtggctaaatgaatccagtgaaggattggaacttctcgaagagctaccaacacccaagttcagcttgggaggcagatctggaaacagtgtagcagcttgggtttcccaaaaaatgtgaaacttttcctgggacgaattcaggtagctacacagaatctacacagcaaagttaccctgacacagaaaatccttgtgcaaataaatgcttagtaagtacacaggatgcacttgttgaatagagtatacgggatgggtgaaagaaaataataataatgagcatctaagtggtggggtttagagatcaatcaagaataatttaatttcctttggtattgaaatgtaacatagtttcctttccgattaaaaaaattccctataacggctaaacagttaaaacactttaaagtagtaaatgagtttatagaacggcatgtattctggattttggtgcctgtggtaaagtggataactatttatgatttttggaccaattttattccagcatcagaataatacgcaaaatacctttgtagtgttggtcgccctgttttgaatatacagaattc

SEQ ID NO: 675216 - DNA, 499 bp, Homo sapiens
tgagctgttatcatatgggaagggttgaaaaataatagaccatctccacagcaggggaaggaggaaaaacacaaatcatcttaatactaggaatcaagcaagtgggaaggaaaatgggttgtgtggtagagtaaagtggaaatgtgcatgtgagagtttgtgcaaatatgtggtaaggcaagggagtttccaactcaacatgcattaataacctggccctgtgcaaagtgctataaggaaaacaaagatggaaagacatgtatagtagcatgaatttagatgaatataacagaaaacttactaacagtagcttaaaccacagggttaaacaatttcagacataggctgtcttaaggtaggttttagttgttcaacagtgtcatcaaagatatggtcccattctcccatctgtcatactcagcttcttagccttttaaagtccataggcttattacctcatggtcacatgatggctgccacagcgttccacaacgggtac

SEQ ID NO: 675217 - DNA, 218 bp, Homo sapiens
gtgcatgcagtacctagaatagtcaaatttatagagacaaagtagaatggcgcgtaccaagggctgggggaagagaatggagagttattgtttaatggatacagagtttcattttggcattttgcaaaagttctggggatggatagtgatgagggctacacagcactgtgagtacacttaatgccattggcaaactgtaagttatgtatagttgacca

SEQ ID NO: 675218 - DNA, 592 bp, Homo sapiens
tgcgatgacctcgtgggcttttcgggggactttggaagcggtgtcggctgggaggatgaggaggacgaaggacgaccgagtgaatcccggccgaccggatggccgcacggacggaaggaggcgtcgacaggcacaggcgaaggcgtgaacgaacgcggggcctaacaatactggtgaagacgcccctccacaggagagccggctgtcccgcgggggtgagacatcaacaacggcacgagcttctgagagccccgcacagcacggcacaacttcgagaacggactcccgacgatgcacgtcaatgaaggatccctgctccacacctggggggacatgggagtgtgagctgtgcacatggcacttgtgtgtggcaccagatggctgggacgggtgaccacctgtgagtgcacatgtgtgcacatgcacatgtgtgtaatgtgtgtgtgtgtgtggcaccatgcgctgaccaattagtgtccttgatccaccctgctcctggcaagagtgagtcaccccaaggccccttcggcctccttgtagactgttttctttccctttgttgttggttttaaaataccatcacacaccaata

SEQ ID NO: 675219 - DNA, 197 bp, Homo sapiens
catcggaccagaatcatactgtcatggatctgcaacaattcatgtccatcctctatacagaacatattcattgcttctgccagatttgctcccgaaatctgtcctaccccgctacccaggatggagtgtcatgggattgactctgtctcaatcgtcaactgccacctcccgtgctcttttgctcctcccctctctgt

SEQ ID NO: 675220 - DNA, 1853 bp, Homo sapiens
  misc_feature (276)..(276): n is a, c, g, or t
  misc_feature (1172)..(1172): n is a, c, g, or t
gtttagacttcgcttccgaaatatctttcaggccctgttggaggagcagaatgttgagtgtggccgatgcgtccttaactatccgtgagcggtctgtgcggtgacccttccagtcggcaggtcccagacgccccttgtctagtcgctagtctagtaggcttcccgattccctctgacaacctgtgtcatgcgtgcggttgcccaggtactagcgcttgtgcagcatgtctagagagggacctcatctagagatcatcgacgtgtggtcttctgaangtatggacattgttggtagaacgccgtaggtgtagttcacgcctaaggagatacgagcacaagttgcgcatgcattcgttcgcctacttgtgcgccaagagtctttgcaagaaacagcaccaggatatttttcagttcgaacctcaataaatgtctaggagtgggcacgccattcgtttcaccttgggaacaccatatggagtacgggaaggccccggctttccaattttaccacgcgcgaaaaaataaataccatggttggttgcttctagtcgtcggcgcaagcgtaagaaatgaggctaaggccctgtccaaggttccccgttgtggcgatacgccttggtgttccttaggagcccacggcggttaaagggtcgtttggggtagaccccaccacctcgacggggttggacgttagcttcagggagcacttacacattagacgcgcccttttcgtttgtggcctgtggaacaaacaaaaccttagagcaggcttgacttgacaaatagcaaaaacattaacactttcttggttcccgaggcgtcgagtatttacgacagcaagaaaaaagaattttgcgggaaatttttcccccagactatggaatgagccccgagctgcccctgtaagctcatctgctcccacatcgtcacacagggcaacggcaatcttactatagagaagaggacaacacaatctcgtgttctacacaacgtagcggcaacacagtgtgtccaacacgagccgaactctttttcaacccaacttttagtgacggaagctaccatacttttcttggtggccgaccttataacagcaaataacgaccctcctctaggtaaacaaaccacagaatcaagagcacgacttcatcgagaatcggtcacgctccacnactgtaggtcccttcggaggcatgcttgcgaggaaaactggggagcctgtgcaagccacaatctacattcgtttctagtgggaaacgacaccccaagagatggaccgtaaaaaccattgccacctttgggattatcgacgacgcacgacgagcggagtcaacagcacagacagcagcgtactcacacccgctcttatcacgaggagtagactgtgagccacgtcgggcgcacacgtgtgtgggtaggacacaccacagccggcatgttgtatggtaagggggcgatctttgtgacaccatcactgtctgagtaatctctcataagacagcaacaaaagcacttgttgctagccacaagggtgcgtgagacacaacgcgcccctcggttgcgcccacggggccacctacaaccagagagcggtgttgtgtctatcattacaccaagctctggtctggcgtgtggcgtcaatgcgttgacaacattgtggctacatctcgttagtctgaggcctagcgcgtggtagacacactagcggggtaggtgctaacaacacagccagcagggagtgatggtgtggggccaccactcttagtgccccactcgaagatcgctggttctgcaagccagcggatgacacctatgctctggcagagactagtgcccagaggaacgaatgtgag

SEQ ID NO: 675221 - DNA, 396 bp, Homo sapiens
ggcgcacagcttctcaatctgaatcatatatatctgctgtatatagaatttaatgagactatcagatgatagtgatatgtcatgtgttgtatgcactcgtgggtattccgtactaacgttaggacatgccggatacgccgtgagagtgttgtgggaagaatgttcgattatatcgccgatgaatatcataatgcaaatggattctggcgtacgtttggtctatggtgtcgccggagaataggggaaatcacttgaatgaagcctcctatgatggctcactacagctcctattgataggaccatagtgcaccgtgagctacaacgtattacgtgtcgtgtagtatgatgtctagtgatgagtttgctaatacaatgcctgtcaggctatcaacagtg

SEQ ID NO: 675222 - DNA, 1101 bp, Homo sapiens
tggacactggtccaaaggttttccatcctggtcctgggaatcagagttgggaagctgaggagcttcagcctcttttatgggttaaatgggccacctggttctcctccgtggtgaagaggctctgcgcaaagctcacatttaagcttgtgctgtgaccgtggtaactcccgtggggcccatatttacaatagcaggcgtggcccatatcaggtgatttccaaacaacaacacagtggcaaggtgcccctctctggcagtgtttcaccccacatacagcaaacaaacagcccaaggggcacacatgcacaagccaccatcgcgcacaggggggcacaggcatgcatcgccagtgctcccactcccgcgctggcaccacttcttctccacgtgggctggctattaggataaagacctcttaacacaccaccacaggtgctccgtggtacctctgactgccaaggaggcgcctattctccagcgcttgaaggcttacagagtgccgtgcggtgaagctcccctcacaacgagggtttaacaaggggattttccacattccactggggaaactcctttaattcagcccagaattagggcacctctcccagtgcacccacatgacacagccagacatttacccgggcctctcactcccctcctaaccgcctcaatactgtcttgcctccccccagattgtgccacaacgcacccctctgggacgcgccccctttctattccaatccagcttccacgcgggatgtctccggcactaggggcccttacgaaactcttcccaaacggtccggcttcccaatacgaacgcccctatcgcttcttcttcaggccccagccccccgggctccaccggcggtcctccccccttccgtgcaggcccccaacgcacccggcccctgggcccccctaacccccccctggccccacacgcgaacggcccacccgaccccccccccccacaagaccgacccacagcccgtaaaacaccagagcgcgcacaacccgcacagcccgcccaccaccttcccgccgcaacccacgccccgccccccgccaccccagcgccccccgacgcacccctcacccccc

SEQ ID NO: 675223 - DNA, 578 bp, Homo sapiens
ggccccacttcctaattctagcaccttggtggtcaggtttcagtgtaggaattttgggggtacaaacgttaacagcccccaggctgaccacagagcactggcatccaggctgccctgtgcccaggtgcacacagtgggtctggtgaggaggagagcagggctctgcttgggacccatcctgtgaggaggaaccagagtgaagtctgttccttacagccctcagcttcagctcacagcgaaagcgtccgctgagggctgccttctgaatttttcattgtaaaaggtggcacacctggatagtcagttgattttcaacaagggtgccaagttcattggagaaaatatcttttcgcaaaaaaactgaggcttgacaatgcacaccatgtgcagaattcagcttgactggatcatattcctaaatgtaaaagcctaaaatttaaattacctagattctaagccttaaaaaatatgaacttaaatcctgcactaatgccactgaactgtacacctaaaaatagataaaatggtaaatattatgttttatatatttttaacacaataaaaaaagtagaaattta

SEQ ID NO: 675224 - DNA, 191 bp, Homo sapiens
gtgtattcagctacatgcgctgcatggctccctggacaagttcctggcgagacgtgagcaccgttgctgacctccaaatatcgttaagctggagccatggtcgacgtgtattcaccacctgcggtgcatgcctccctgtacaagttcctgtcaagacgtgagcacgtgctgacctccaaatatcgttaagc

SEQ ID NO: 675225 - DNA, 127 bp, Homo sapiens
cttggcaggtggaaataggaggtgcttcacgactgtcaggtgccgacagcgcccaggcggtcagaggggcttcatgtcaggcagtgccccaaccagcggctgtgcgcttctggagcgtggggccact

SEQ ID NO: 675226 - DNA, 183 bp, Homo sapiens
tccagtgtctcaacagaactcatctatactcccatgtatatagcaggcctgtctaaaccagccaaaatttggaatcacactcagtgtccatcaccagcatgaatggactcacagcaaaatatggtacatatacacacatggaatactatttagccataccaaactgaatggtgtcgacacttg

SEQ ID NO: 675227 - DNA, 1386 bp, Homo sapiens
gccctggtgctgagtgctggcctgctgacggggctggtgcgtgactctcggtgcgctcagagctggcctcgtggtcctcgtgagcctggctgctctgaaccgtcccttcctgacctccaccctgtgaccctctgatccctgacacgggctggccctgggacaacagacacctgaccacaccgagcagcccgatgtactagaaatacaccgaacgacactacctctcaccgagctccgcctgccgctgcggagcgcaccaatgagaagagcagatacacagacgcttaggctgagcacactcacacggcaggagcaatcgacgtacacaacggacagcgacaggggacaacgaactagacagacaaccaccatagagggcagcaggagtaatcaacacagacagtggcgaggtcgcaacggcgatcatcgcgcagaagagagcggcgccgggagcagcaatcgcaacgcgcaggagcaagcaataggagagggcacgataaaaaaggagagaaccagaagaccacacgcagcgagcaaacagatcgaggacgaggacagccagaagaaacagagtgctgacccacggtaaggtctggtcccaggaagtagggagagcaggcaagagcgacgacgaacgggggacgagcagctagcggagagaggacgaagccacccaaaaggacgggtagaagaaacagtgagtgagggcgagtccgtatagcaggcaagtgagacgggcgggagagcagacaggggaataacaaggcacacgaagaacgcaagggagccaacacagggaatgcgagacgcgacgcgggcgatcgacagaaggaggaacgggtgcaaacagaacggcgaggcggcgaagcgcgcggcaacagcgacaggggaggacagggacaaagggacgagcgagagactaagcggtgggcgcgcacgcacaggggcggagggatcagaaaggacaacaggagagaagggcgaaaaacaaagagaggcaagagggaggcagaagagagaacgaacaacgaaagaggagaaacgcagacgaagagggcgtagcacggactagacaccacgagaaagaatgacgaactcacaaggtacagacaagcaaacaaaaataaagcaaagaaaacacaggataaataatacacactgagagggcaggagggagggcgggggggcaggagacgtggaggcagcgcgtagtgagagaggagccgcggaggagggacggacagaggacggtagagctcgatggggccagcgcagacgaggcactgcgccgacgcgctgggaccgacggcggcggagctaagggagcaagatagaggtacgcaggagagagaggcgagggggacggcatccgacgtacgctccgcg

SEQ ID NO: 675228 - DNA, 123 bp, Homo sapiens
aaacctgagccctggcccagtattactctcaaagcccatgatgaaggagttccggttggagccatcctcacagattatcgaggttgcacggaatggccagaacctgatagatcaccactcacg

SEQ ID NO: 675229 - DNA, 880 bp, Homo sapiens
  misc_feature (39)..(39): n is a, c, g, or t
  misc_feature (70)..(70): n is a, c, g, or t
  misc_feature (81)..(81): n is a, c, g, or t
  misc_feature (86)..(86): n is a, c, g, or t
  misc_feature (94)..(94): n is a, c, g, or t
  misc_feature (96)..(97): n is a, c, g, or t
  misc_feature (183)..(183): n is a, c, g, or t
  misc_feature (189)..(189): n is a, c, g, or t
  misc_feature (204)..(204): n is a, c, g, or t
  misc_feature (207)..(207): n is a, c, g, or t
  misc_feature (278)..(278): n is a, c, g, or t
  misc_feature (287)..(287): n is a, c, g, or t
  misc_feature (300)..(300): n is a, c, g, or t
  misc_feature (328)..(328): n is a, c, g, or t
  misc_feature (338)..(338): n is a, c, g, or t
  misc_feature (349)..(349): n is a, c, g, or t
  misc_feature (374)..(374): n is a, c, g, or t
  misc_feature (381)..(381): n is a, c, g, or t
  misc_feature (386)..(386): n is a, c, g, or t
  misc_feature (527)..(527): n is a, c, g, or t
  misc_feature (596)..(596): n is a, c, g, or t
  misc_feature (607)..(607): n is a, c, g, or t
  misc_feature (635)..(635): n is a, c, g, or t
  misc_feature (668)..(668): n is a, c, g, or t
  misc_feature (670)..(670): n is a, c, g, or t
  misc_feature (676)..(676): n is a, c, g, or t
  misc_feature (678)..(678): n is a, c, g, or t
  misc_feature (683)..(683): n is a, c, g, or t
  misc_feature (692)..(692): n is a, c, g, or t
  misc_feature (731)..(731): n is a, c, g, or t
  misc_feature (738)..(738): n is a, c, g, or t
  misc_feature (743)..(743): n is a, c, g, or t
  misc_feature (787)..(787): n is a, c, g, or t
  misc_feature (806)..(806): n is a, c, g, or t
  misc_feature (812)..(812): n is a, c, g, or t
acacacaaaagaacaagaaagaacaaaaaagcaggcagngaaccggaccggaaaacccgggaacgctgancaggccgcggncagcnggagatancnngctctggacctcgcatgatagctacttacagggacatccatcacccagaaaatgagaatgtactgaaacgtggatattcaggttanaatacnaggtgggccaaaaanatnctaacacaagattaaacaggaaaagaaacagattatgagacatcccagtagcagtaacaaataacaatagnaccaataanaatccactaaaanatgaaaaacccaaacagcacattccccnggaggagaangcagcgaaccnaaagaacatagaacaatacctgaantccgtgnacatncctaaaaacgagtacaatcacaacacgccgaccccactaagtaaaacaacctgggaagaacagagcatcaaacaaggttgcaaactaaatcgcctgaactctgaagtcggatgaatatgccaatacgtgtctacaagtagnccaagacagtcggactagacgtacttgacctgtggaccctgatgcaggacagccaggacttctcatctnatttatcaganggactacatttgtctccaaaggggaatnaatatttgttctcgcatctctggcctttgatananaaaaangnctctnctctacctntgctgcttccttactggcgggatgtagcagaagcaaaanctgaatnaaatntgctgggagaaggagaacattagccaatcacaggagaccaaaantgcttgttatctacagaantcaaantagtcaatacgtagaggtacgcttttttcctcaggcttaaacctttgccactgatataaataataaaa

SEQ ID NO: 675230 - DNA, 1357 bp, Homo sapiens
caaaacgtttttccgacacataactggttgagaatcacaacgcctgtttattataaatgtgcgataatttttatatataatcctctttcccccaatgtcttcgccaaaaaatgtccctatatatggttgtccccaaacccctctttgtagaaagaacattttttccctcccttatataaatgttcttccacaaaatatatccgtgtgttattccacccacaccccaagtggtcccccgcgttgcattttttggcgccaacaaaaatagggctccccccccggattgggggaaatcccaaggttgatacccgggaagtcccacatttgggggcccgaagaaaattggtactttggggcccctccgcaaataagcttttgtgctccccctagagtgtacacctggtgggtcacaccaccagtggtttttgtgcgctccgagtattattaaattgtatctagcagcgtccaattccggggggtgtacccccaaggggcccaaatagggggtcacacaaaaagagggggtccaacacacacgatgcgggttgggcgcacccacccccagaaaatacttgctccccccctctagaccccccccgggagagccccttgccgctcaaagaggggggcccctggttaatttggggcgccttggcacttccctcgggttccgtgtttagagcctcttctctcttgtgtgccacaccgccctttggggcacaagaaaaggctataccacttctccccgcactctctgaaattgcccacccacagaaagatatttttaaacagatatttgggccacagcggtttatccctctttttttcaaagggagcgccgcacaagctgcgagtctctcaagagaaccatatgcctctcccactcgagctttataggagccttatattggacgccaagagagcactctcacaaccctctctctgggtggggctcttgtgctccacattatagggtgtaagatggaccccataggacatttggtctcaagcctgtaaagagcctttgttgtgggtgtgggcacccacagaaacccggggtgtcttctacaccctcttccccaagagtctcctgtgtcgtgggtgccagaaccggaatacggcgggcgtcttggagaaagaattgtacccttaagattctcattgtaccacccaccctccccgatttggccctggccccgttcccaggaccctgggagaggagaaagaaaagacattctcatgggacaccactgtaagaaaagaacccgattgccaagagaaaaagagagacttaaagtcccgggaccagattttgcccttggtggggtttccaattaaaattattttccccctgtga

SEQ ID NO: 675231 - DNA, 154 bp, Homo sapiens
aacaccaatgtgcacgggctccttccggtctggggacctcatgtccctgaatcagcttttgccacttgcctggcaggacacaacacttacctccatggaatgtacatggccatgcgggacgcccactgtatcatgctcaacattccactgacat

SEQ ID NO: 675232 - DNA, 80 bp, Homo sapiens
gactgcccatcccgggtcctttccctgatgggttggggcacttacccggtagcggttttaattaaaaaaaggaaaaaaaa

SEQ ID NO: 675233 - DNA, 212 bp, Homo sapiens
aacgcctatccctgctgcatattgaattaactagaaataactaggcaaggcgagcctagcgctaagacccccgataccagacgagctgcctaagcacagctataagagcacaccctgtctactttcgcaaaatattaggaagctcaataggtggaggcgccacccctactgcgcctgtgctcatagcctggttgttgaccgagtagacgtct

SEQ ID NO: 675234 - DNA, 269 bp, Homo sapiens
cgacggccatgagattcctcgttgtgactttgtttactttctcagggtgatcagagtatgtattatgttatcatctaagtaccaagattcattctcatcaaatactagaaacaaaagggaaaatcccattttgctttttaggattgaatactttcacatagatttcgcacatcatgctatagcacttaggatctactgatcagtgtatagcatgtacgtatctctcacactactcttgatgcatatatatcatactgactgcactaatc

SEQ ID NO: 675235 - DNA, 316 bp, Homo sapiens
taagcgtgcttagtgaagccctgtgaactgaagctagacaacttaaacttcagaagaaaataacagcaaccggtttacatatataagctactttcatacctgcctacggatgtatggacttcagaagtagtgtggcctatatcgattttctaggatcattatttggtttgttgtttttctcccttcctccacctattttctcttcataggacatgaggattctcaacctgataaaaatgagctttcctaataactcaagacccatctgcctaggaataaaccatcccagctgtgagagaccagacaaagggaaaca

SEQ ID NO: 675236 - DNA, 913 bp, Homo sapiens
  misc_feature (330)..(330): n is a, c, g, or t
  misc_feature (477)..(477): n is a, c, g, or t
  misc_feature (496)..(496): n is a, c, g, or t
  misc_feature (511)..(511): n is a, c, g, or t
gagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgaggagaagccaattacatcggctcatgacaaatacttccatgctcgggggaactatgatgctgccaaacaggggacctgggggtgtctgggctgcagaaagcgatcagcgatgccagagagaatatccagagattctttggccatggtgcggaggactcgctggcngatcaggctgccaatgaatggggcaggagtggccaagaccccaatcacttccgatcctgctggcctgcctgagaaatactgagcttcctcttgcactctgctctcaggagatctggctgtgaggccctcagggcagggatacaaagncggggacgagggtacacanatgggtatctaatanatacttaatgaggcaaagcctagttaacgcatttactaaacgcatttgagcactcgcacacggatcccacttcggagaaagtcggtcacgggactgccaaccatttgggacccaccgatcccccgtttcgaacgctgggacacacttgggaatacgggagatgtccggagaaaggcgcccgagcgacacgaagctagaacgcaacgaatgagaaggactcactcccggcacgaattaaacaaccgcccccgggttgtgggaaacacagaagcaggctcttcgggcacacagaatcccccgaaagtaaggtcattgcaacagcacgaaccaataacgggggactactgcctacggcagggactacacacagggtgaacggcccccaaatgcataatatccccg

SEQ ID NO: 675237 - DNA, 405 bp, Homo sapiens
  misc_feature (169)..(169): n is a, c, g, or t
  misc_feature (305)..(305): n is a, c, g, or t
ggcacgagcacggtgccgaggtggtcgaacacgggacgcttggcgtgcgcgccgccccggtcggccggcaggtagcgccaggccagcagcagcgccacgccggccagcggcacgttgacgaggaaaatggctggccagccgaagtgcgcgatcagcaggccgcccatcncggggccgagcgtggtgccgaccgccgacatggtgccgagcaggcccatggcgctgcccgtcctggccttgggcacggtgctgccgacaaaggccatggtcagcgccatcatgacggaagcgcccaggccctgcanggcgcgcgcggcaaccagcagccacaaggtgggcgccagcgcgcacaggatggaggcaagggcaaacagcgcaatgccggccagcagcaggcggcgccgg

SEQ ID NO: 675238 - DNA, 631 bp, Homo sapiens
  misc_feature (330)..(330): n is a, c, g, or t
gagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgaggagaagccaattacatcggctcatgacaaatacttccatgctcgggggaactatgatgctgccaaacaggggacctgggggtgtctgggctgcagaaagcgatcagcgatgccagagagaatatccagagattctttggccatggtgcggaggactcgctggcngatcaggctgccaatgaatggggcaggagtggccaagaccccaatcacttccgatcctgctggcctgcctgagaaatactgagcttcctcttgcactctgctctcaggagatctggctgtgaggccctcagggcagggatacaaaggttagtgaggtctatgtccagagaagctgtagatatgggcatagtaataggcatctaaataaagtgcttaagaggtactaaaaagacatgagagttcatgaaacagaaaggattttgggagtcctctgtggagttcctgagaagagtttttttaa

SEQ ID NO: 675239 - DNA, 675 bp, Homo sapiens
  misc_feature (292)..(292): n is a, c, g, or t
  misc_feature (439)..(439): n is a, c, g, or t
  misc_feature (458)..(458): n is a, c, g, or t
  misc_feature (473)..(473): n is a, c, g, or t
gagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgaggagaagccaattacatcggctcatgacaaatacttccatgctcgggggaactatgatgcagcgatcagcgatgccagagagaatatccagagattctttggccatggtgcggaggactcgctggcngatcaggctgccaatgaatggggcaggagtggccaagaccccaatcacttccgatcctgctggcctgcctgagaaatactgagcttcctcttgcactctgctctcaggagatctggctgtgaggccctcagggcagggatacaaagncggggacgagggtacacanatgggtatctaatanatacttcagaggtggacacccaaatttcctgtattctgaacaaagagaaagacagctttaactcctgatctcccttcctaatatcacacttgttcctgggcagacagctgcaatcatgatttccctaagcaactcccccctagaaggtgtcctggaacgcactcaagcttgccatcatccgagggccctcaggcgagttccg

SEQ ID NO: 675240 - DNA, 523 bp, Homo sapiens
gacggccaccgttcccctgttagaacagtgccgtggctgctgttggagaatgttgcttttacacaacaacagggccacatgggacacacgggcccccaaggcaagccctttcacgctttccctttcctttttcttccatttaaaaacgacgccaaaccagggggcttaattcctttggtttctctccttttttattcacaaaacgtggtggccttttggggctctggccaattctgaggggtgttggatgtggctatgttggcgacacgaacagtctcaggaaggacaccgtttgggaaaaaccgaccgtttcaacgggcatttttaaccccttctctcacggtaaaccattttttattaacaatttcttaaccgtttggttccaactcgttacttttctgagcaccaatttccaccaagggcaaaacaggcccttgggggaacattcctttgtgtcgaaagggtccctccctttcacgcctgcataattcatttacttttctcctctcctcttcttcaaaaa

SEQ ID NO: 675241 - DNA, 478 bp, Homo sapiens
gtttgccgagataggatgatggacgcatgaccacacggctaacgtcctgtggtactggtcctcccgcgagtttgtctaggaattattgctcctcctaagccgtccacgtaacagttgaacttgactctcagggtactctcggtggctcacggtccatcaccatgcatgtcagcctcaggggtccgggagatcatgagggtgtccttgggttaaggggggaagaggaagactgacggtccccccaggagttcaggtgctgggcacggggtgggcatgtgtgagttttgtcacaaggatttgggctcaactctcttgtcccaccttggtgttgctgggcttgtgattcacgttgcagatgtaggtctgggtgcccaagctgctggagggcacggtcaccacgctgctgagggagtagagtcctgaggactgtaggacagccgggaaggtgtgcacgccgctggtcaggggcgccttagtt

SEQ ID NO: 675242 - DNA, 692 bp, Homo sapiens
  misc_feature (277)..(277): n is a, c, g, or t
  misc_feature (367)..(367): n is a, c, g, or t
  misc_feature (500)..(501): n is a, c, g, or t
  misc_feature (506)..(506): n is a, c, g, or t
  misc_feature (512)..(512): n is a, c, g, or t
  misc_feature (518)..(518): n is a, c, g, or t
  misc_feature (522)..(524): n is a, c, g, or t
  misc_feature (527)..(527): n is a, c, g, or t
  misc_feature (535)..(535): n is a, c, g, or t
  misc_feature (537)..(537): n is a, c, g, or t
  misc_feature (540)..(541): n is a, c, g, or t
  misc_feature (548)..(548): n is a, c, g, or t
  misc_feature (555)..(555): n is a, c, g, or t
  misc_feature (560)..(561): n is a, c, g, or t
  misc_feature (567)..(567): n is a, c, g, or t
  misc_feature (570)..(570): n is a, c, g, or t
  misc_feature (572)..(572): n is a, c, g, or t
  misc_feature (576)..(576): n is a, c, g, or t
  misc_feature (578)..(578): n is a, c, g, or t
  misc_feature (582)..(582): n is a, c, g, or t
attatggccggggcacggatcacgatgtaaattattaagcattttggttggatttcttttgtaataaactatttttgtaccataaaaaaaaaaaaaaaaaaaaaaaaaaaaaaaaaaaaaaaaaaaaaaaaaaaaaaaaaaataaagaccacttagaccaaaaaaactttaaactaaacaaagttaataaatagcgaccgaaattaaagctaatttgcccaatacacctaaaagggagccgaataaaaattaattggccgtcttttaaaaacgtcgnaattggaaaaaccttggggtaaccaaattaaatcgctttgaaaaaaatccccttttcgcaagttggcgaaaaaccaaaaaggcccgaacnaatcgcctttccaaaaagttgccaaccctaaatggcaaatggaaaattgtaagcgtaaaaatttggtaaaaattcgcgtaaaattttggtaaaataagttaatttttaaaccaataggccaaaatgggaaaannccttnataaanaaaaanattnnnccnaaataggntnaanngtgttcnagtttgnaacannattccnttntnaaanancggngcctcaaacgttaaaagccaaaaaacgggtatataaggcgatggcccaattaagtaaacctttaccctaaataggttttttgaaataaggggctctaaagccctaaatgg

SEQ ID NO: 675243 - DNA, 572 bp, Homo sapiens
  misc_feature (187)..(187): n is a, c, g, or t
  misc_feature (277)..(277): n is a, c, g, or t
  misc_feature (410)..(411): n is a, c, g, or t
  misc_feature (416)..(416): n is a, c, g, or t
  misc_feature (422)..(422): n is a, c, g, or t
  misc_feature (428)..(428): n is a, c, g, or t
  misc_feature (432)..(434): n is a, c, g, or t
  misc_feature (437)..(437): n is a, c, g, or t
  misc_feature (445)..(445): n is a, c, g, or t
  misc_feature (447)..(447): n is a, c, g, or t
  misc_feature (450)..(451): n is a, c, g, or t
  misc_feature (458)..(458): n is a, c, g, or t
  misc_feature (465)..(465): n is a, c, g, or t
  misc_feature (470)..(471): n is a, c, g, or t
  misc_feature (477)..(477): n is a, c, g, or t
  misc_feature (480)..(480): n is a, c, g, or t
  misc_feature (482)..(482): n is a, c, g, or t
  misc_feature (486)..(486): n is a, c, g, or t
  misc_feature (488)..(488): n is a, c, g, or t
  misc_feature (492)..(492): n is a, c, g, or t
tgacattttagggacatggtgtttttataaagaattctgtgagaaaaaatttaataaagcaacaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaattggccgtcttttaaaaacgtcgnaattggaaaaaccttggggtaaccaaattaaatcgctttgaaaaaaatccccttttcgcaagttggcgaaaaaccaaaaaggcccgaacnaatcgcctttccaaaaagttgccaaccctaaatggcaaatggaaaattgtaagcgtaaaaatttggtaaaaattcgcgtaaaattttggtaaaataagttaatttttaaaccaataggccaaaatgggaaaannccttnataaanaaaaanattnnnccnaaataggntnaanngtgttcnagtttgnaacannattccnttntnaaanancggngcctcaaacgtaaaggggcaaccgtttataagggcaatggcccattacgggaacctttcccttatgtttttggggggcgg

SEQ ID NO: 675244 - DNA, 624 bp, Homo sapiens
  misc_feature (239)..(239): n is a, c, g, or t
  misc_feature (329)..(329): n is a, c, g, or t
  misc_feature (462)..(463): n is a, c, g, or t
  misc_feature (468)..(468): n is a, c, g, or t
  misc_feature (474)..(474): n is a, c, g, or t
  misc_feature (480)..(480): n is a, c, g, or t
  misc_feature (484)..(486): n is a, c, g, or t
  misc_feature (489)..(489): n is a, c, g, or t
  misc_feature (497)..(497): n is a, c, g, or t
  misc_feature (499)..(499): n is a, c, g, or t
  misc_feature (502)..(503): n is a, c, g, or t
  misc_feature (510)..(510): n is a, c, g, or t
  misc_feature (517)..(517): n is a, c, g, or t
  misc_feature (522)..(523): n is a, c, g, or t
  misc_feature (529)..(529): n is a, c, g, or t
  misc_feature (532)..(532): n is a, c, g, or t
  misc_feature (534)..(534): n is a, c, g, or t
  misc_feature (538)..(538): n is a, c, g, or t
  misc_feature (540)..(540): n is a, c, g, or t
  misc_feature (544)..(544): n is a, c, g, or t
tgacattttagggacatggtgtttttataaagaattctgtgagaaaaaatttaataaagcaacaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactcaagggggggcccggaaccaaattcccctaataggaagtcgaataaaaattaattggccgtcttttaaaaacgtcgnaattggaaaaaccttggggtaaccaaattaaatcgctttgaaaaaaatccccttttcgcaagttggcgaaaaaccaaaaaggcccgaacnaatcgcctttccaaaaagttgccaaccctaaatggcaaatggaaaattgtaagcgtaaaaatttggtaaaaattcgcgtaaaattttggtaaaataagttaatttttaaaccaataggccaaaatgggaaaannccttnataaanaaaaanattnnnccnaaataggntnaanngtgttcnagtttgnaacannattccnttntnaaanancggngcctcaaacgtaaaggggcaaccgtttataagggcaatggcccattacgggaacctttcccttatgtttttggggggcgg

SEQ ID NO: 675245 - DNA, 295 bp, Homo sapiens
  misc_feature (109)..(109): n is a, c, g, or t
  misc_feature (133)..(133): n is a, c, g, or t
  misc_feature (154)..(154): n is a, c, g, or t
  misc_feature (156)..(156): n is a, c, g, or t
  misc_feature (166)..(166): n is a, c, g, or t
  misc_feature (180)..(180): n is a, c, g, or t
  misc_feature (189)..(189): n is a, c, g, or t
  misc_feature (191)..(191): n is a, c, g, or t
  misc_feature (199)..(200): n is a, c, g, or t
  misc_feature (206)..(206): n is a, c, g, or t
  misc_feature (227)..(227): n is a, c, g, or t
  misc_feature (235)..(235): n is a, c, g, or t
  misc_feature (278)..(278): n is a, c, g, or t
  misc_feature (283)..(284): n is a, c, g, or t
gagctgactcccatgggttgccgtcttcccagtatcggtggggacgggccctgagtgggaaagaagaaacaaggaaaattccagtcccagctaacagatacacaccatngaaagaaaacgggatgaagatatntactcctatggtggaacattngnggacttcagnatacgctttaactntgaaatcangngaatgtannaaatcnggactggtaaggaaaccaagngatgtcangtgctctgacaaaagcagcgtgatttggtgaaagcttttagtnctcgnnctttcagcgtg

SEQ ID NO: 675246 - DNA, 259 bp, Homo sapiens
cccccatttttttccccccccccaggggtttttttttaaaaagaaaaaaattccaaaaccccccccttttttttgggaacccccccccgccttcctggggaggcccccctttttggaaacccccccccggccccccccggggttaaattttaccgagcccgtggttttgcccccccccccccccctccttttttaattccccccccccaaaagggcccaaaaaaaagcccctttttcttgggtttaaaaaacaaaccca

SEQ ID NO: 675247 - DNA, 448 bp, Homo sapiens
ggcaacgcccctagaggctaatgcgacaaagcacgacacgatcgctactacgctaggtgtatgcaccgcaaacggtttgcctgcagacgaaatgcgcgttgtctacggcagatacagtactatgaccgtacaactttacgggactgcaaagaaacatacggcacaggacataccgcaaaaaactgataatgatgaagagggttataagtgggagaaggaacgcaattaagccttgaattaaggccaaaagagctgcgaggcgcggcgaggacaccaattggtacggcgttgttgggagcactatgtaccagctacgggaatgccgggacgaaagtgagattgctgccgcacgaaaataaagagagagcgggggagagaaagggaacgcaagggatgaagatacagcaggaagagctacggaccagcggttcgtaccccgattatagcg

SEQ ID NO: 675248 - DNA, 107 bp, Homo sapiens
cttcctggagatcgtcaccaaccctgatggctttgcttcacgcacagcacgaatcgcatgtgggccaagactcggtcccacacagcaggctccctctgtattggcgt

SEQ ID NO: 675249 - DNA, 1481 bp, Homo sapiens
  misc_feature (64)..(64): n is a, c, g, or t
  misc_feature (430)..(430): n is a, c, g, or t
  misc_feature (509)..(509): n is a, c, g, or t
  misc_feature (1384)..(1384): n is a, c, g, or t
gaaaactacctcctactacgccaaacctggtgcacaagcgataaacgcacttcatagttcgacnctattgtcgatcattggacacgtacattcgggcaagtccacctagctactggccactctgtatcttattaaattgtcggatggcatcgtacgaactagaactcacttgacaataatctgaagaacgtgacgtgcctgctggcataactggcgtaaatgcggtctccatatcaagttattgtccatgtgagctcctctgggaactaatagaactgtatacacgactgaaggcgatgaatacgttgtgtaatccaccaattagaactcatcctccctagtgcgtgaaatatttgaagcactcaggtcccgccttactatagttgactaatcacttgattgccccacgagaacatacatgtatagaccntgttattcacacaaaaccattgattctatcacgggcaccactctatcacgaggctgaccctgctgccatgatacctgantttgctctggcatgacctggatgctctggctgaaattctgagaggcctgggtactctgcccaagtaactggcgcagaacacccgaacgtagtcactggcaccttctggtcttaccatcatctggtgtgttgaatacatcacacttacaatagttcgcggtgattaatcataaactggacttcgcacctgagaccactcctcactagtcccagaaaagtagcatcattgcaggcaacactagtcttaaaggcacagctccacgtcagttaactatttacagcaccacagattgggagtgcacaaaccccgcgacgaccagctcatcgatcgcgtgccgcaattttacttggttcggacatcggtgcactaaagctatagcctgggcagtcccacaggttgacttaaaaatattggcctttgggttttcaacacgtgcatcggggacaaacgtctaaacgccgttcaaggcatggctaacttgacccagttgggagaacccaccacttggcctagaaaagcttcatgcgaacttggcctttttctacccaccccaaacttcgctctcagaacttgggaggcttaggtccccctttgtgtggcccttggctctctcccccaggaggtggtcgtccccccaccacgcgagggcgcgcgccattactgggcaccaccgctccccaagggtacgacacggactgaagcgtgcccccacgcgtgcggtccgctccaaacccaccggccatgtgcggcggcggcccccccttctcgattcacacactcagcacgggcagtctacccggacacacactaccacctctgtcgctcaactgatcggcagccgacacacagcaactaagcaaaaaaccacacccccngacggcaacaaggagcgccgcaaccttgcgacgaaagactcgttgcacaccccatcagtacgacgcagcacaccgacgaaccgtgcaaacactcact

SEQ ID NO: 675250 - DNA, 475 bp, Homo sapiens
cggtctcttcctgacctattataccttctctaaaattgcatcttgaccaggcacagtggctcatgcctataatcctagcactttgggaggccgaggcgggcagatcacctgaggtcaggagttcaagaccagcttggccaacatggtgaaaccccatctctaccaaaaatacaaaaattagccagacgtggtggtgcacgcctttaatcccagctactcgggaggctgaggcaggagaatcacatgaatccaggaggtggaggttgcagtgagctgagatcttcccactgcactccagcctggacaataagacctgtctccagcaagaccctgtctcacaaaaaaaacaaacaattgcatatggactcctgaagaacttcaagccatagttgagatccatcacataagatggacatatactaaagtacctgtgagccaggtgttgcaatctcaaagtcactccttaccaagctcc

SEQ ID NO: 675251 - DNA, 930 bp, Homo sapiens
tgtttatacggcacgaggccaagatatgccaggctgacattgtggaggctgtggacacttgcaagtgcagccaagcactttgacttgaatctgcgtgcagatgtggaccctacagactaaactactctcgaactggaagacacctggcttttggatgggctgccgaggtcatgtggctgcccttgatttgggtaacaaagaagcttatgttgcgagatcaactgtcatggagtgcggtgctgggacatcctggttatctaccattacttgacgagcaccttgcatctgactaggtttgcttctatgcacaccctgcatagtgcatcccacgatactaattgacagatcacgggccattagagcatccacttgtatcctgcctgctgtgacctgagtaacacggcttgagttcctgcccttccacttcctcctggctacagcttcagaaacagggtttctaacctacctggatgtgtcagtggggaagatagtggcagctctgaactgctcgagctgggcggctcgatgtcatgagtcagaacccttacaaatgccgtcatccatctcggacacagcaatggtactgtgtctttatggagtccagctatgcaaggagccactggcaaagatactctgtccatcgtggtgaggtccgggctgtggcagtagatactacaggcacgtacatggccacctctggcctagaccaccagctgacgatctttgacttgcgagggcacgtacagcctctgagcactcggaacctgccccatggagcatgtcactgcccttcttcccaaggcgcactgcatgttccggcgcaatgggataccgtttgacacatctgggccggtccggcacggccagccacctcctttacagcctcctaccacggatccaggccgtgcatgcctcaattgcccttgacgt

SEQ ID NO: 675252 - DNA, 131 bp, Homo sapiens
  misc_feature (64)..(64): n is a, c, g, or t
acacaaggcagtgtggagcaacatgctgttttaatgagcgcctggatgcaggtgggctgaggcntaaaatggggtcagcctgaacaatatattttttaaaaagattctgtcttctacttttttcattactt

SEQ ID NO: 675253 - DNA, 293 bp, Homo sapiens
  misc_feature (197)..(197): n is a, c, g, or t
  misc_feature (226)..(226): n is a, c, g, or t
agctcgcttagagctcccgtgtactcttctccctagaggaggcagttcccaaaggtggaggggagatgtctattactactttaagaactaatcggccgggcgaggtggttcacgcctgtaactcccatgcacgtttgggacggccgagtgtggtgtggactcacctgagtgtcaggagttgcatgaccatgcctggncaacacagctgagacccctgtctttacanaacattcgctgggcgggtggttgtatgccctgtaatcccgagctacacgggagccactaggcgaggt

SEQ ID NO: 675254 - DNA, 853 bp, Homo sapiens
gcatggcaggcgcgcggtaatcggccgaggactggcaccatccttattgctacagatgtagcctcccgtgggctagatgtggaagatgtcaagttggtgatcaacatatgactatccaaacagctcagaggattatgtgcaccgtatcggtcgaacagcccgtagcaacaacaagggtgccggcgtataccttctgcaccccagggaacctaaaacaggccaggagagcttatcaaagtgctggaagaggccaatcagggctatcaatccaaaactgatgcgctgtggaccacgaggaggcggcggaggcgggggtggtcgttctcgttaccggaccacttcttcagccaacaatcccaatctgatgtatcaggatgagtgtgaccgaaggcttcgaggagtcaaggatggtggccggagagactctggaaggtctatcgggatcgtgggtgaaaccgtatagagcggtggtgatgctaatggcagtggcatatggaagtcgcaagattctgccttcggagcacaagcaggcgcagatacaccgtatggtcaaggcacctatggggcagctgcttatgggaccagatagctatacaggctcaaagaatatggtgctggcgaacttatggagcgtagtagcagcacagctccaagctgggcagtaagttcacagcagctctagcctagcagtttcagtgggataggccggtcgtgggcagcagcctacagtcacatgatgtcacaacagttgtgcacagcctccgggagctagcaatatgataggtcacatggggcagactgctacaatacctctccttcacctctgtccaatctgggtatccccatggggtcg

SEQ ID NO: 675255 - DNA, 115 bp, Homo sapiens
tagaattggaaattgttgtttctaaatctatatgagaattgacaataagtattcttattataacgcggcccatacatgtatactatgtatgcagtgcatctgcatagaacagttt

SEQ ID NO: 675256 - DNA, 258 bp, Homo sapiens
  misc_feature (240)..(240): n is a, c, g, or t
gacaagatccgttgagctgcttcctctggtgcaattggacatatagaacatctgcactgaggcgctcgtctgtgcacgcaactgcagtactgacccctacaagggagctgtgcactgatccagctgagagggagttcagcgctgctgcccgcagggaacaatcacacctgtacatggaaggcctgggaggatacccttgacaaatactgtgaccgggagtatgctgtgaagacccaccancacttgtgttggcggggt

SEQ ID NO: 675257 - DNA, 397 bp, Homo sapiens
  misc_feature (61)..(61): n is a, c, g, or t
tttttttttcccctttccctccctccctttccgcatttttcccttggttaaggacaggganaagggttcccctccctccccgccttcatggatcaccagctcaggtcatgttgcctttttttttctttgggggggggtaaataagggaatttttttcccccccccccttttttttttgggcccccccccccccccttttttgccagggaaatgggggatgggttatgggtttgcaaacaggtggacggtcaggggggtttttttccaaaggttcctccttggcctccccttcccctcctttcccctccttttccttccttccttcctttccttggggccctgggccccatttgggaggttgagagaaacccaaattaaagagagaaagaggggggga

SEQ ID NO: 675258 - DNA, 176 bp, Homo sapiens
  misc_feature (64)..(64): n is a, c, g, or t
  misc_feature (71)..(72): n is a, c, g, or t
gggtggaaacagccttaaccccagatgacttctattctgactaatttgagtcattgcttgactncataggnntttttcttgagagggctcttccacttttgattcagaaaaggtagcatattttatttacccatgaaattttgagaaccacagggctttttttttttttgggggga

SEQ ID NO: 675259 - DNA, 218 bp, Homo sapiens
cgcggtctctatagatattaacactacatatgcatgtatatgtaattaggtgtgtagcctgatcccttaacatctgcagcctccgcaaggacaaggagatcatgtctgttggattcccagaacccagcagatgagtctggcattcagtagatggccaataaattttacagaatgaataaaagtatatacttctatagaaatcacacgtatacacttac

SEQ ID NO: 675260 - DNA, 394 bp, Homo sapiens
taatgtctagttcactgcactcacctcctgggctcaagcgattctcctgcctcagactcagtctcctgagctagctgaaagttactgacaaatcacttacatgcccaactaaatttttgtattcttagtagaaacacgctttcgccactgtaggtcaagctggtctcgaactcctgacctcaaactgatctagccacctcagactccccaaagtgctgggatttacaggcggtgagccatcgcacccagcccatgaaattttttttaaaaaagcctttggacagagaggcttctcgtcagattaacctccccaggaaatccattgtctgggcctttgccctgttatgctcagtattctcatcctgtctccagcctgggcaacacagcaatgctc

SEQ ID NO: 675261 - DNA, 1105 bp, Homo sapiens
  misc_feature (804)..(805): n is a, c, g, or t
  misc_feature (808)..(808): n is a, c, g, or t
  misc_feature (812)..(812): n is a, c, g, or t
  misc_feature (814)..(814): n is a, c, g, or t
  misc_feature (817)..(817): n is a, c, g, or t
  misc_feature (827)..(828): n is a, c, g, or t
  misc_feature (830)..(830): n is a, c, g, or t
  misc_feature (836)..(836): n is a, c, g, or t
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccatgaggggccagggggcccttnnagnctgngnccngggccaaccnngncggcangagggggtggggacacgggtcacagggcggcaccacaaaagagagtcagcgcgagaggacaaaggcggagaaacaagaagacaacaagccagagatgatcaagaaccaccagggagcccacaaagggaggcaacaaaggtagacaacaatcatggtgacgatacgagaacgactgtgagcacaccagaagagaacaaacagagcaccgagatacgatgatcaaggccacagacactcacccgcgagagttgctagactaacacgacaaa

SEQ ID NO: 675262 - DNA, 218 bp, Homo sapiens
ggtttctcgcctcatgtctggtggctgccgcgggagtattaacagagaaccatgggcggcccagaggaccgtgtgaccccgatgggtgtgcatacgagaggcaactggaatgagattatgtgataactttggatcgatatgaatttaaaggacgtctctccgctcgttggcatcaatgctaactggattgaacgaggccttccgctattacagcagtg

SEQ ID NO: 675263 - DNA, 138 bp, Homo sapiens
cacccgcacggacttgtcggatcgtctggatgtggctgatcgcctcgatcttcttctcattgacgagtacggcgatgcgctcaagcatgttcttcttattcacctgataggggctctcgtcgatgatgatcgcctggc

SEQ ID NO: 675264 - DNA, 872 bp, Homo sapiens
  misc_feature (2)..(2): n is a, c, g, or t
  misc_feature (447)..(447): n is a, c, g, or t
  misc_feature (489)..(489): n is a, c, g, or t
  misc_feature (871)..(871): n is a, c, g, or t
tnacggccgccagtgtgctggaaagccaccaccgccctgctcattccctacttcttaaatatttccatcgattggaagaaacaaggggaacctttgagatccaggttctctgagatcctgtctcacagtctcaccatggttagtctagactccatgtctccttagtaaaccaagatcaggctcccacacggctcttctctctctcagaagaaagatatagtcccaagcacacagggtcatggagtgtcatggaagcaaatgacaaactcgatggggaacttgacagggaggatagagcattttgtatgtggtaactgaagagctgcagtctttccacacaaaggggaaggtagagagtgcccctagaaagggagcaaatgaggttacagaccaaagtatgaagtccagaactgggtcatccaagattagacagagacattatctgtnaacaatgaataatcaaataaaggtttataccttatttaaaanaaaaaaagaagaacaagggtcatggacatatagaagcctgagagccacagaagggcaggcacatcctggccataccagctgagttctgtctggttctctgttaggcagaccgctgtattcaagggtccagcaggaggagacactttagagatgagcatgatagactatcgctgggttgttgactagcaaacccggtctagaccaatccctgtgagactgttagacaggatctcagagaacctggatcttagacgctccccctacttcttccaatcgatggaagtattaaagcagtagggaacgccttggggactctctacccgacaaaaaagaaaaaggaagcttatttcctttcttctggcagctcctaagcaggcttctnt

SEQ ID NO: 675265 - DNA, 868 bp, Homo sapiens
gggatccaccatggtggcgccgagtgtgagccgatagagagagaccggggaaattaagtttcttgcggagtacgggtggggatagcgagctgcttgagcgagggattctggaaagcattgcgtatctgagtcccccaggagtgtgggggcttaaagcggaggcgaaagccaggggtggccagaagagcatggtgagcatggaacatgggctgtacatcctggaccgcatgttggacatcgtgggcactcatctgacacagagatgatgtgcgcgtggtttctggccgtctttgtagatgtcatgatgaccaggagcagtggagtcatcctgataatgggaacagtcgactgcttattggcagtgggtacgcgccaggggcgctgttggatgaaaggtacacgtttgagccaggtggctggcagttgctgcgaattatcactcggcggaagagcttgctgccgtagttaccctctaagaggagacgggctgttgtgccctgatcttgtgcgacgagtatctgggagggagacatcgaagatcgtgatggtgacccccacagagcgggttcagtgagtgcagaaccaagggggctccccaggcttgctaaagagaggtggctccgcagtatccttgtgagtgtgttgccccacttgggaggtcctcaagatggttttgcaaggcggcagcccgagggagaagcaaaaattgggaagccagtgaaaaacccgggaaataaggacagagatccaggaaaagtcaacatgtgggcttggaacggggttccggtgattcggcagtggacggtgggggacagttccttagaagcaaccttgacccggtgcggtacacgaaattcatcgcggctgg

SEQ ID NO: 675266 - DNA, 1641 bp, Homo sapiens
ggtggcggcgcgcgcagcggcaggcggcggcgggatggagcccgatcccgagcccgcggccgtggaggttcccgcggggcgcgtgctcagtgtgcgtgcgctggccctggcctggagtgggtgtctggggtgctgctggtggccagcgctgggtagggaaacctggctgccctgggaccctggccaggctggcccctgatgcgctggctgctgacccctgcgtccccttctcccccagcgccacggagagcatctacagccgaccgcatcgcgggatagacagaacgcatgcacccagcagactcgcagtggaccccaaggcactttcatgccacagaacgagctcagagcagctacagggccagagcggcatgactggaccgtgttgccagggaaaagatgcatctgcgcagcctgccttggcaggaaggcacgcaggctgtaggaagctggccatgagtgcatgactattggtgagcttgccaggaggtgggaggcccaaggacaggaagggagcttccgtgggcacgttagagacgtgatacaacaagatggggagcaaaacttacatggggcagaaagcaagttggtgcgtagtcctacaacagacggcgaggggaccagggacacaaagaccgtgtcagcacaccgggcaaagaagggagcttatgcatattcattccttggaagatggtgcggcataccaagtcacaggaccttccatatcccaagcccaaaaagaaaccagttgccccacctattgatcataatatcccagggcggacaaggcatttacgccaaggacagttgctattgcaattgcaaccatagaaacccaaacaaaagatagtatgaaacacaattatacccgtattggacacgcgttacacaaaatagggatacttacacagcgacgagcaccttggaaagaggaacgggatctcggggagagcaagcaaggttgaggaacacagcaccgaaaagatacccacagcagaccacaaagccgtccatagaaccaatcgaaccccagcgagagacttgagcgaagcgccagcagtcacacccacacggactagccgaaagagggtgaacagcacacgggagcagcagacatggcgcggacacgaggagcgagcaagaggacaaagcgcagcggcacacacaccccgacacaacacactagacgaaagcacagagcagccgagagggccgacaggcaagagaagacgcacagaacccaggagacgaagagagcaggagggagacaggcagaagacaagcgagagggacaacaaggcagcacgaaggcggagaagcacaaggcgcaggagagagacagcgacccaggagaggcagcacggacacacaggaacgacagaggccaaggcgaagagcagagaagcacaccagacacgaaggtaagacaaacaaaagaacagagagacaagcagtccaacagcgacaggcgacagcaacaaggcaacgagacagagcgcgacaagacaaagaaggcacgtcgggacagaccgaggaagtagctcaggccaacacaaagaggagagggagtcataggagcacagacggacgcgagaggcagcgacgaaggaagagtagacaggagagacgcacttaggagag

SEQ ID NO: 675267 - DNA, 592 bp, Homo sapiens
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaaaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 675268 - DNA, 631 bp, Homo sapiens
gggggcgcgggggcagaggtgacctggggctctggacttagacccaagggctagacaccccgggtctgactggtgggagagaagacgtaatgtgaagggggttggcaaccaagacgcgggaccccacttgcagtaccccccgtctgcggccggcgtcgcccacccgcagccgccggccgggcaatggcaccacctagcggacggcaccagtgcggggaccccagcctcgaggaggcgctcgtgccgggcggaggtggcgcttcagcaccgtcgtgggccggacagcgcctcccgcccccggccctcgaaacctggcttctggagcccagccgtagggaccggacggaagacaccgaaggaatggcgaacctccccggaccgctcctgacagttcccgggtggccttcggcctgcaaagtcggaatttgcacaccctccgctcgtccttccctgagcccttctgccctccttgcccagcccgggcggtgtgggactaagcagcgcgaggctgcagaggggcggtcacaagtgtgaccattcgcactgcactccagacgccggctcctcaggctttactggagagaagccccgaggagggctaggggcaaaagaggggccttctgcatctcca

SEQ ID NO: 675269 - DNA, 111 bp, Homo sapiens
aggtactctaagatccctcacgtgcattgtgggccattagtcatctcaaacagttttgaacccaggaccagaaaagacaggagggtggctgaggacacaacaccacgttaa

SEQ ID NO: 675270 - DNA, 330 bp, Homo sapiens
ggcaaggcagggtttcaccattttggtcaggctggtctcaaactcctgaccttgtgatctgcccacctcagcctaggagttaagagaccagcctgggaacatagactccacacaaaaaatttttttaattagctgggtgtggtggcatgcacctatagtcccagccacatgggaggctgagcgtggaaggatcatttgagcccaggagattgaagcggcagtgtgtggtgattgtgcccctgcgctctagcctgggcaacagcgcagaccttgtctcaacaacaacaacaacaaaaggctatctattgtgggtacactgcctatggggta

SEQ ID NO: 675271 - DNA, 300 bp, Homo sapiens
tgaacattcgtgtccttcgtgtcctcgtgtccttgtagccgtggtccttcagcatatctctgtgctgcagacaacacaccttcctgatggaggtgtccggtaagtttccaagcagtgccgtctctgcagtaccttgaccgccaggagttggtggttaggaactggctcctgaagtagggtgtaaactagaggactgttccagggactcctacccctacgcctagctctgagcataactagtgttcgtgtgtgtctagggaagagggagaataaccagtgggggacacgaatgatcggtag

SEQ ID NO: 675272 - DNA, 209 bp, Homo sapiens
cgccatgttcccaagaataggccggaggactcgctgcttgacgggagggatagctgacctatgctatagctatcttatacctagtgaaacagggacacaaaagtgcttcatatgaagatactaaggaacgatagagatacttgtagaacaagttagtatagagaaatagctgatagtatagtagagactagcttgaaatttctataata

SEQ ID NO: 675273 - DNA, 742 bp, Homo sapiens
  misc_feature (593)..(593): n is a, c, g, or t
gtattcaaagctttatatattcctagaccttgcttatctgttaaaaacaagacctagcatataacatatattagatgctcagtaaatatgtttaatgaataaaaccaaagttatcgtctggaatcataatacatgagttctaatacaccctggtagatagaattatctagttcttatacttttatttgttgttgagatggagtttcactcttgttgcccaggctggagtgcagtgacacgacctcagctcactcctgggttcaagtgattctcctgcctcagcctcccgagtagctgggattacaggcgcccaccacaacgcccggctaattttttgtatttttagtagagatggggtttcaacatattggccaggctggtcttgaactcctgatctcaggtgtttcacccgcctcggctcccaaagtgctgggatcacaggcgtgagccacacgcctgtcctagttcttatactttttttttttttttggagaccaagtcagctttgtcacccaggcggagtggcagtagtggacctcggtcactaaaaccttgtgtctcccgggtccacagtgattcttgtgaccacaggnccccgagatagctggctcaacgggtgctcgccgcaatgcctgctaagtttcgcattccacatcagagcggggtttcacgtggttaccaggatgtcccaattccagaccctcgttgttctgtcccgcttgggttctcaatttccgggtac

SEQ ID NO: 675274 - DNA, 1936 bp, Homo sapiens
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 675275 - DNA, 102 bp, Homo sapiens
  misc_feature (1)..(1): n is a, c, g, or t
nccctgtagatgagcagaaatcacatcgcgaaggcccgcggcgggtgttgaggcgatgtgatttctgctacatctcaggtactcctattacgtgtccggcca

SEQ ID NO: 675276 - DNA, 2875 bp, Homo sapiens
  misc_feature (1862)..(1862): n is a, c, g, or t
  misc_feature (2044)..(2044): n is a, c, g, or t
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccaggtaccccctcagcctgccacatcttcgagggccactggcagctgaggaatcacaggactttggaaagggcatggatgaactgggatggattgaggcttaaggaagatgtgggaggagggagtggacccacaagcacggtcagttctccggcggctgcagcagggcctgtgtgggaaggcttagagatggtgagtcaggagaggtaaggaggggtggaaactatgaccatatccttaaaaagataaacaacatgcatgtggatggctttgccaccaactagctgtgatcccaacctgttagatgggaaaaggaggtgccttcttggccaagtgaaagaaaggcttgctgtctgctctaagcccagggaaccaatggggaaagaataagctaaatgtgttaacggattccaaattacttaaagcctttatgggaacacggtagattgtaggtaactagatagggttgccagatcagtttgatttgactttcagtataatttttcagtatatgttccaaaaattgcatgggatatgcttatactaaaaaaaaaaaaaatgttgctaggctggacacggnggctcatacccgtaatcccagcactttgggaggccgaggcgggcagatcacctgaggtcaggagttcgagaccaacctgggcaacatggtgaaaccatctctactaaaaatacaaaaattagccgggtgtggtggtgcacacttataatcccagctactcaggaggctgagacaggagaatngcttgaacctgggaggcagaggtcacagtgagccaagatcacgccactatactccagcctgggtgacagagtgagactccgtttaaaaaaaaaagttgctaaatctggccgtcctaaactagatggcagactgagaaatgtgactcccctccccagtaccttgttttctgtgtccttgtagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 675277 - DNA, 173 bp, Homo sapiens
ggaagctgccggtctgtgtggatgctcggggggggggataaggtcacagatcaacaggatcccaaggcagaagaatttttcttagtacagaacaaaatgaaaagtctcccatgtcttacttccattccacacagcaccctggcgccattccggggtaccgacgctcgcaattc

SEQ ID NO: 675278 - DNA, 2323 bp, Homo sapiens
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttttaaaaaaaaaaaaaaaaaaaaaaaaaaaaaaaaaaaaaaaaaaaaaaaaaaaaaaaaaaaaaaaaaaaaaaaaaaaaaaaaagacagaacagagacagaaaaaaaaaaaaaaaagagacggggggggggcgccaatagaacgtcccgtccgggagcaacgacagagcgcgcgcgctttgtagacacaggaggcggcccacacagaggagggaggaagagataccaacagagaagagacgagcagcgcggcgcgccagtaaagaacgcgccgcgggggagcggagggaagaaaagctgtgccgcgggcgggatagctggggagaagggagacacacaccatcagggggagggggagacaaaggagggagaacacagcacacggagagg

SEQ ID NO: 675279 - DNA, 182 bp, Homo sapiens
atagcgcgcagctgttgagaatgttcgtggcatccgagccagcattgtcacacagctagcgtgtgataatctccaaggccttggcatatgccccagtcggcagctgctgtttcctggaatagtccgtagtatccctgcaggtacttagagagttccagctcttattgcccaggctggagtgt

SEQ ID NO: 675280 - DNA, 2124 bp, Homo sapiens
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccaggtaccccctcagcctgccacatcttcgagggccactggcagctgaggaatcacaggactttggaaagggcatggatgaactgggatggattgaggcttaaggaagatgtgggaggagggagtggacccacaagcacggtcagttctccggcggctgcagcagggcctgtgtgggaaggcttagagaagccgtggtccttcagcatatctctgtgctgcagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 675281 - DNA, 292 bp, Homo sapiens
attcctttcccctcagatttcggcattcccaccctatgggagaaattattatagttgccattcttaggatgtttcccagataaattacaggaatcataagattgctaaacaaatgtaggtggctaatagaaaaagagaagcagtaagcctacttttttcatttacttattcagcaaatgtttatcaggcatctattatttgataggctttgtactgatttctggcttgacaatgatgaagaaattagacatgcccctttctgagctaagaagataggcaaaagggttacaca

SEQ ID NO: 675282 - DNA, 1460 bp, Homo sapiens
gactttagagaggtgccaacggaacgttctccctggtgtattgttgttggggcccccagaaaccaccattttcctgccaccacgagagaacgacccaccgtggttttacccagggtcgcttatatgaaaatccttccagagattatggttgggccccccaaagacctcctgggagggtattcattgtagctcgaccgaccaccgcgttgttttgatccacacaaaaggagatgtgtccaacgcttggttaattacccgccgctcaagcgcttgtcaacacaataccccacagggcggttgttgtgttccatctaagacggggggacaccctttctgtcagagatgaaattttcaacgggggtctacaggggagaaattttgtggttcccaataaggcgagaatttggcggggattcaaaacaaatttgttccccagggcgacccccgcttggggcgacccccctgggctccttgtgaaacattgtggggggatctcccccccacaagagttgtaatattccgcctggtgtgtcgacgttgttcttccacaggggagatgttttgggggacaaaatgcgaaccctcgggtgggtttttttaaaaaaaacgggggagagctttttgaaaaagaaggcggggaaaaaatccttggtgtgacagcacgctgccacacaccgcaagggcggtttccctctgcacagacacgaagatggcccctcccgtttgttttagcacgcccgtgttttgtggcaacacgtttttgttgccgccccaaaggtttgtgtacacccacatgctcgagaggcttccaagaccctctttcaccacgacggcagacctcgaatagggtgtctctttcaccacgaggggaagggggccatatttctctagcgggcaaatatttcatattgggtaatcttgtttaaagagccacaagacaagacgtggcatatattctctctctctcaaaaatacatatctgggagattatatatggctctcgatcttgtgaaaagctcgttttaagtccccggcagtaattgtgtcccctcgaatagtggagaataatggtggcactttgtttgtcacactctaggcacacacaagtaccctcttctaaatttgcccagtagggccgctgaaaattggggctgtaagtaacctcaagttgtgaaagttcttctcccgcttataaactgaggtgtagaaatctgagattttctaaaagaagctgtaaactagttgtgaaagcggctctaggagagcaactttgccaacactttaatgagggagtacacctggtcatttttataaattccctcaccacctgtaagattaaagtgttttaaatttcttttgtagtcggaaccaacattaaccccgatttttacaggaaaccccgggttttatttggattgtttttctgtaaaagggttccaaaaaaactggagtgaacttta

SEQ ID NO: 675283 - DNA, 1904 bp, Homo sapiens
ggtggcggcgcgcgcagcggcaggcggcggcgggatggagcccgatcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctgggcagcttggtggctgccgagtggaggccagaagagggcttcgtggagttgaagtctcccgcgggcaaattctggcagaccatgggcttctcagagcagggccggcagcgccttcacccggaagaggccttgtatcttctggagtgtggctccatccacctcttccaccaagacctgccactgtctatccaggaagcttaccagctgctgctgaccgaccacactgtgaccttcctgcagtaccaggtcttcagccacctgaagaggttgggttatgtggttcgacgattccaaccaagctctgtcctgtccccgtatgagaggcagcttaacctggatgccagcgtgcagcacttggaggatggagatggcaagagaaagaggagcagctccagccctcggtccattaataagaaggccaaggccctggacaactccctgcaacccaagagtctggcagcctccagcccacctccctgcagccagcccagccaatgcccagaggagaaaccccaggagtcaagccccatgaagggcccagggggcccctttcagcttctggggtccctgggccccagccctggcccggccagggagggggtggggtgcagctgggagagtggcagagccgagaacggagtcacgggagccggtaagcggcgctggaacttcgagcagatctccttccccaacatggcttcagacagccgccacacccttctgcgcgccccagccccagagctgctcccggccaacgtggctgggcgggagacagacgctgagtcctggtgccagaagctgaaccagcgcaaggagaacctctccaggcgggaacgggagcaccacgcggaggccgcgcagttccaggaagatgtcaacgccgatcccgaggtgcagcgctgctccagctggcgggagtacaaggagctgctgcagcggcggcaggtgcagaggagccagcgccgggcccctcacctgtggggccagcccgtcaccccgctgctgagtcctggccaggccagctccccagacaacacaccttcctgatggaggtgtccggctgttggagaagtctgggggcttggaaatcatctttgatgtttaccaggccgacgctgtggccacattccgaaagaataaccctggcaaaccctatgcccggatgtgcattagtggatttgatgagcctgtcccagacctctgcagcctcaagcggttgtcttaccagagtggggatgtccctctgatctttgccctggtggatcatggtgacatctccttctacagcttcagggacttcacgttgccccaggatgtggggcactgacctcacagctctgcagaggatggagcttgctccgggggaccgggactgtctgttctcagggaccatctcggctgcctcctgtacccagactctaacctgtagcttcagaggccagtctgggccttggccctgggtgtctgatactcacagagtgaaactgtgaccctctcccttccctgctgccttgcagtgacccctctggaactcaggactcgattttaaggacccaggaggtggggcagaagagaggactgtgtgcctttaacgagagggtgcctgcttcgtgctataaagccaaagccattaaaaatagatttcttt

SEQ ID NO: 675284 - DNA, 369 bp, Homo sapiens
cgcttagaatggcgatcagaatgtcgatcacctcaggtgtaaaccagctcatcgtgccgcctcccgcagatgtctaccttagcacccaccaagatcggcgggatccctggcaagccgagcggcaaaccaacctggccctgggtcagggtttcactcagacgcaccggcagacgcagggtctggcccgcacagctgaactccaccaggctgcccgcgttgacgcctagcgtcgccgcgtcggccgggttgaccatcacgtaggcttccggcatgcgctgctggatcacgtgagagcgctgcgacatttcgtcactgccgaacaggtggtagtacggcgcgacacgccagccgtcgttcggattgaacgcg

SEQ ID NO: 675285 - DNA, 238 bp, Homo sapiens
gtctcccttcccccttttcggggggatttaggggtcaacattttttgtagccccggggttccccgggcttcccgtcattattggggcacctttcccccctttttgttttttccccccactaatttttccctttacatcccaacccccctttgggttttaaccccccccctgatactggccttttgtaaatggggtttgcctatttttggtggtccccctcttttgatgggggttttta

SEQ ID NO: 675286 - DNA, 861 bp, Homo sapiens
gtggacgtccccgtaagatggactgccagtgacacagctcgtgaggccttctggactgatcctaccaccaatcgtccaatgaaaagccgttgcgctgctctcaaggatgtctacaaaatcgggtattctggtactgttcctgtcgcccgagtgcgagactgatgttctcaaacccggtatggtggtcaccttttgctccaactcaaccgtttacaacggcacgtaccatctgtcgaactgcaccatgacagctttgacgtgacagctcttcctggggacaacgttggggcttcaatgtccacgaactgtgtctgtcacagagatgttacgtccgttgacaccatctgctggtgacctgcaaaggaatgaaaccaacccaagtggaagcagctggactccactgctcaggtgcttatcctgaaccatcccaggccatttaagcgccgtcctattgccctgtattggactgccacacgctccaaatgtgcctgacacagtttgctgagctctcgacggaaaagatcgctgccgcgtctggtaaaatgctgcgatatggcctaatcctggagtctgctgatgctgccattgtagatattgctcctggcaaaaccccagtgatgtggaaggtcccaaaaaatccacgtgggaccacgtgaacctgcggactcggacaacaccgcgatgggacaccaaagcagcgacagaagctgcggcaacgcaaagcccacgtgcaaaaacaaacgcaacgaaaacccagacagccccaccaacaggcgcaacaagccaacggggtatggcccagcagacacggcgacagacgaaccacaaaagtgccagcactggcaacgcgcaaagcctaac

SEQ ID NO: 675287 - DNA, 354 bp, Homo sapiens
ctatgtcctgtactctgttgcaagaggacaacttattacatatactcaactaaggcactattaccacaaattattacctggagtagccagattcttaagcttataggcttctttaattctaggcgcatgaacaccaaccaaaggtgaaggtagagcaacttgatggaatacttctggtgctatagtacaacttgtgtgaatatttagtgctcagagcattactactttcctttgtatgggtaggaggtgctttatattggttgtagtagtatgtctccaaaggaacctttcatcagttagtattcatgctttatatagctcagtataaggcagccctaattctacgagacggta

SEQ ID NO: 675288 - DNA, 272 bp, Homo sapiens
  misc_feature (192)..(192): n is a, c, g, or t
gtctgctggaagctggtgtccgcgaccaccctttcccgcaggtgcgctgtcccagggaaatgagagtgttttttctataagcccgtgagtggggctgctgctagtctttcagagatgccctgcccagagaggaggaatctagagaggcagtctggctacaacgtttttgctgagctgtggtgggctctgctngttcaaatttcccagtggctgtgtttacactgtgaagggaataccacctactgaaacctcagtaatggtggacacccttc

SEQ ID NO: 675289 - DNA, 870 bp, Homo sapiens
  misc_feature (474)..(474): n is a, c, g, or t
  misc_feature (490)..(490): n is a, c, g, or t
  misc_feature (492)..(492): n is a, c, g, or t
  misc_feature (506)..(506): n is a, c, g, or t
  misc_feature (519)..(519): n is a, c, g, or t
  misc_feature (539)..(539): n is a, c, g, or t
tgctacggagctcaggcgagggaccctacagctccctggtgtcttgccgcaaccaccaggaacgtggccattgagccagtgcagtctgtacttcgaatgtccgtctcctccattgggtgacccacgctagattctgtgagcattgaagcctggcatgagagccgaacggctgatgatctcgaggctgtactgcatggcgtgatctggactggctcgacagatgcacgaaccgagcttagttgggccctcatgcatgcagacacgtgcctggttgtacacgcctaaaacatcggattgctgcgttattgatgaatccttcgggaatcctcgatcccttaccgctataacggtgaatggcgcgcaacggggccggctgggggcctgagctgggaggccatcatcaacctggccacccagcccaagaggcccatgtccatccccatcatccctgacatccctatcgtggacgcccanagcggggaggactacnanagcttccttatgtncagcgatgacgtnctacgctctccatcgggcanccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccagcctcacacgggactacaactcactgacccgctcagaacactcacactcgaccacactgccgaggggactactccagcctcacctcgtctcctcccatgggctccctcccatctgggaacacgggagggagcaggcttccgctgtctgggcctggggtccg

SEQ ID NO: 675290 - DNA, 140 bp, Homo sapiens
atggctagtgtattagtgggtgtagtgcgatgagcggacgtagtgacatggagtgtaaccagtgcgatggagcaggggtaagtgctgatggagtggggcaccaatgtcaaaggagcgggtcattagtgccgctggagttg

SEQ ID NO: 675291 - DNA, 680 bp, Homo sapiens
  misc_feature (241)..(241): n is a, c, g, or t
  misc_feature (315)..(315): n is a, c, g, or t
  misc_feature (331)..(331): n is a, c, g, or t
  misc_feature (333)..(333): n is a, c, g, or t
  misc_feature (347)..(347): n is a, c, g, or t
  misc_feature (360)..(360): n is a, c, g, or t
  misc_feature (380)..(380): n is a, c, g, or t
gaacagatatttctccagtcctggaagggaggcatgggagctattggcgcccatgaagaaagtgctggttgatcaaccctagagatccgtgatgctgcttattgagaaccttcggtagtcccgagccctactcgtctagcactgcgtggaatggcagcgacaagcagggtgccctgcgcttggaggcgtcgctgacgcgaggtagcgccgatcaactcaatccctgtgaacatctcgcagngcacaagcatggtgccagtagctccgattcgccgcgatcagtctccatgaacagtccctatcgtggacgcccanagcggggaggactacnanagcttccttatgtncagcgatgacgtnctacgctctccatcgggcanccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccagcctcacacgggactacaactcactgacccgctcagaacactcacactcgaccacactgaccgagggacatactccaaccgtcacctccgtcatccttcccaacgaaatctccgcctgactgctggtgtg

SEQ ID NO: 675292 - DNA, 899 bp, Homo sapiens
  misc_feature (474)..(474): n is a, c, g, or t
  misc_feature (490)..(490): n is a, c, g, or t
  misc_feature (492)..(492): n is a, c, g, or t
  misc_feature (506)..(506): n is a, c, g, or t
  misc_feature (519)..(519): n is a, c, g, or t
  misc_feature (539)..(539): n is a, c, g, or t
tgctacggagctcaggcgagggaccctacagctccctggtgtcttgccgcaaccaccaggaacgtggccattgagccagtgcagtctgtacttcgaatgtccgtctcctccattgggtgacccacgctagattctgtgagcattgaagcctggcatgagagccgaacggctgatgatctcgaggctgtactgcatggcgtgatctggactggctcgacagatgcacgaaccgagcttagttgggccctcatgcatgcagacacgtgcctggttgtacacgcctaaaacatcggattgctgcgttattgatgaatccttcgggaatcctcgatcccttaccgctataacggtgaatggcgcgcaacggggccggctgggggcctgagctgggaggccatcatcaacctggccacccagcccaagaggcccatgtccatccccatcatccctgacatccctatcgtggacgcccanagcggggaggactacnanagcttccttatgtncagcgatgacgtnctacgctctccatcgggcanccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccagcctcacacgggactacaactcactgacccgctcagaacactcacactcgaccacactggccaaggaataattccaccttcccttcggtttcttcccagaattttggcttaatggttggggggccgacaaggcccaccggctggtgttttttgccctggggcccacatctttcagagttagctggcagga

SEQ ID NO: 675293 - DNA, 868 bp, Homo sapiens
catggtggcgggcacctataatccccgctactcaggatgctgaggcaaggagaatcacttgaaccctaggaggcagaggttgtagtgagccgagatcgcaccgatctgctacttccgagcctgggcgatcagggactaatgactgtctctaaacttaataaataaataaataaatccaaaatgaagctacatgatgaagactgacctaatggacacagcatttgtaggacaaactcaacgatgtcgtaacactcccagatatactcggggactacgtgaagtaaatacttgagaatatttctagaagtttgaggaaactatatagttctcactatgtaacgcccactagtcacgtgcgaagctcaattgagacccagatagctacgcttaaacacaaagctaagcacgctgaggcccatcacagtcaatagctgctgagaacctagtgactcaagtgcaaatctcagaagcacagagaggaaaacgagtcaccgttacatatgcaggacgcagatgatagaggatcgacaagcgtgtttgactcattcacaaaggctggagaggccacgacaagaagatgaccgatgatgctcgaattgccagacagtaaatatctttttaaaactaaggcaactagagatttcaagaccagatagctaccttgagccttacaaggaacattgtttaaaaggcaagttccttgaaggaacacggtacaacactacactacccaacattgaaacactgtcggattcctacacagaagcgcaattcggagagccaccaccaccattgactaacagatgttggggtcaaagaccttgtatgtatagcgtcttctacaacgatatttccgcaatttaaagac

SEQ ID NO: 675294 - DNA, 924 bp, Homo sapiens
tcagggtttgatggtctaaaccgggttaccaaaggtggcaccatgggcgtcaccagcatcttcagtcggttaaacttaactatctgccgtgtcaatcgcgatagtttaaacttgttccgctgcagacttgctatcagtatcacaaaattgttagtatcagcgaccctcagccagtcccctcaccagttgatggggtaccagaatgttagaagagtgtccagaacgaatataaggtcttgttgcgggacagagcttcagcaaacttggtgagtctctccaatcagcagagagagcttcttgccacagcaccgtggtcaggacaaacttcctcaagccttgaccacttgtgagtgacatcgtgaatcaaacaggaccagactctggcttgaacctgcagaacaacatggctgactagggaaacttggacctttcggaagaagtcagcatgtgattgctgagcagtatcatactgtgttgaaactccaaggccaggtgttctgccaaaaagcgccttggtaccaaccaggattaatcagcaacctataaccaacgaaccgaccagggatagaaaccatgtcctgtcgagaatgttacgttccccgaacaccaacttgccaaagcttcaacagactgcagccccttatgcccggatcctatcgctcatcggcgttccccatttagctccaattctgggcctgtttggcaaaaagtactaaggcgtgtggggaacagagagagaggcgagtcagtgccccctgaggtgcggtcatgctactctcctgaagaaataggtctcttttatgcctttaccatctatcaggaattatatccaggatgctaatactcagacatctagcttttttctcacgttttgtattataaccacctatgtaatctcatgttgtgatatcttgtgtattacta

SEQ ID NO: 675295 - DNA, 223 bp, Homo sapiens
gctcgacgggattttgataagagcaaaccacacttgaaaaaagtatttttgagaccattgaagaatttgattgtggctcagtgcagtggctcatgtctgtaattccagcactttgggaggctgaggcaggagaatcgcttgaacctgggaggcagaggttgccgtgagccgagatcgcgccgttgcactccagcctgggcaacaagagcaaaactccatctcg

SEQ ID NO: 675296 - DNA, 763 bp, Homo sapiens
acacccagaggtccccttctcgccgtccgcctgcaactgcgaggtgtatgcccggggccgcttggatgtcgcccggacctgatgaggctgctgcactgggcctcagccagccctctcggatgctggtgctgccactcccgcctgtccctcaagcctctggctagtttgtcctccgatggagaccgatggatgggcccgtccccgtcggagcttgccggctccccagatacctggaccttccttcctccagtctgagctcgtccgcgcatggcttcatcgtcctccagaggccgcactccactacctgcgttattggacgactcagggtgtccccatacgacagatgcgtggtggacgaggagtcacagagggagccaggggccagtggggctccaggggcagaaaaagtgctacagaatgccccgtgtgctcaagggtcttcgagtacatgtcctaccttcagtgacacagcatcacccactcggaggtaaagcccttcgagtgtgacatctgtgggaaggcattcaagcgcgccagccacttggcactggagcattccattcacctggcgggtggtgggcggcccacggctgcccgttctgccctcgccgcttccgggatgcgggtgagctggcccagtcatagccggtttgcactcgtgggggaacgccagttcagggtccacactgcctcgccgttttggagcagacacctgctaaccaatgcggtggagctcctgagccggctgccggttgcccagtac

SEQ ID NO: 675297 - DNA, 130 bp, Homo sapiens
gtaatagcaaatgtcaggttaaaattgtatgtatcatctcacacacagtgcagatgtctgtgaatattgagttcaccaaccattttttcagttaaaaaatatttcaaaaacattttgaacaaacactcaa

SEQ ID NO: 675298 - DNA, 215 bp, Homo sapiens
ggtggcaaatagcaagagaattagacttagaagtggaggctaggccaggcgtggtggtttcaccatgttggtcaggctagtctcaatcccctgacctcaagtgcatccgtccgcctcggcctcccgacgtcctgggcattacaggcgtgcagccaccgcgcctggtccgtcttcttaagtctttctagattcacgttagcgtacacatatgcctt

SEQ ID NO: 675299 - DNA, 175 bp, Homo sapiens
ttatgtcgagtcctttctagagccttcagagattcaatgctaaacaaatttccttacgttggcatgaaggccctggacatgaccagaacgtttctggcctgggttttgtggtcatctacttctatgcagggaacactaaccggtggaaataacaagattttctacttatggaaat

SEQ ID NO: 675300 - DNA, 416 bp, Homo sapiens
  misc_feature (386)..(386): n is a, c, g, or t
ggcacgagaactggagaaagaggttcacggttaggtaagattgggtataagggaagtcctcactgcctaactggagctcccatatctgctctcaacatttaaaagcactttggccattgatgattgttcactttggattatgttcaaaatgtaataatcttgttttaaaaatcgccccccaccccggctgcacccagcccagtcagtatgagctgtactgaactgaagtgcattgccttgtaaacacaggtaaaatttcctatctgaattgttgagctcttttggttcacacccattgatgcctttcctgttcctaattgacctttttgaaaacctcacaagctgttttggtacaagttccacctcaattcaaaggaaaatgatantttaccttggttacaacattggaaagggga

SEQ ID NO: 675301 - DNA, 407 bp, Homo sapiens
ggggtgaggtgggctctgcaggtgcgaatggtccacacacacacttgtctgcgtaggcgtgctcagcacagctcagcagcagcgaagagcacctccgcacctcattctataagaacctggacacggctctcctcaccagcgtctccagctgcacagagaaaggactgctctctaaagggtgaagatgaagatgacattcgcgagtcgttcttgggagcatcagctaccactacagccgcctcgcactctcagggatgcagctgtgatggagaggttgggtatataaattaaaaagtagaaagacagcaggcaccaagaagagagagcccacacaccacacgagagggaaggcactgcctctcctcccactatcctccacatggacacagcaacctagagtgtcccct

SEQ ID NO: 675302 - DNA, 474 bp, Homo sapiens
ggacgcgtgggtcgacccacgcggtcgcagtatggctgtagccaggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggttagggcagaggcctcagagggccctagggacagactgacccaggtctgagcctcttgggagcgtgcggatggccggcctcagacaggctggttgtgg

SEQ ID NO: 675303 - DNA, 323 bp, Homo sapiens
ctagtttctgactatccttggatatggcatgatgagagacactcctatataagagagtcaagcgtgtgggaataaaatagtctcattcccacagtcagaggagaagagacatgtagcttgaaccatcgtccttcctctcaagctaaccagagggtgcagagcctaaggaagcgtggcggtagcagatcgagtaatggtcactaggtccatgacccactcccataagctcagagttgcaagaggtccctttctcttcttctcgcaggtccttcctttagtggctggttgttgcaccatctgcttggttggctgaagcgtgacat

SEQ ID NO: 675304 - DNA, 387 bp, Homo sapiens
  misc_feature (365)..(365): n is a, c, g, or t
atgtgggaggctgggcgtgggggctcatgcctgtaaccccagcactgtgggaggcgtgggcgtgggggctcatgtgtgtaaccccagcactgtgggaggccgggcacgggggctcagcctgtcatcccagcactgtggaggccgggcgccgtggctcacgcctgtaatcccagcactgtgggaggccgaggggggcggatcgcctgaggtcaggagtttgagaccatgcttgccaatatggtgaaccccgtctccactaaaaatacaaaaattagccgggcatggtggacacgcttgcaatcccagcactttgggaaggtgagggcgggcagatcacaaggtcaggagatcgagaccatcctgtncaagatgttgagaccgcgtctc

SEQ ID NO: 675305 - DNA, 558 bp, Homo sapiens
  misc_feature (3)..(4): n is a, c, g, or t
  misc_feature (34)..(34): n is a, c, g, or t
  misc_feature (73)..(73): n is a, c, g, or t
  misc_feature (92)..(92): n is a, c, g, or t
  misc_feature (143)..(143): n is a, c, g, or t
  misc_feature (145)..(146): n is a, c, g, or t
  misc_feature (190)..(190): n is a, c, g, or t
  misc_feature (195)..(195): n is a, c, g, or t
  misc_feature (197)..(197): n is a, c, g, or t
  misc_feature (200)..(200): n is a, c, g, or t
  misc_feature (214)..(214): n is a, c, g, or t
  misc_feature (404)..(404): n is a, c, g, or t
tannagaaattaccctcactaagggacaaaagcntcaaaagctgggcggtgcgaccgcgcggccgctcgtggntcccccggatctgcagggnttcggcacgagcccgggttccggcgcggggctctcatagtgctggagggcntnnattttaacgggaagagcacgcagagccgcaagctggtggaccanttgtncncgngggccaccggcacngaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcatttnctggtgtggccttcaccggtgccaaggagaatttttccctagattggtgtaaacagccagacgtgggccttcccaaacccgacctgggtcctgttcctccagttacagctggcggatgctgccaagcgggggagcgtttggccatgagcgctat

SEQ ID NO: 675306 - DNA, 127 bp, Homo sapiens
attagggagggttattgccccaaccattgcaatgggaggtggagggacaaggcttcagcctcctcattgtctaaatgaggcctaaatgtgtgaagtgcgatttctgcaaacctgtcaccccaccacc

SEQ ID NO: 675307 - DNA, 369 bp, Homo sapiens
  misc_feature (29)..(29): n is a, c, g, or t
ctagacgatccgcgttaagcacaccccanccttaatagtacccatgcgctacataaagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtccaagcttcttggcaagttattccgggt

SEQ ID NO: 675308 - DNA, 271 bp, Homo sapiens
  misc_feature (3)..(3): n is a, c, g, or t
  misc_feature (6)..(6): n is a, c, g, or t
  misc_feature (8)..(8): n is a, c, g, or t
tcnccngngccctttcaggatgaaagctgcggtctgaccttagccgtctcttcctgacggggagccaggtcggcatttctggcagcaagatgaacccccccagagcccctgggatcgagtgaaggacctggccactgtgtacgtggatgtgctcaaagacagcggcagagactatgtgtcccagtttgaaggctccgcttgaggaaaacagctaaacctaaagctccttgacaactgggacagcgtgacctacaccttcagcaagctgcgc

SEQ ID NO: 675309 - DNA, 502 bp, Homo sapiens
gtcgacacctaactcccactcccaacctcaacctaactcccactcccatccccaacctaactctcacccccaacctcaacctaactcccacccactcccactcccaacctcaacctaactcccaacctcaacctaactcccactcccatcctcaacctaactcccactcccaacctcaacctaactcccactcccaacctcaacctaactcccactcccaacctcaacctaactcccactcccatcttcaacctaactcccactcccaacctcaacctaactcccactcccactcccaacctcaacctcactcccactcccatccactcccactcccaacctcaaccgaactctcactcccaacctcaacctaactcccactcccaacctcaacctaactcccactcccactcccaacctcaacctcactcccactcccatccactcccactcccaacctcccactctcaacctcaacctaactcccactcccgtcgacgcg

SEQ ID NO: 675310 - DNA, 889 bp, Homo sapiens
  misc_feature (3)..(3): n is a, c, g, or t
  misc_feature (167)..(167): n is a, c, g, or t
  misc_feature (187)..(187): n is a, c, g, or t
  misc_feature (192)..(192): n is a, c, g, or t
  misc_feature (205)..(205): n is a, c, g, or t
  misc_feature (250)..(250): n is a, c, g, or t
  misc_feature (279)..(279): n is a, c, g, or t
  misc_feature (305)..(305): n is a, c, g, or t
  misc_feature (347)..(347): n is a, c, g, or t
  misc_feature (366)..(366): n is a, c, g, or t
  misc_feature (373)..(373): n is a, c, g, or t
  misc_feature (491)..(491): n is a, c, g, or t
  misc_feature (511)..(511): n is a, c, g, or t
  misc_feature (571)..(571): n is a, c, g, or t
  misc_feature (659)..(659): n is a, c, g, or t
  misc_feature (688)..(688): n is a, c, g, or t
  misc_feature (764)..(764): n is a, c, g, or t
  misc_feature (780)..(781): n is a, c, g, or t
  misc_feature (800)..(800): n is a, c, g, or t
  misc_feature (882)..(882): n is a, c, g, or t
gtnattattcaaaaacagtaaaaagctgagattctaccaaaactaatatatccatgtgggagaagagatacagtagggacagaaacaactcctgaccacattagagttaccttttgagccgcgtcattaggaggcaatactgtaaaactagacacaggtctcccgcngtgccactaggctcacccanaagantagcagagagcangaaaaaaaaaaacttctataaaagaatcatgctgagacacaagancagagagggagtgacattgcaaactcganagaggcagggggcctgggagacaggngtgctccaaagggcacccaacaccatcccccccctgatttcngtgacaaaagtggaaagcnacttgcntggagggactgggggaactgaggggggaactttcatcctgttaggaactccgctttccattcctgcgactactgtctagctcccagagagaaggatggatcacggagggggccacagncagcggggagcagcaggaantccctacggcacaagtctacagggggaaggacgcactgtgcgggcagcggtggcacacanggccagtctgacactgtaaccacaggctgggatgtagccaggacttggtctccttggaagacaggtctgatgtttggccaatccagtncttcagaccctgcctgaaacttgtatctnacgtgaacttaaagaataaaatgcatttctaccccgatctcgcccccaggactggcacgacaggcccacggcagantagatcttttcccagnnctgatcggtgcgtggaatnccagccaccacttctgattcgattccacagtgatcctgttctctgagtattttaaagaagccattgtcacccagtcagtgtncaggagt

SEQ ID NO: 675311 - DNA, 477 bp, Homo sapiens
  misc_feature (118)..(118): n is a, c, g, or t
  misc_feature (178)..(178): n is a, c, g, or t
  misc_feature (273)..(273): n is a, c, g, or t
ggggggggggggtgtgtgggggggggtgggggggtgggagggggggggggggagggggtgtgggggggtgtggggggtggggggatgggcggggtggggaggtgggggtgggtgggtngtgtaggggtggggggggtggggatgttaggtcttgcggtgggggggtgttgggggggtngggggagagggggggggggcgttgggggtgggccgggggtgtggtgtgggggggggggggtttggggggagtccgggggggtcttggggtagggntggcgttgagggtggggggggcgggcgtggtgggggcggcccgagtgtccctggggaagttggccccaagccaggggggggcggtccgccccccccattaaaacattaaaaccctcattcacagggggaaaccccctcagggtcaaacccctatccccccattttcctcctatccctcaacccggacatcattacgggggtttc

SEQ ID NO: 675312 - DNA, 517 bp, Homo sapiens
cagattattttaagctgaaggaacttgaggaatgacatgtacaggaagcactttttgacctttctctgaagcaggtcataaaatctaggaataattttctaaccttcttttgatgcaggtcataaaaccctcatgcgaaagatgccctccctatatccagaggaaaggataaagtatctgaacagttaggcctgtttaggcctaactttctccaatttgttacactgagctcatactttttctttgtcctattatatttctccatgactttcctctcttcatcaaaccaagcataaaaacattcaggtttaaccacttcttcagatcttcctttccttacaaaggctcccatgtcacataaaaaataaatgtgtatgtttttctcttgttaatctatcttttgttaccagggccccaagccaacgaacctaagatgggtagaaggaaaagatgtatttcctcctttatacttttaaaaattaaaaaaaaatcccaaaataaaaatctctgtttaaaa

SEQ ID NO: 675313 - DNA, 125 bp, Homo sapiens
actctagagcagcttatcactgggatgaggacgtcactgggatgtggaacgtcactgggatgaggaacgtcactgggatgaggaacgtcactgggatgaggaacgtcactgggcaggcggcgcct

SEQ ID NO: 675314 - DNA, 859 bp, Homo sapiens
ggcccgggacccgggctttctgtgaaacatggcggtaggctgggaccataacacaagcatgactatatgaaggaagaggaaggtttcctgaagatgaggcgatgaatcggaaaaaaactttaagttggtaaaagagtgggatgcctttccgagggttcctgagagctatgtagagacttcagccagtggaggtacagtttctctaatagcatttacaactatggttttattaaccataatggaattctcagtatatcaggatacatggatgaagtatgaatacgaggtagacaaggatttttctagcaaaattacgaattaatatagatattacgtgttgccatgaagtgtcaatatgtgtggagcggatgtatgggatttagcagaaacaatggtcgcatctgcagatggttagtttatgaaccaagagtatgtgatctttcaccacagcagaaagagtggcagaggatgttgaagtgatcagagtaggctacaagaagagcatcacttcaagatgtgatcttaaaaggtgtttaaaagttcataaaggctcttcaccaagagagatgattctcagggtctccaaaatgctgcgaattcaggcaatcattatgttacttacgtagcggggaatttcacctttacgggggaggcaatcacattcggggtcgtcacttggggcctgttaccaggattttacttctctgaaagatcacgtgttggaacggcccgcaattaccttaaggagcagaagtttatatccaccagtgccttttagtgggccgcatattttattacccccgtttgtgggaatacacacgccggcgttaataaacgggccagcagtaggtcacaatat

SEQ ID NO: 675315 - DNA, 335 bp, Homo sapiens
  misc_feature (230)..(230): n is a, c, g, or t
  misc_feature (246)..(246): n is a, c, g, or t
  misc_feature (276)..(276): n is a, c, g, or t
  misc_feature (324)..(324): n is a, c, g, or t
tgtcttcacttccttggtagtgtcttgtaatacacaaagttttaaatttttatgaagtcaaatgtatctacatttttctttggttgctcatgcttttggtgttgcatctaagaatccactgccaaatccaaggtcatgaagatttactcctatgttgtcttctaagaattttatagtttttgctattacataaggtctttgaggccattaagatctttggacttaacttntgtatatggatgtaangtcactgtcaaacatcattcttttgcattngggctgtccagggtatcccaggcattatttgttggaaatgcctacacntctttatattc

SEQ ID NO: 675316 - DNA, 132 bp, Homo sapiens
catgtatatacggtgcgcttccaccctcagcggatataatctcaagacaccttccgagcgtcagttcactacccttccaccctacagctccaccctcagcatgatgataatatcaatgacacctgccgagcc

SEQ ID NO: 675317 - DNA, 225 bp, Homo sapiens
  misc_feature (10)..(10): n is a, c, g, or t
  misc_feature (23)..(23): n is a, c, g, or t
  misc_feature (50)..(50): n is a, c, g, or t
  misc_feature (77)..(77): n is a, c, g, or t
  misc_feature (213)..(213): n is a, c, g, or t
  misc_feature (219)..(219): n is a, c, g, or t
ttgccccccnatcccgtaggggnccaaaagcccagctgcatttcccttgngaccgccactaactctgttttctgcanagttgtcttccctgcttctgtagtggtgagctgtgggaaacttttttttttttttttttgatgagtctcgtctgtcaccaggctggagtgcagtggcacaatctcggctcactgcaacctccgcctggtgacagancgagantccatc

SEQ ID NO: 675318 - DNA, 172 bp, Homo sapiens
atatatcttaaatactgtaagaggcatatctgagagtatactttaaaatatacaggcagtataaaataacttgtgcttggttggcaaatgaaaaatgatgcatgtattattattattttttttaaccaagcttgaatgtatccttactataagcttaaaaaaaaacaattct

SEQ ID NO: 675319 - DNA, 231 bp, Homo sapiens
  misc_feature (71)..(71): n is a, c, g, or t
cacccaagacgaaaccaccccaaagaaaaatcccagaacagaccaagaacaagcacggaaagggaggcagngaagaacagcctacaaaccaaaaaagcccagacccagacagagacacagccaaaacctaccagaggtacaaagaggagctggaaccatgcaaccggaagcgatcccaaacagcagaaaaagaaggaagcccccctaactcaataaaagaggccagcatca

SEQ ID NO: 675320 - DNA, 144 bp, Homo sapiens
tacctatctcgttaggcaagactttgcctctctcctagctactgagtataaatcctgtgtatagattcctctagaaaggcatacacaaggctcaacagcactagaatggcctctatgatactgcgacaaattcacgttgcaact

SEQ ID NO: 675321 - DNA, 452 bp, Homo sapiens
tcatcacggacaatcagtatgagatggtgtacggagaagtctttcaagaatgacggaataagagacctgtaataaaaaggaactgcagcaatctttgaaagacttccaaagaatgtatagagcacagtacgtaatacacttgccctgctccctctaccccttaccccacaaagtgcaactgacactcccacccagtctctgctccaccttacagaccacgtcacgtgtagtgtccattatgtgaagccctgttgtgccacagagtgtagccaggtcaccctgcagatagtcctagtgaacctcaccccgaggccctgcatgggccagaccctccatatgtacttggtccaactgcaactcatcatcggtgactggtaatcacaacatcgctgggccctttgggacctgcatgtaatgtgagaggctcaagaaagctcctcactgtggtaaat

SEQ ID NO: 675322 - DNA, 164 bp, Homo sapiens
ttttttttaaaactccccccccccccccctcccccccagggggggggggggttccgggccccccggggggggaagggggggcccctagggggggggcccccggccccttttcccggggaaggggggcagggccccccaaaaagggcccttggggggttttttta

SEQ ID NO: 675323 - DNA, 852 bp, Homo sapiens
cgggaggctgaagcaggagaatggcgtgaacctgggaggcggagcttgcagtgagcggagatcgcgccactgcactccagcctgggcgacagagcgagactccggctcaaaaaaaaaaagaaaaagaaaaagaaaaaagtggggtataagctgggcaaggtggctcatgctcgtaatcctagcactttgggggaccaaggcaggtggataacttgagcccatgttcaagaccagcctgaccaacatggagaaaccctgtctccactaaaaattacaaaattagccgggtgtggtggtgcatgcctgtaatcccagctactcggaagtttgagacgagaatctcttgaacccgggaggcggaggttgtggtgagccaagatcgtgccattggcactccagcctgggcaacaagagggaaactccgtttcaaaacaaaaaggaaccacgaaacgaatttgagaagtaacgcctcataatattgtgtccccagcttttaactttgaagctggttgcataatctggggaatagtcataattccatgtgttataacagtttaaaaagcctgcaaaagtgacttggcttgttactttctgcctcagattggactattttaaccaatatggtcgcgactagatcatagctcctagctgaataccttgagggtgtttcacaggttagggtctattaccacgaatttacacataaggccccaattttaacttgtatggatatcgtgatattgcctattctaataccatcttaatggcttaaatgctgccagataaggaatctgccaatttcacagttgaacacctttacacaggttgaaccatgaactcttccatgctcag

SEQ ID NO: 675324 - DNA, 158 bp, Homo sapiens
gacttcatttggtcaggctttgggaggaagtaaacagattgaaaaccaagtttgcttatcaacagactagtcaagataaattacgcaaaaatgagaaaagacactctgcttcattctgctagatttgaagtgaaaactttacagagacacaatgctga

SEQ ID NO: 675325 - DNA, 220 bp, Homo sapiens
agcggggaacaatcacttgaggaacatcacttaggaacaatcacttaggaacaatcacttaggaacaatcacttaggaacaatcacttaggaacaatcacttaacgggaagtgatggttcccgctaagtgatggtccccgttaagtgatggttcccgctaagtgatggttcccgctaagtgatggttcccgctaagggatggttcccgcggggtaccgag

SEQ ID NO: 675326 - DNA, 303 bp, Homo sapiens
  misc_feature (25)..(25): n is a, c, g, or t
  misc_feature (250)..(250): n is a, c, g, or t
  misc_feature (277)..(278): n is a, c, g, or t
gcccaggctggagtgcagtggtgtnatcttggtcactgaaacctccgcctcctgggttcaagtgattctcttcctcagcctcctgtaatcccagctactcgggaggctgaggcagaagaatcgcttgaacccaggagggggaggttacagtgagcggagatcgtgctactgcattgcagcctgggcgagagagcgagtctccatctcatataaaaaaaagaaaaagaaagaaagaaagcttgtctgttgngctgcctgcagggtggagttcagaggnnaaggtcaggagcctagtgacagctc

SEQ ID NO: 675327 - DNA, 409 bp, Homo sapiens
  misc_feature (12)..(12): n is a, c, g, or t
tgagacaggaantcagagccgagtgtggaagcagttggggtggggggtctctgacttgctcaggacaaactaggccaggggtttgcaaacgggttggcagagccctgaagtttcctaggggttgcctcaggagtccttggggagatgaagggggtggggagccgagcaggctgggcaattggccctcaaacagaacagctccccttgtagctgtcttacatatgggggttcagggtaagattttatttgcattaaggggttggctgctgaaaaaaagtgggaaaaccacggactagaccatcggctccaaatgggagtctgtgcttccttccccaggtatggagcacactcttcaccctaccctctaccacaggacacttgggatccagaggacacttggcatccagag

SEQ ID NO: 675328 - DNA, 220 bp, Homo sapiens
aagtctacaatgctctcgtttcctatgcatattgtctcatatgcatggtactgataacctagtgcgacgcagggatctcgtatagctgtaccatatccccaattcccacaatgctctcgttccctttcatattatcccatatccatggaaccgatagacatagatggcgacgcttgtagatcaggattcctgctagagtcagtcgcggtccgacgctcga

SEQ ID NO: 675329 - DNA, 404 bp, Homo sapiens
taaggatctctctgctcctcttcagtgggggctgtatacctgggtgaggaggagctcctgcatataccgatgggccaggaccaggcagcagaagaggccaatgcggtgctggggctggacacccgaggcgatcacattgtgatgctgtctgtgattcctggggaaagctgaggaccaagttgagttcagagcctagcggggtcacctgtggttgcttggaggagcggaggactcaaggtgccacgtccgagaaaagccttttctctctgggattgggctggagcacactttcctgacagagaagaggagtattacacagagccagaagttggggaatctgacgcagccccgaacagaggactcccaataaacactgaaagtctgaaatccccaaaggtgaactg

SEQ ID NO: 675330 - DNA, 829 bp, Homo sapiens
taacagtttaaattttaactatgtcatgtaagctataaatatttcactttaaaattagaatttaaaaaataaggaatttcaagagagctgacttaggcctggacatctgagtagacgtaacaaatcaacaaaggaataaaatcgtatgaatttcattctatattctgcctatacctacctgaatttgcccacctcctaacacaatttctgtctgtctgtcatctatctatctctcactcagtctctatctacacacacacaatatgtatgtatgtatgtgtatatatatgtgtgtgtgtgtgtgtatacacatatattttaaaagtttatttctcataacaattttcccagagggtgtaggcaaatatggtgcgtatgggcagagaaagaatggggagaaaaatcatatatacacacacacatatatatataatgtttggggccaaaacatgtaacatagctgagtttagattaaagaagtagggctgaatgaccaagcacaatatgagggcactgaaaagttacatagcaaaagacagtgatccagagaaagttgaaatttcgaggctgtgtgtgataaattcatcctccatcatctctcatcctccgtgcttccaacattatcagggttttgagatcatttccattctttttctgtactgagggttcattttcttgcttcaataaagtggattctctaatacctttgtcagaaggggtacataagaaatggtattccctctgggaaataaatgttgtgggagtacatattttttttgaagaattataggatatgggaccattattatctagaattcagaaatggtaa

SEQ ID NO: 675331 - DNA, 199 bp, Homo sapiens
cactcacttgtctacgtccggctgctttttgtctttttagtcagcagcggggttcacctgcgttgggctggcatggtctctctccgtgcacttgtgatcccaccacccttgcctcgccgcgtgctgggcttgcaggcgtgcgtgcagtggccgcggcctgcttatcttttttcattgtccagaactcatctcgtggcct

SEQ ID NO: 675332 - DNA, 1115 bp, Homo sapiens
ggcccctcgtctggcccccaccacgcctgggacgaggagcccaatgccactgctctgctctgcatgtactgatgacactctccgcacagctgatgtgactcatgacacatggtgcggtggtgtgtgtgtgtgtggtgtgtgcgggggtcggggctcccaaggagaacgccacagagaaaggtgcccttgagggagaactggtggggttggcgagaatctccaccactagaccacaaggagaggaggagagccccctgtgatgtccgcagcactagtggcgcctatcaccactccagctcttggccgcggcaccgaagagcgcgccggcgaatctctctttggcccgctggtctatagagcgcgcctttataacacataagagactcctcgtctcgcgctacgcgtgacgtgtgggcccccgtggtgccacaacgagcactcttatcaaccgcggagggggcgagagctgtcttcaacgcgggagagcgacccgcgggagaaagagaggagagggggcgaaagagggggagacgccgcgtgcggagaggggggggacaagcgagcgaaagcggcaagatatgagtggaaaggcccacagcaacgcccgagtctggagagcgcaacaggagcgagggcgaccgcggggggaccccacgaaagcgcagcgagagagagacaccaacggaccgcacccctacccgaagcggcccatgggtcgccccccccccgagcagacaggggacgatagcggggacacaccacaacaaaactctctctacacaacgggcgagcgcacacgagaaaggacgcccacacggggcgacccacacccctaccgcgggacaccacccaaaatcaccagcaaaaaagaacagacaactgagacaacacaagatagccccaagcaaagggcccactgtgtgacccaagcccccccaaagagtgtcgcctcatggactactcgggccccaccaacaagaatggggccccacagccacacaccagcaaaaatggcgaacggaaaaaacccacgaacgtacggcgcacaaggggaggagagaggcggaacaaaaaggggggcccacgatggtcagaacagaccgcgtgtgtggtga

SEQ ID NO: 675333 - DNA, 117 bp, Homo sapiens
aataggttaatttggcaaatataatacatgccttttttatcctcaaatgaacagtttcccaattacttcactctaacacctggtagtgctctttctcctgtgtgagacggtggttta

SEQ ID NO: 675334 - DNA, 447 bp, Homo sapiens
gagccggtaccgtagcgctgcatggtagactgcctgtaatctcagcacttggaaggcaaggtgggtggatacctgaggtcaagagttcgagaccagcctggtcaacatggtgaaaccccgtttctgctaaaaagacaaaaattggccaggcacggtggcatgtgcctgtcatcccagctactagggaagttgaggcaggagcatcgcttaaacccagaagccagaggttgcaatgagctgagatcccgctactgtactccagcctgggcgacagagtgagattctgtctttaaaaaaagaaaaagaaagaaagaaaagaaaagaaaaattgaaggggaagagagagaggaactgagatgaaaacactgagtgaggccaggcccagtggttgtaacatctgcagtcctagcacactgggaggctgaggcagtttaccatgcagcgcta

SEQ ID NO: 675335 - DNA, 1539 bp, Homo sapiens
  misc_feature (498)..(498): n is a, c, g, or t
  misc_feature (578)..(578): n is a, c, g, or t
  misc_feature (633)..(633): n is a, c, g, or t
  misc_feature (650)..(650): n is a, c, g, or t
gcttttttctcccaacacagtgcaagactccgtctcaaagaaaaaaaaaaaaaaaaattggaggtggttttattattggatttgtaggaatggcttatttttttcagaattacaaattctctttttctcaaattattattgtttttgaggactatttttctttccttagtcttggggcttgtgccttttcatttttcttaagtgggtgctctttcaaagaaacaagtttggtaatgtgtaagtggagcccagttttatctccatttttttcttttaatgggctcaggtgcttttgggtttgttggcaagaaaattcttttaccttacccattagaaattggccttggggtgcctttggctcaaaattcaattgtgaccattattattctgtggggatctcgtggaataactcatatttatatgtgctcattgtgactctatagtggtattctatattctcttatacaacaaagtctcccccacggtggctcttgtgantatatttggggggggcattataataagctatatattgggacaaatctctcaggatatttggggtaaaggttctcttaccnaatctctttttctccccaaggattcggctcttggagcttatctcaggggcgtccntttctcttttatattanacaggctttatatatattataagcgctttgggtccaaattctctttctcttttttaacaaaaaaaagagcgctctaaacgcgggggacattggcgcgacatcggcgggaaatgtcgcccatttggaacaatctctaattacagggctcccacacatttgcggggcggcacacagcactatttgcggcgacccaaaacaaaactcatttttttggggaaaacctcctttgcacaaatattaccccagttgggggacccatggggctttactatatatttttctcttgcccccactttttttatttgtggggcgggtctcttttctctacacacgcttttttttctttctccaaggccaactgggtgttgttcgtgggttggggttctgtcgggtgtgagacccaaaacggtctcttcgtgttactcatccctttgtcgcgtcacacatggtgttttttcgccctaaaaatatttcgtggggggggggaatagcccacatggtgacacaacagagaatcttcttcacattcacaccattttaaaacaggtaatttcgcgagggggcataatattaaaaaaggcgccttataaaaaaggggggacaattcgagacgggacccccggaaagcattgttggaaaaaaggagagagcacaaacaacggcggtagaatacaaacgagggggaaaacgaccggtggtaaagagagaccacaataaggaataaaccagcccgtgggtggataaaaacaagggagtcacagtttccgacaaaaagaaacgaacacagaaaagagggggggcgcagaacaactgacggccgaacgaccaacacatagaggtgctagcagaaaaacaacacgcacccagcgaacagagcagacacgaagaa

SEQ ID NO: 675336 - DNA, 600 bp, Homo sapiens
  misc_feature (161)..(161): n is a, c, g, or t
  misc_feature (224)..(224): n is a, c, g, or t
  misc_feature (468)..(468): n is a, c, g, or t
  misc_feature (533)..(533): n is a, c, g, or t
gtggttaaggaaaccctgaaaagcttcttggaaccctggaattttggggggctttttatatgaaggctttcaccaacgtaaggcatgactgattaactcactggccattggtgattcactcagccttcagcccctcccctccctggaggttgaggggtggngctggaagtcccaactctctaatcctgcctcgggctttcctgtttcaccctgaagctacctanggaaaccaagggggtagggtgacctaggggtcactggtaaccatctcattaacatgcgaaagacatcactcttgagattccaaaggtgttggggctctgtgccacgtaacacggatgaagagcaaatacatatttacaatatcacacacattacagacccccctgacttttgctctaaaggtctataccttgcctcatgctacctttcacctgattggcttccgctggccttgcgtcccctgangtgtagctcactgggtaggagggcccttaggaaagacagaaacctgagctgttttgtgggccacnccctgggaggaacttcaatttggtggtcacaaggagttgccgccccggcttttgtgatgggtggcct

SEQ ID NO: 675337 - DNA, 350 bp, Homo sapiens
ggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattaaattcattttattagatttattctaaaattttttaatggtaaattcttaaactgtggaaaaccactgaaaggtgctatattaactattctcacaaagattatatacaagtattggaaaatactagagtttacggctaaacacataagtgtggaaaataaaaaatattataaaaaactaacaaaaaaaataa

SEQ ID NO: 675338 - DNA, 871 bp, Homo sapiens
gatatatattttagacagtgacatttcccagagagccccagagctctcaagctcctttctgtcagggtggggtggttcagcctgatcctgtcaccgtctgaggtgcctgctgtggcatcctcgtccccacatgcttactaatacattcccttccccatagaccatcaaaatcgtggaccaactggcctcttccttctccccgtgggaccaaaagtttaggggcctcagtcccctcaccgccactgaccctggtctagttcgtgtctcgtccgttcttccccctggcctgttctgtctctgaggctctgatgtcctccgatttcattccagtggctgggaggtcactgagtgctgcctctgccttcttgattgcctggactggccttgcttctacaagtatgctttctcccacagctgatggctggcaggaaccattaaattgttactacgggagggatgccgtgtggcagcgtggctgccccaggccagcagctgcgcttgactgtggctcaccatacatctgggtgcagccattccctggcagggtgccctcgtggcgttctcacttgttccattcccttcacgtgtgtgctaaggggtgggagtgcaggggcatgcgcagcaggggacggggcctggcctttacgcaatggggtcctggggcgcctttgaacggacaccgattgaagtttccgtacgagtctgaaagactccaacgaaattggtcccatttgctgcacctgacacacgacacacacccaccacacgactagcggagcgatcccccaaaggacacccccacccttggaccctcgggaaggaacccacgaccgcgggaccactggggggccaaccgcccgcagcacccaat

SEQ ID NO: 675339 - DNA, 875 bp, Homo sapiens
  misc_feature (275)..(275): n is a, c, g, or t
gatggagcaggtctcctggtcctcccggagcacggggggcggggagctccagctacttacatcaagcgcccttgggggtttccaactggtattctgtggttctcgtgggtgtcttattccccttttgccgtgggggcgggggctggcaggggaacatacctgcttgatctacatcactcgggtctcatgtctgaagggcctgtctcacctggacactctacctgggcctgggcgctcgagaatctgaggcgaccttcatcaccctccatctgccncaatgaccgcaggggtgaccccgtcaccaaggctggctgggcaggatcccacggacgtaggaccccaggtaggacgcagtgggcttcccccaggaaagagcacgagccagcactgcctgcctagggagggcacccgactagcaggcatggctggtggctaccgtttaaagaaatctttgtccatgtgggagtgggaggtgcttcgccctatgctggctgcgtaagccagcgtccatggctcttaccgaggcagtctgtaacagccgtgaggggccaccatgatgatggaggaacctggcggctcagaggaccctgaggtcaccgggcatccgaggcagagggaggggagaaggggagcatcctctggaaggatgatccgaacgtgaagggtgcagaacctgagagcgcgacaggcgagccgaatcccctacctggagggtcgtgcaacgaggaacatggcccggcaaagaaaggcccctgccaatgaggccggggaacctgggaccccgggaagaggcggcacacgccacgagcatccacaggtgccacactgccggggcccaagaaccgcgcgacatacaatgggccggcgcaaggccg

SEQ ID NO: 675340 - DNA, 401 bp, Homo sapiens
  misc_feature (93)..(93): n is a, c, g, or t
  misc_feature (131)..(131): n is a, c, g, or t
  misc_feature (157)..(157): n is a, c, g, or t
  misc_feature (189)..(189): n is a, c, g, or t
  misc_feature (228)..(228): n is a, c, g, or t
  misc_feature (241)..(241): n is a, c, g, or t
agccaaagtcccaattatgaaaactttggaaaattttccagaaaaccccctaaaatgtttcagcaacccaggccaaaagagaggccctggaancccaaggtgagaggaaactttaaaagttacacttatgnccaggcacggtggctcacaccgtaantccagcactttgggagactgaaatgggtggancacttgaggccaggagttcaggaccagcctggtcaatanggtgaaaccccanctctactaaaaatacaaaaattagcctggtgtggtggtgcatacctgtaatcccagccacttggcaggctgagacatgagaatcacttgcacccaggagacagaggctgcagtgagtgagatcatcccactgcactccaacctagacaacagagtgacac

SEQ ID NO: 675341 - DNA, 782 bp, Homo sapiens
  misc_feature (10)..(11): n is a, c, g, or t
  misc_feature (15)..(15): n is a, c, g, or t
  misc_feature (114)..(114): n is a, c, g, or t
  misc_feature (258)..(258): n is a, c, g, or t
  misc_feature (262)..(262): n is a, c, g, or t
  misc_feature (307)..(308): n is a, c, g, or t
  misc_feature (345)..(346): n is a, c, g, or t
  misc_feature (405)..(405): n is a, c, g, or t
  misc_feature (413)..(414): n is a, c, g, or t
  misc_feature (418)..(418): n is a, c, g, or t
  misc_feature (448)..(448): n is a, c, g, or t
  misc_feature (454)..(454): n is a, c, g, or t
  misc_feature (456)..(456): n is a, c, g, or t
  misc_feature (476)..(476): n is a, c, g, or t
  misc_feature (479)..(479): n is a, c, g, or t
  misc_feature (482)..(482): n is a, c, g, or t
  misc_feature (504)..(505): n is a, c, g, or t
  misc_feature (530)..(530): n is a, c, g, or t
  misc_feature (555)..(555): n is a, c, g, or t
  misc_feature (564)..(564): n is a, c, g, or t
  misc_feature (589)..(589): n is a, c, g, or t
  misc_feature (608)..(608): n is a, c, g, or t
  misc_feature (610)..(610): n is a, c, g, or t
  misc_feature (711)..(712): n is a, c, g, or t
  misc_feature (716)..(717): n is a, c, g, or t
agcgggagcnngtcnccgctggggccgggccgggcgggagtgcaggggacgtgagggcgcaagggccgggacatggggcccgccagccccgctgctcgcggtctaagtcgccgnccgggccagcctgccgctgccgctgctgctgccactattgctgctgcttctgcgcgcgcagcccgccatcgggagcctggccggtgggagccccggcgcggccgaggccccggggtcggcccaggtggctggactatgcgggcngccntaacccttcagccgggacctgcgcaccggccgctgggaaccagannccacagcgctctcgacgctgtctccgggacccgcagnngcgtgctggagtactgcagacagatgtacccggagctgcagattgcacgtgtggagcanggctacgnnaggnccatccccatggagcgctggtgcgggggtncccggngncggcgagctgcgcccacccncancancaggttgtgcccttccgctgcnntgcctggtgaatttgtgagtgaggncctgctggtgcctgaaggctgccgngttcttgcnccaggagcgcatggaccaatgtganagttcaacccggaggctcngnaggcacaggaggcctgcaggctcccagggcctcatcctgcaacggctcgggcattgctcttaccctgtggctcggatcggttccgggtgtggatatgtgtnnctgnncccctccaaggtaccccgaccatctgggacagcagtttggtgaccctcaaccggtcctgggcccg

SEQ ID NO: 675342 - DNA, 171 bp, Homo sapiens
gcagtatccaagaggctccttcggccttcttcctcttctgctctgagtactcgccattaaatcaaaggagaacatcctggcctgtccattggtgatgatactcagaaatggagatattataggaaaaagaaatcctttggaattttaactaaaatcactgcatatgggaaa

SEQ ID NO: 675343 - DNA, 765 bp, Homo sapiens
  misc_feature (10)..(11): n is a, c, g, or t
  misc_feature (15)..(15): n is a, c, g, or t
  misc_feature (114)..(114): n is a, c, g, or t
  misc_feature (258)..(258): n is a, c, g, or t
  misc_feature (262)..(262): n is a, c, g, or t
agcgggagcnngtcnccgctggggccgggccgggcgggagtgcaggggacgtgagggcgcaagggccgggacatggggcccgccagccccgctgctcgcggtctaagtcgccgnccgggccagcctgccgctgccgctgctgctgccactattgctgctgcttctgcgcgcgcagcccgccatcgggagcctggccggtgggagccccggcgcggccgaggccccggggtcggcccaggtggctggactatgcgggcngccntaacccttcagccgggacctgacgtcacctggctcgtcgtagggaatcgcaagaccacaacatggcgtctctacgacctgtgtgtctaccggggacctcgcgatgcagcagtgcctggtagatacatagcaggacaacgatagtatcctcggaagtctgacaagatttgggcacgtagtagtgatggcagggctacggcaagggcgcaatcccccacatgggaagacgtcatgagttgcggaggggtttcaccaggaaggcgggcgtgcatggagacacgcagaacactccaacacaacgcaagggattgtgtcaccatttccagacttgcacctgccctggcgttgaaacattcttggtgaaggtgacgtgcgcccatggcatgggttggccttggaaaggtgcgtggcccggatgtcctttggcacccgaggcagcggccagtgtggacccaagatgtcgagggagtttccacaccccagggagggcattcaagggaacgg

SEQ ID NO: 675344 - DNA, 1581 bp, Homo sapiens
tcacggggggcgagcccccacacaaactaggggggcgtatatatatattctgcgggccaccctcttttggtcgtgagtagtgtgccccccaccaactgtgtgtcgactacctatcagacggggggtggtgttgtgaggactcagactaactgtgtgagagcaatgttgttcgtgactcagcataccgctcgccttttcctcacaaagcgtttttcatctttctcgagccacatcgtttgggcctttctgctggtaggagaacaccagcaacaagacttgtggtattgttaggccaccagccacccctggtgggcaccgacaggtggttactagtattaccacaaggggaagcagaaaacacctttcggggggggtacattcccgttgtggataaaggggaagctcttctaatgtgggtcccccaccccaagagtgtgccgaaagaatgacacccatcatttaagttgtgctgtccaaacccctcctcagagagagagtcgtctgttgtgggaagattttggcgctcccctcccttctcctggggggggaacataattgtctcgtggcgccggtttgtgattatggccccccgcccggggggcgggtttttcttctcccacaagggaaaacatgatgtgtgagtaccccttgtgccgcatttattattctttggtggcgccgcattggtcctcaaaaaagggccttttgttggtggggacgaaaaccatgggtctgaattctcccccgtgggaggagcctttggtttaagccgggggaggagaatgacgttctaaccatttgtggcgaaattagtgcagcgttattctccgacgattgtttctgcgccacacacaggtttgtgcgccaaacaacgtgggtacaacactggggttggggagcaccctggagacgccgtgtcctccgcttttttaatagaggtgatatacacccttgtggcccacaaagtgattgggagattgagacactccacaagaaaaagtgtttgggttgtagaaaacacacgcgccgctttcgcgagggggggcccccccctctcaaaagggggcactccccccggggggtaaacaccctgagggcaccccacggttggttcttccctctcttgaacttttcacaaacacagcggaacacacccacactttctcttccacacctcttggaaccccttgggggcttggcactttggccccttcaacgagccaccttgtgtcaaagactcactttcactggtatatgagcacaccgagaattttgggtatacacagcacaacacgggttggtggagacctcacatggcccacacaacatggcctccaaaggagagttaagagacccctggagccacccagccccacgcaagaggcaccaacagagggaaagaagagagagccctcacctgctggggagagtccctgccaacacgctcagtgcccccacccaacacctgaatttcccctcctcacacagttgtccatgtagaccccttgtaagaggggaggggcctagggagccgcacccttgtcatgtaccatccaatataagtaccctgtgctcaaccca

SEQ ID NO: 675345 - DNA, 893 bp, Homo sapiens
  misc_feature (95)..(95): n is a, c, g, or t
  misc_feature (97)..(97): n is a, c, g, or t
  misc_feature (108)..(109): n is a, c, g, or t
  misc_feature (131)..(131): n is a, c, g, or t
  misc_feature (162)..(162): n is a, c, g, or t
  misc_feature (165)..(165): n is a, c, g, or t
  misc_feature (175)..(175): n is a, c, g, or t
  misc_feature (182)..(182): n is a, c, g, or t
  misc_feature (185)..(185): n is a, c, g, or t
  misc_feature (195)..(195): n is a, c, g, or t
  misc_feature (197)..(197): n is a, c, g, or t
  misc_feature (200)..(201): n is a, c, g, or t
  misc_feature (209)..(209): n is a, c, g, or t
  misc_feature (220)..(220): n is a, c, g, or t
  misc_feature (224)..(224): n is a, c, g, or t
  misc_feature (227)..(229): n is a, c, g, or t
  misc_feature (253)..(253): n is a, c, g, or t
  misc_feature (258)..(258): n is a, c, g, or t
  misc_feature (264)..(264): n is a, c, g, or t
  misc_feature (267)..(267): n is a, c, g, or t
  misc_feature (271)..(271): n is a, c, g, or t
  misc_feature (275)..(275): n is a, c, g, or t
  misc_feature (278)..(278): n is a, c, g, or t
  misc_feature (284)..(284): n is a, c, g, or t
  misc_feature (289)..(289): n is a, c, g, or t
  misc_feature (293)..(293): n is a, c, g, or t
  misc_feature (301)..(302): n is a, c, g, or t
  misc_feature (306)..(306): n is a, c, g, or t
ggcgccagtcccttgcggcgggggagagaaatcgcttggacttcggggcggcctcggacggccatgggctttaccctgtactcactgctgcaggngncctgtctggtnnaaacgccatcgcagtgctgcancgaaggagcgattcctcaagaacattggtgnggnaacaagaccnagggacntgnggtgatttgncngannggagccgnggaattaaatncacnagnnnaattgaaccttaatcgatctgtanagaanccggtngantgangagntgnccattntgatnattnaggtacannctcnaattgtgcaattgtgtggttacttttgcacttataatttgggagtggaactactcaggtgggaggaaaaagtgggaggacctccaggaaagaaggggactatttgcccagggtaggaaagggttcactttaactttgtgggtcatttcacttgtggacaattacttaataaatcttaaaggcttggagttaggacctggtggcatccttggggttccaacaccactcttggtttacagcagggctttgaagaaaattttaagaacaccgagggctttccctaattgaactgcgtggtaacaatattagttcgtaacacgttgtgtgggcgccttggtacggttccacttttaccacaagaaggattccgggattccattggaacaggcggcaggtcacatctcttcaagggaggcgttgggaaatatatctggagtgggccccgagggggttaacaactacggtcaagctccaagtggctggtggggtggacagcattgtgttcacccaccgggtgtgcacagacctgtggtgcggcatccctactcttatcaaagcgaataattgtgccataatcctcttccacta

SEQ ID NO: 675346 - DNA, 291 bp, Homo sapiens
cctgtgtgctcagctctcccctctggcagtgcgcacccaggagatggaatcccctgcccgcccagctcatgcccagctgtcctagtgttgggcatgtgggtggacccaagcttgtcttgctgcctgagttccagagagggaggaccctgggtgtggagggtgagggattcttgttgaagttttgtaaatacaagcccgagtgcttacagacgtccttgtggtgatccatctacgagtctgaccgtgcatgtgcatgcaatgctatgtgcacttgtgcctgtctgtatttac

SEQ ID NO: 675347 - DNA, 134 bp, Homo sapiens
tgcctgagtaggtggctatgtgctagagggcaagagtggagtctatcttaggaaaatcaaggcccgcaaaggcatataaatccttgtatgtcttcacccatgtaataaaggtgtttactgtcttgttaaacaac

SEQ ID NO: 675348 - DNA, 404 bp, Homo sapiens
  misc_feature (372)..(372): n is a, c, g, or t
  misc_feature (392)..(392): n is a, c, g, or t
ttcggcacagccatctggtcatttaaggtcttctctacactcttattctagttatccatttgtatcacttttttcaaggtttttagcttccttgtgatgggttagaacatgctcctttagctcggagaagtttgttattactgaccctctgaagcctacttctgtcaacttgtcaaactcattcttcatccagttttgtttctttgctggcaaggagctgtgattctttggataagaggcactctggtttttggaattttcagcttctctgctctgctttctccccatctttgtgggtttttgtttgggtgacctacagatgggggttttgggtgtaggatgtggctctttgttgatgttgatgctattccnttctgtttgttagttttccntctaacagtcgc

SEQ ID NO: 675349 - DNA, 163 bp, Homo sapiens
acagcactgagtcgtacaggatttagaacatgacatggaagagatcaatgctacgatggaatacattgaataaaaaggtcgcacaaagaattgcacagctacaggcaagctttgttagcattagtggggaagtttcaagtatgccttggcagccatatgctca

SEQ ID NO: 675350 - DNA, 240 bp, Homo sapiens
  misc_feature (162)..(162): n is a, c, g, or t
atattctattatatatataatgaacccattcataggatgttttttcagtttacttttgtaatccctctccatcgggattttttatttcatagtatgtcctgaaccattattctaggcccctgtcatgggataatttggaaaaaatagagaatgagtcccgtnctcccatccataaataactcaaaattttttccctttttaggatgaagaatatgaatatagttctgttacgtaatattt

SEQ ID NO: 675351 - DNA, 196 bp, Homo sapiens
tgggcagcaacacttgcagccaagagccaggcttggagcccctggaacctgaatccaccctgatgtcaattgttgggtgccccaactctgctcaatcctgaatcctgtgggattgaccaggggcccgccctctgctccacccctccagggacggaaatcaccggaacttttgggggaaccccgtatttgtcccgtg

SEQ ID NO: 675352 - DNA, 164 bp, Homo sapiens
attcaaacgttgatgcgtctctctctctccttctttctttgctgtttgtttctttctttgcttttctttctttcttcttgctttcttgccttctttcctgtctttctttctttccttccttctctcgctccatttcacacatactaagttgcccgccaatcgaa

SEQ ID NO: 675353 - DNA, 4240 bp, Homo sapiens
tagttcaactttcccatgagagtttttggaggaggtgtctcagggttgtcagggtcggccccgcctgcctctcaggtgtgtgtgatttcaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcacgtgagtgcgggagttccccccgttcccgagggcaggggtgctgcaggaagccagctggttaagtgcaggagctcagagcaccagggcgcccggcccccatctctccacctagcgtgcatttctccgtggggctgttaggggttcttgtcaaggattgtggcctgtaccttttccactgtcccgacttaactcgctcagaagcacagagcagagaggtcccttctccccgcagtctccagcctccggctctgtgaagaggccgaaatggactttcctcgcctgcctccttttcccctgccagcgcccacccctgtggcttagagcaggaggtcagtgaggtgctagccctgcgtccaggcctgtgcctgccaggagagccccggtggacagcagttccctgcagagccccgttgtttaccctggagtgtggatgcgtctgttctgatggtgtttagtcagtgagaacaggtgctacagttcccgaaaagaggaggatgccccccagagaagcccaggaaatccgtgctgacaaacttctgctcactgttcggccagctttgtttgtggtgaagtttaaaatagagtagagtaaaccctgaggcgctctgcctgtttcccagctcctggaatcaggactcatccgatgaccactctcactcttaggttagtaatgcttcctcagggaggagcttctcaccaggaatgactgaccgccaccaacctttacacagtggacacaggatcagtactagctgtggtcatagccgttagtgggaagcctgcagaactgtacgtcaggcagccttttagctgctttacttgattcacttcacgaagtagccacggggggacagctcatcccatttttggataaggaatttaggcacagggcgcagcagtgcggtgcggtagtcaggtacggcccaggcctgccagaccccgacactcacactgggcccccgttgcccttgagctttaccccacagtgttcgtgtagcctctccagggtggagttactcttcctcaacatgggaaggccccagtgctgcagggaacagctgaggcttctctggcttcagcatccagcggggctcctgagctatagcttgtgtggctcatttgcaccctggtccttaagagagaagtcctgaagacagagcttacatacgcaccattaggacagagggatggtggtcaccctttatcatcttttgagccactcccagaacctcccagaactcagtcattgtgtgttatgtgtgttctttctgggtctggggtgtgtcaggcaaagagtctatattctagaaaacgggtgcagtgctgcaccaaaggggaaaggttcctgttgtttacttagacttgagcagcgacactgaaaggcctctttttctctttcagtggctgaatgaagagaaggtcatccagaggcttgtggagttgatccacccgagccaggatgaagatgtgagtgtgctgcttaccgagcttcgtgcatcagtccaggcctgtgctgccaggtcacccactgctgcgggccagggggcgagggagggcaagtcatccctttcctaagatgaggatcggttaggtacttttctttctttaatcaagcactgacttctaggctggatttttttttctttttttttttgagatggcgtttcgctcttgttgcctgggctggagtgcagtggtgcagtctcggctcaccgcaacctccgcctcttgggttcaagcaattctcctgctcacccagtcgggtgagccaccacacccagcctctaggctgttttcttcttgttgttgttgttgtttaaatagagatgaggtctcactacattgctcaggctggtctcaaaaacctggcctcaagtgatcctcctacctcagcctcctaaagtgctgtggttgcaggagtgagccaccatgcctggcctacacttttttttcttaactgaaaaataatctatgtgtattataaaaataggacaggcgcggtggctcatgcctgtaatcccagcacttggggaggctgaggcgggccgatcacttgaggtcaggagttttgagaccagcctggccaacgtggcgaaaccctgtctctactaaaaattagcgaagtgtggtgtcaggtgcctgtaatcccagccactcaggaagctgaggcacaagaatcacttgaacccaggaaggggagcttgcagtgagccgagatcacaccactgtgctccagcctgggcgacagtgagattctgtctcaacaaacaagcaaaccaaagaacaattccagtagaattgtatcagtcgtctgtgaccgaatagcaaattaccctgaaatgtagttgcttatggcaagtatttttacctgtagcagtatcagtttctgtggatcaggcgtctgaatgtggcttagtggctcttctgttgagtctcacaaaatacagtcatctcagagctccactggggtagaggccagctccatggtcacagatggcttggcagcatccagttcctcagggctgtgggccgaggccgccctcagcattgcaccacatgggcgtctccacagggcagcacacaacgtggagctgagctttcccctcactcttaatgtatttggctctttagacctgggtggctgggtccagcccacactaaaagagatgggggctataaaggcatgaactccaggacgggattgctaggggccccctaggagccacccaccctggaagcacctaaggtgacaatggggctccctgtggtgatccctgttgagagtttggggtatatcccagtaggccttttcctagcattacacataccgatctatacatacaaccacgtgtccttggcagattggaaaacagtggtgctgactcgtgtctgaggccttcaccgctgcctggccaaccaccctactttgttctccatcagcccacagggctgatcagacagacaggagaggccacgttggcgtctgtaggaaacaaggaggccgccctgcctgatgttggcgtccgtaggaagcaaggaggccgccctgcctgagaactggagcccacccatgcatgtgggtgttgtgggctgatggcctgtcctgggtcccaaaggcagacctgagagctaatctggctgctttcttttctccctaaaatactcctgtgagtgtttgctttccctcagtcttcccacagcatgtgaaccaatgctgcagggagtcaggggttatttctctcttaatcacatttgtcttacctacagaacagccctacattgtcagcaggggcacgttcccatcacggattgcgtgttaatgtttccctagaaaagatgagtcctctgttttcttggtagcaacttccctattttcattagcttacaggactcattctgaataatagcagctacttattaccacatttaaaatatagtatcagtaacatggccacatattcagcatatttcaaaacgtggatcacaggtatagcccagtatctgcattgcatatctgaccattattagccctgttttgaattcctgaagatagttcaatgcagctttaaaaaaaagaaaactctaaccagatctacattttgacgacagaaaaggcagacacaggcttctttgaaatgaagctgttgtctggaatctttctttgtaggaaactggtttagagaaagtcccacatctttttcttttttttttttgagatggagtctcgctctgtcacccaggctggagtgcagtggtgcgatcttggctcactgcaagctccttctcccaggttcaagccattctcctgccctcagcctcccgagtagctgggactacaggcacccgccaccacgcccggctaattttttgtatttttagtagagatggggtttcaccgtgttagccaggatggtcttgatctcctgacctgatgatctgcctgccttggcctcccaaagtgctaggattacaggcctgagccattgtgcctggccaaaagtcccacatctt

SEQ ID NO: 675354 - DNA, 311 bp, Homo sapiens
atatggatgccatgtctcatacacatccttctctgtctagtacccaatcaatctcctcatcatcattatcaatctcttttttcacaatctttcattgcctatatacgatctgtttttttaactcgaacctactgttctttgtcttaattgcctcttcatattacccggtagtctaatcaacaatccttaagacctagactggatgaagctttgccactttccctggtgtacattgcctctttgtcttcaccaatttgatccatactctcatgacttgaaggattatatgtaattactgtctgtgcatggtc

SEQ ID NO: 675355 - DNA, 159 bp, Homo sapiens
taaatagtcgagattgacgaactgacagcctacagaaagaggaaccataatggactccaataggcagcagcagcgttttgcagagacagtgatcgtagacagtatggtagacaaacatacgggtactaccagtgtctactccaacacttgactataata

SEQ ID NO: 675356 - DNA, 203 bp, Homo sapiens
gatatttatatgataggcagcacacttaaaaatacaaaaattagccgggtatggtggcatgcgcctttagtcccagctatttaaaaggctgaggcagcctcgcttaagcccaggagttcaaggtaagaggattatttgagcacgggagttcaggctgtagtgagctgggattgcgccactgtattccagcctgggagatagaa

SEQ ID NO: 675357 - DNA, 1050 bp, Homo sapiens
  misc_feature (861)..(861): n is a, c, g, or t
  misc_feature (906)..(907): n is a, c, g, or t
  misc_feature (909)..(909): n is a, c, g, or t
  misc_feature (916)..(916): n is a, c, g, or t
  misc_feature (930)..(931): n is a, c, g, or t
  misc_feature (936)..(936): n is a, c, g, or t
  misc_feature (938)..(938): n is a, c, g, or t
  misc_feature (945)..(945): n is a, c, g, or t
  misc_feature (951)..(951): n is a, c, g, or t
  misc_feature (956)..(956): n is a, c, g, or t
  misc_feature (963)..(963): n is a, c, g, or t
  misc_feature (970)..(970): n is a, c, g, or t
  misc_feature (974)..(974): n is a, c, g, or t
  misc_feature (979)..(979): n is a, c, g, or t
  misc_feature (994)..(994): n is a, c, g, or t
  misc_feature (1006)..(1006): n is a, c, g, or t
  misc_feature (1011)..(1011): n is a, c, g, or t
  misc_feature (1022)..(1022): n is a, c, g, or t
  misc_feature (1025)..(1025): n is a, c, g, or t
  misc_feature (1028)..(1028): n is a, c, g, or t
  misc_feature (1030)..(1030): n is a, c, g, or t
  misc_feature (1046)..(1046): n is a, c, g, or t
agcgagcgggccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgtggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 675358 - DNA, 823 bp, Homo sapiens
ggctccgccctctctgtcttctctgcagtgggagcagctctcctgccaagtcttcaccccctgaaaatgttcgcctgctccaatgttgtgtctccactccctccttggtcaagagcacctcacatgctgcgtgagccgtacgctatcgtgcagatggtgctgaaaggaccggagaatactgacagatgagagcctcagcagctttggtagtctaatgtcccctttacctcgattggttcatagccaaagctttccagaccagcgccatttcaggggacatcgacacggcagccaagtttctgtgtggagctggggctgccacaggttgggcgtggcctggtactgggggctggcatcggaactgtgtcgggagcctcatcatttggttttgccaggaacccttctctgaagcgacagttcttctcctacgccattctgggcttgccctctcggaggccatggcgctcttttgtctgatggtagcctttctcatcctcttgtgccatggtgagggagccgtctccacctcccataggttctcccgcgtcttgttggcccgtgttgttccttttcttaatacctccccagggagccctgaggcaacgtgctggctcagggcttttgcccgacgaagagaccacttaattctgtctcaaaccgcgatagagacagagaaagatgtgggggcggcgagcaccggaaagtttgaacaccggtttggggccgcccaagtaggacgcggccagcggccaaggaccgggcgaaacgggggtcccaaaaagccggggcccgttgcaccccggtgggcctggctacggcccaa

SEQ ID NO: 675359 - DNA, 744 bp, Homo sapiens
  misc_feature (198)..(198): n is a, c, g, or t
  misc_feature (251)..(251): n is a, c, g, or t
gggagagacacctgggcgcattcgcctaacagaactacagagcaagcaagagcattgaggggcatgtcgagcacgctggtgggtgggggacagtgtggtgaaggagggcaaaggagggggttagcccagaggagaacctggggaggcaggtcctggagctgggggtgcagcctcagagctgttgagcagctgggaagnctgctaactttgtgagcccaacctggagaggtctgatgggaatggttactggngagggccccacatcctgagctctgggaatcttgtgtgttcatgctgcagatggacttccaggacttgggtctagtgttgctgagggtggatctgcagaggtgagagaaatgacccctttggacttgggtctagtgttgctgaaggtggatttgcaagggtgagagacgtgacccctttgccctcgttgcagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaacgtatgtacctaagctgtgacgtccatacccagcagtctcagcagccgcagcagttcct

SEQ ID NO: 675360 - DNA, 569 bp, Homo sapiens
tcgagtctgaccagtactggtcccactctgtcatagattttacatccgaagctgactaattacatctctccacccggcagctccaaattcgatatgggcggaggatgggctctgtctcattcattgctgtaatccaagtacttagtagattcctgggaccagcaagattttctgataatattggtggaattaagatgttgcagaattgaagccccaaagtgccagaaggaaccaagagctataaatagctttctaacagccttccacaccagggtgaggggcatgcagagatcttcacacacacagaatgccagaaaaacaattactacctcattatcaggaatgctaaagcagtcacatctcactcaactgagaataggcctttctgggcccccaaattccagtgacccagacctcagggaagattgccagaactcaagaagaggccaaagccactggggtacaggcgagggaggctgcgtaaggcatgtcagaacaggtggtgtacttagaacagagcagtgcacctttgatgtaatattatttgcaatactgttgctgtccacctg

SEQ ID NO: 675361 - DNA, 152 bp, Homo sapiens
cagacagctgcagattgtggagcgtggctaatggagctgctggtgtactacagacactgcaccgtttagttttgaaggccactttgaaccagttggctttccaggaactcttcagcaaggtgtagcgtggtccgatttggagcctggttccg

SEQ ID NO: 675362 - DNA, 1656 bp, Homo sapiens
  misc_feature (1467)..(1467): n is a, c, g, or t
  misc_feature (1512)..(1513): n is a, c, g, or t
  misc_feature (1515)..(1515): n is a, c, g, or t
  misc_feature (1522)..(1522): n is a, c, g, or t
  misc_feature (1536)..(1537): n is a, c, g, or t
  misc_feature (1542)..(1542): n is a, c, g, or t
  misc_feature (1544)..(1544): n is a, c, g, or t
  misc_feature (1551)..(1551): n is a, c, g, or t
  misc_feature (1557)..(1557): n is a, c, g, or t
  misc_feature (1562)..(1562): n is a, c, g, or t
  misc_feature (1569)..(1569): n is a, c, g, or t
  misc_feature (1576)..(1576): n is a, c, g, or t
  misc_feature (1580)..(1580): n is a, c, g, or t
  misc_feature (1585)..(1585): n is a, c, g, or t
  misc_feature (1600)..(1600): n is a, c, g, or t
  misc_feature (1612)..(1612): n is a, c, g, or t
  misc_feature (1617)..(1617): n is a, c, g, or t
  misc_feature (1628)..(1628): n is a, c, g, or t
  misc_feature (1631)..(1631): n is a, c, g, or t
  misc_feature (1634)..(1634): n is a, c, g, or t
  misc_feature (1636)..(1636): n is a, c, g, or t
  misc_feature (1652)..(1652): n is a, c, g, or t
agcgagcgggccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 675363 - DNA, 119 bp, Homo sapiens
acgaatcggtcatcaccccaccagacgtgtaactggtctggacgaatcttggcgcattcgggaacgtcttccatagcggcatagacgatattggcgatcctcccgccggtgagacacag

SEQ ID NO: 675364 - DNA, 705 bp, Homo sapiens
  misc_feature (41)..(41): n is a, c, g, or t
cgcagcctttgaccttcgacgagatccaggaggtggaggtngatttttctcctttctttgcttttctcctttttctttttcctctctcttttttgctttcttcgttctatttttattcttttcttcttctttcttttcttttttgtctctcttatcttctttctttttctcttttttttctttcttattcttctcttctttttctttcttctttttctcttattttctctattctcttttttcttcttctttcttttttttttttctgttctttctttcttcttttctttttttttctgttccttttatttcccttctcttcttattttttctttctccttcttcttatctcttcgcttccttttttatctcttctctttcttctttcttttattttttttttcttttttttttttttttttcttatttcttttttttcttttttttttcttctttttttcttctcttcttttttctcttttctttttttttttttttctctttttttttttttctttttcttttttctttctctttttccttttttcctttttcccttcttcttctttttcttttctttttcattttttctctttccttttttttttttttcttcttcttttcttctttttttctttcttttttttcttttttttctctttttctttttcttttcttctcttctttcttcttcttttttcttcg

SEQ ID NO: 675365 - DNA, 288 bp, Homo sapiens
cacccaattatatactcaatatggttttactgtgccttacacaaagagaaactctatacagaatgtatgtcatgggtgggggtaacagagtctttcctgcactgttaggtgatgcacacagagcatgtccagaacatttctgtgcttattcaccaccaaagagatctaaagtaatgtatgtcgcctgaaatgggggttatgcctgacaattaagtggtttattggttttctgaaaggaggtgaccttatttttctaacccctatgctaaatacactttatattaacca

SEQ ID NO: 675366 - DNA, 2857 bp, Homo sapiens
  misc_feature (1349)..(1350): n is a, c, g, or t
  misc_feature (1355)..(1355): n is a, c, g, or t
  misc_feature (1465)..(1465): n is a, c, g, or t
  misc_feature (1552)..(1552): n is a, c, g, or t
  misc_feature (1570)..(1570): n is a, c, g, or t
  misc_feature (1572)..(1572): n is a, c, g, or t
  misc_feature (2668)..(2668): n is a, c, g, or t
  misc_feature (2713)..(2714): n is a, c, g, or t
  misc_feature (2716)..(2716): n is a, c, g, or t
  misc_feature (2723)..(2723): n is a, c, g, or t
  misc_feature (2737)..(2738): n is a, c, g, or t
  misc_feature (2743)..(2743): n is a, c, g, or t
  misc_feature (2745)..(2745): n is a, c, g, or t
  misc_feature (2752)..(2752): n is a, c, g, or t
  misc_feature (2758)..(2758): n is a, c, g, or t
  misc_feature (2763)..(2763): n is a, c, g, or t
  misc_feature (2770)..(2770): n is a, c, g, or t
  misc_feature (2777)..(2777): n is a, c, g, or t
  misc_feature (2781)..(2781): n is a, c, g, or t
  misc_feature (2786)..(2786): n is a, c, g, or t
  misc_feature (2801)..(2801): n is a, c, g, or t
  misc_feature (2813)..(2813): n is a, c, g, or t
  misc_feature (2818)..(2818): n is a, c, g, or t
  misc_feature (2829)..(2829): n is a, c, g, or t
  misc_feature (2832)..(2832): n is a, c, g, or t
  misc_feature (2835)..(2835): n is a, c, g, or t
  misc_feature (2837)..(2837): n is a, c, g, or t
  misc_feature (2853)..(2853): n is a, c, g, or t
agcgagcgggccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcgcttggaaggctgagatgggaggactgcttgagcctgcagtgagctatgattgtggcactgcactccagcctggacaacatggcgaaacaccatctttaaaaataaaatccagtctgacaatgtttgtctttaattgaaatgactatttgcatttaatgcatttattgaaatggttgaatttatgtctggtatcttgctgttttttttttttattttgtctcctctgtttttgttgcttatctccttgtatttttattattagttttggtcttttggattaatccagttgttttaaattatactactagaaaaattcttctagcaggatcctatttcgtcgatggtcttttgtaatccacccaggcttccaccttctctgtggctagaaacaggaccgtccagaagtcacctgtaactgccctatcttgcaagttctgattttggcaaaaaaaaaaaaaaaaagccttgacaaggttggattcacttctttccctggattgtgtgtcatccaagtacgtgagacatctggtagtgcatttcagagagaggagtatctgatatgtgtgtggaggcagccatcttttcctgaaagtccttttaggaatcattatttctggtcctctgaagtttgccgctaccactcataaatatctatccacaccccttacaagaagaataaggaagatcttaagacctagaaggaaaactgattgcagaccaggcttggtggctcagtgcctgtaatcccagcactttgggaggccgaggagggcagattgcttgagctcagcagttcgaggccaacctgggcaacatagtgaatccctgtctctacagaaaaaaaaaaaaaccccaccccaaaatcaaaactgaaggtagtgtcagtgtatatatggagtcccttgtgctgaaagtcaaagcagcttcatttgggggcctcaagagctccagctctgggctcttcacctctaagcnnatggncagtgcccgcccagtggtgtgtatagatcggaggctgcagggcctcacccttagctgcagctgtcgcgtgctggggagcctgtgcaggagggtacaagtaggaaagtgcnatctgcatgggaagaaaaatgcagcgtccttgtagtgcggatggggtccaggagacccaggagctgcccagaggacctggtggcatnctgtagaaagcagccagntnggggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 675367 - DNA, 2989 bp, Homo sapiens
  misc_feature (1481)..(1482): n is a, c, g, or t
  misc_feature (1487)..(1487): n is a, c, g, or t
  misc_feature (1597)..(1597): n is a, c, g, or t
  misc_feature (1684)..(1684): n is a, c, g, or t
  misc_feature (1702)..(1702): n is a, c, g, or t
  misc_feature (1704)..(1704): n is a, c, g, or t
  misc_feature (2800)..(2800): n is a, c, g, or t
  misc_feature (2845)..(2846): n is a, c, g, or t
  misc_feature (2848)..(2848): n is a, c, g, or t
  misc_feature (2855)..(2855): n is a, c, g, or t
  misc_feature (2869)..(2870): n is a, c, g, or t
  misc_feature (2875)..(2875): n is a, c, g, or t
  misc_feature (2877)..(2877): n is a, c, g, or t
  misc_feature (2884)..(2884): n is a, c, g, or t
  misc_feature (2890)..(2890): n is a, c, g, or t
  misc_feature (2895)..(2895): n is a, c, g, or t
  misc_feature (2902)..(2902): n is a, c, g, or t
  misc_feature (2909)..(2909): n is a, c, g, or t
  misc_feature (2913)..(2913): n is a, c, g, or t
  misc_feature (2918)..(2918): n is a, c, g, or t
  misc_feature (2933)..(2933): n is a, c, g, or t
  misc_feature (2945)..(2945): n is a, c, g, or t
  misc_feature (2950)..(2950): n is a, c, g, or t
  misc_feature (2961)..(2961): n is a, c, g, or t
  misc_feature (2964)..(2964): n is a, c, g, or t
  misc_feature (2967)..(2967): n is a, c, g, or t
  misc_feature (2969)..(2969): n is a, c, g, or t
  misc_feature (2985)..(2985): n is a, c, g, or t
agcgagcgggccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcggcgctttcatggaactatatgatcatatgggcaacattctgttgcagtctaccttctgtctgacggatatgccatcctgaaaaaggaaagaagctgaacttcaagttcctttcatttagccttggctctgcgcttggaaggctgagatgggaggactgcttgagcctgcagtgagctatgattgtggcactgcactccagcctggacaacatggcgaaacaccatctttaaaaataaaatccagtctgacaatgtttgtctttaattgaaatgactatttgcatttaatgcatttattgaaatggttgaatttatgtctggtatcttgctgttttttttttttattttgtctcctctgtttttgttgcttatctccttgtatttttattattagttttggtcttttggattaatccagttgttttaaattatactactagaaaaattcttctagcaggatcctatttcgtcgatggtcttttgtaatccacccaggcttccaccttctctgtggctagaaacaggaccgtccagaagtcacctgtaactgccctatcttgcaagttctgattttggcaaaaaaaaaaaaaaaaagccttgacaaggttggattcacttctttccctggattgtgtgtcatccaagtacgtgagacatctggtagtgcatttcagagagaggagtatctgatatgtgtgtggaggcagccatcttttcctgaaagtccttttaggaatcattatttctggtcctctgaagtttgccgctaccactcataaatatctatccacaccccttacaagaagaataaggaagatcttaagacctagaaggaaaactgattgcagaccaggcttggtggctcagtgcctgtaatcccagcactttgggaggccgaggagggcagattgcttgagctcagcagttcgaggccaacctgggcaacatagtgaatccctgtctctacagaaaaaaaaaaaaaccccaccccaaaatcaaaactgaaggtagtgtcagtgtatatatggagtcccttgtgctgaaagtcaaagcagcttcatttgggggcctcaagagctccagctctgggctcttcacctctaagcnnatggncagtgcccgcccagtggtgtgtatagatcggaggctgcagggcctcacccttagctgcagctgtcgcgtgctggggagcctgtgcaggagggtacaagtaggaaagtgcnatctgcatgggaagaaaaatgcagcgtccttgtagtgcggatggggtccaggagacccaggagctgcccagaggacctggtggcatnctgtagaaagcagccagntnggggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 675368 - DNA, 765 bp, Homo sapiens
agcggaggggaagtgatcgctcccggaggagcgcgagccgagcggccggcgcagcgtgagacagcacatcctgcccgcgcaggccccgacaccttcgggagccgcctgctaccaacgctgccgcctgcccaggagccgccgaccggctcggggatgcccagttccgccgctgcctaatgcgcgtccaggaaaccaacatgtctgacaaaagtgacttaaaagctgagctagagcgcaaaaagagcagcgcttagctacagataagagaagagaacgaaacggacaggacacgcacggagaggacacacgacaagaggctgatatgcagcacgacgaaagaacccgttcaggacgactctgatctggatcgcaaacgacgagagacagaggctttgctgcaaagccataggtatctcaccggagccgacatctagtgcagccgctgcatatcaaaacatgggatacctgttatctccattatttagtcccgaacccctatgtctccactccatcggaaatacagtgagccactcccaagtgcaagctgcgaaagccaacgaactcaaggccgactctggcggacacttaaccccgcaacgcacagacttgcattccacttgggccgtcgtcaaagggtccacccaccggtggactttccctgccccaacgggaaagtaacgcggtcctactacaaacgggacgaccacagacatcctctctggccacgccatcaagtcctgcacgacggatgacggaaccgatcga

SEQ ID NO: 675369 - DNA, 532 bp, Homo sapiens
  misc_feature (181)..(181): n is a, c, g, or t
  misc_feature (518)..(518): n is a, c, g, or t
gaacaagagaaattttgtatctctgttttgtactctgaaaacacctagaaataatgatgaccagtgacaatgaagatctctagaatacagtgtgatactaaatgctgttcctaccaaaaggaactggaatcgctgggaaaaatggtcctgtcgtaaaaacatgcttggaataacacacggngcccgaaaaaaactactaaggtaatgtgagaagaaaataggtgcccatctaaaagggtcccaaccagccaaagatgattcacaaaaacatcatgactgcaacagactgaatcaaatactaaaaaaacaaaaggaaatatcaaccaaaataagttcactggtcacctttgaaagctgctagaacactgaatcattattttgaaaactggtaaataaaacatatatactatctttactgaaaaaacttatttcagaagaaatgcaaactatcaaatcattattttgcaaccactaatgatatcatattggtggtctcaaagtgtgggccctacactaancacattagcactaa

SEQ ID NO: 675370 - DNA, 2577 bp, Homo sapiens
  misc_feature (1069)..(1070): n is a, c, g, or t
  misc_feature (1075)..(1075): n is a, c, g, or t
  misc_feature (1185)..(1185): n is a, c, g, or t
  misc_feature (1272)..(1272): n is a, c, g, or t
  misc_feature (1290)..(1290): n is a, c, g, or t
  misc_feature (1292)..(1292): n is a, c, g, or t
  misc_feature (2388)..(2388): n is a, c, g, or t
  misc_feature (2433)..(2434): n is a, c, g, or t
  misc_feature (2436)..(2436): n is a, c, g, or t
  misc_feature (2443)..(2443): n is a, c, g, or t
  misc_feature (2457)..(2458): n is a, c, g, or t
  misc_feature (2463)..(2463): n is a, c, g, or t
  misc_feature (2465)..(2465): n is a, c, g, or t
  misc_feature (2472)..(2472): n is a, c, g, or t
  misc_feature (2478)..(2478): n is a, c, g, or t
  misc_feature (2483)..(2483): n is a, c, g, or t
  misc_feature (2490)..(2490): n is a, c, g, or t
  misc_feature (2497)..(2497): n is a, c, g, or t
  misc_feature (2501)..(2501): n is a, c, g, or t
  misc_feature (2506)..(2506): n is a, c, g, or t
  misc_feature (2521)..(2521): n is a, c, g, or t
  misc_feature (2533)..(2533): n is a, c, g, or t
  misc_feature (2538)..(2538): n is a, c, g, or t
  misc_feature (2549)..(2549): n is a, c, g, or t
  misc_feature (2552)..(2552): n is a, c, g, or t
  misc_feature (2555)..(2555): n is a, c, g, or t
  misc_feature (2557)..(2557): n is a, c, g, or t
  misc_feature (2573)..(2573): n is a, c, g, or t
agcgagcgggccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgctctaccttctgtctgacggatatgccatcctgaaaaaggaaagaagctgaacttcaagttcctttcatttagccttggctctgcgcttccaccttctctgtggctagaaacaggaccgtccagaagtcacctgtaactgccctatcttgcaagttctgattttggcaaaaaaaaaaaaaaaaagccttgacaaggttggattcacttctttccctggattgtgtgtcatccaagtacgtgagacatctggtagtgcatttcagagagaggagtatctgatatgtgtgtggaggcagccatcttttcctgaaagtccttttaggaatcattatttctggtcctctgaagtttgccgctaccactcataaatatctatccacaccccttacaagaagaataaggaagatcttaagacctagaaggaaaactgattgcagaccaggcttggtggctcagtgcctgtaatcccagcactttgggaggccgaggagggcagattgcttgagctcagcagttcgaggccaacctgggcaacatagtgaatccctgtctctacagaaaaaaaaaaaaaccccaccccaaaatcaaaactgaaggtagtgtcagtgtatatatggagtcccttgtgctgaaagtcaaagcagcttcatttgggggcctcaagagctccagctctgggctcttcacctctaagcnnatggncagtgcccgcccagtggtgtgtatagatcggaggctgcagggcctcacccttagctgcagctgtcgcgtgctggggagcctgtgcaggagggtacaagtaggaaagtgcnatctgcatgggaagaaaaatgcagcgtccttgtagtgcggatggggtccaggagacccaggagctgcccagaggacctggtggcatnctgtagaaagcagccagntnggggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 675371 - DNA, 974 bp, Homo sapiens
ggtgactgacacaccagggtacgtaggtcgtagctatggagcgtacctggactcatcttagtagggtagagactctttacctgtgcatccatgaagaaacctgtccatctatgtgagccacacagctgtttgttaccttggttacgactctgtacccgacatcgccttattacacgttgccggaggctgcggaagacttttatacaattctgacgcacggtaacacagtactacgcttcgactgacacgatctgctgtaatctgtacctcagacaaagggacctgcaactttacgtactatgaatttcacctgatactttaacaggcacttcccaaccattttgtactatggcccaacagtacacactcacataatttactacatcaagggcacacccgagactgagcacacactgacgaccacgctacttaggcaggctggctaccacagctacaccaacgttgaacagcaaattggcacgaaacacgttgagtgtacagacctaccagttgagctttcctccacacgcttcacgcaacgacgaacgagctaactccacacgagttgctgaggccacattgcaagctatcccaattaacgttttaaacttaaccggattgaggcaacctctcagtcgtccatatcccgcgttatactccctctacacgcaaacaccttatgaggaacaaacaccgaggccatatgacaattgggacacactccctttctgacgacaacaacgtcgtgcacaactgcgccacggccaccacaccgggaacacaacacaggcccttctggctttcccccacgtcattttcgcccaactcaatcgtcttggaacacagggttacagactgtctcgagctaccgagaccttcagcttggtaatcacacccaagcggctagttacaccgacacatacatctccatacataaatgacgtacagcgctcacttatcttagaacattcaca

SEQ ID NO: 675372 - DNA, 2729 bp, Homo sapiens
  misc_feature (1221)..(1222): n is a, c, g, or t
  misc_feature (1227)..(1227): n is a, c, g, or t
  misc_feature (1337)..(1337): n is a, c, g, or t
  misc_feature (1424)..(1424): n is a, c, g, or t
  misc_feature (1442)..(1442): n is a, c, g, or t
  misc_feature (1444)..(1444): n is a, c, g, or t
  misc_feature (2540)..(2540): n is a, c, g, or t
  misc_feature (2585)..(2586): n is a, c, g, or t
  misc_feature (2588)..(2588): n is a, c, g, or t
  misc_feature (2595)..(2595): n is a, c, g, or t
  misc_feature (2609)..(2610): n is a, c, g, or t
  misc_feature (2615)..(2615): n is a, c, g, or t
  misc_feature (2617)..(2617): n is a, c, g, or t
  misc_feature (2624)..(2624): n is a, c, g, or t
  misc_feature (2630)..(2630): n is a, c, g, or t
  misc_feature (2635)..(2635): n is a, c, g, or t
  misc_feature (2642)..(2642): n is a, c, g, or t
  misc_feature (2649)..(2649): n is a, c, g, or t
  misc_feature (2653)..(2653): n is a, c, g, or t
  misc_feature (2658)..(2658): n is a, c, g, or t
  misc_feature (2673)..(2673): n is a, c, g, or t
  misc_feature (2685)..(2685): n is a, c, g, or t
  misc_feature (2690)..(2690): n is a, c, g, or t
  misc_feature (2701)..(2701): n is a, c, g, or t
  misc_feature (2704)..(2704): n is a, c, g, or t
  misc_feature (2707)..(2707): n is a, c, g, or t
  misc_feature (2709)..(2709): n is a, c, g, or t
  misc_feature (2725)..(2725): n is a, c, g, or t
aaaaaaaaaagaaaagaaaaaaaaatgatttgtggccagacaggtaatagggcatttcagattctaattttctcttagcaacagtctctatcacagaatgttgttttttaaagggcgctttcatggaactatatgatcatatgggcaacattctgttgcagtctaccttctgtctgacggatatgccatcctgaaaaaggaaagaagctgaacttcaagttcctttcatttagccttggctctgcgcttggaaggctgagatgggaggactgcttgagcctgcagtgagctatgattgtggcactgcactccagcctggacaacatggcgaaacaccatctttaaaaataaaatccagtctgacaatgtttgtctttaattgaaatgactatttgcatttaatgcatttattgaaatggttgaatttatgtctggtatcttgctgttttttttttttattttgtctcctctgtttttgttgcttatctccttgtatttttattattagttttggtcttttggattaatccagttgttttaaattatactactagaaaaattcttctagcaggatcctatttcgtcgatggtcttttgtaatccacccaggcttccaccttctctgtggctagaaacaggaccgtccagaagtcacctgtaactgccctatcttgcaagttctgattttggcaaaaaaaaaaaaaaaaagccttgacaaggttggattcacttctttccctggattgtgtgtcatccaagtacgtgagacatctggtagtgcatttcagagagaggagtatctgatatgtgtgtggaggcagccatcttttcctgaaagtccttttaggaatcattatttctggtcctctgaagtttgccgctaccactcataaatatctatccacaccccttacaagaagaataaggaagatcttaagacctagaaggaaaactgattgcagaccaggcttggtggctcagtgcctgtaatcccagcactttgggaggccgaggagggcagattgcttgagctcagcagttcgaggccaacctgggcaacatagtgaatccctgtctctacagaaaaaaaaaaaaaccccaccccaaaatcaaaactgaaggtagtgtcagtgtatatatggagtcccttgtgctgaaagtcaaagcagcttcatttgggggcctcaagagctccagctctgggctcttcacctctaagcnnatggncagtgcccgcccagtggtgtgtatagatcggaggctgcagggcctcacccttagctgcagctgtcgcgtgctggggagcctgtgcaggagggtacaagtaggaaagtgcnatctgcatgggaagaaaaatgcagcgtccttgtagtgcggatggggtccaggagacccaggagctgcccagaggacctggtggcatnctgtagaaagcagccagntnggggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 675373 - DNA, 1740 bp, Homo sapiens
  misc_feature (1551)..(1551): n is a, c, g, or t
  misc_feature (1596)..(1597): n is a, c, g, or t
  misc_feature (1599)..(1599): n is a, c, g, or t
  misc_feature (1606)..(1606): n is a, c, g, or t
  misc_feature (1620)..(1621): n is a, c, g, or t
  misc_feature (1626)..(1626): n is a, c, g, or t
  misc_feature (1628)..(1628): n is a, c, g, or t
  misc_feature (1635)..(1635): n is a, c, g, or t
  misc_feature (1641)..(1641): n is a, c, g, or t
  misc_feature (1646)..(1646): n is a, c, g, or t
  misc_feature (1653)..(1653): n is a, c, g, or t
  misc_feature (1660)..(1660): n is a, c, g, or t
  misc_feature (1664)..(1664): n is a, c, g, or t
  misc_feature (1669)..(1669): n is a, c, g, or t
  misc_feature (1684)..(1684): n is a, c, g, or t
  misc_feature (1696)..(1696): n is a, c, g, or t
  misc_feature (1701)..(1701): n is a, c, g, or t
  misc_feature (1712)..(1712): n is a, c, g, or t
  misc_feature (1715)..(1715): n is a, c, g, or t
  misc_feature (1718)..(1718): n is a, c, g, or t
  misc_feature (1720)..(1720): n is a, c, g, or t
  misc_feature (1736)..(1736): n is a, c, g, or t
agcgagcgggccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgctctaccttctgtctgacggatatgccatcctgaaaaaggaaagaagctgaacttcaagttcctttcatttagccttggctctgcggccgtcacgatgttctggaagtttgacttgaacaccacgtcccatgttgacaagctgctggacaaggagcatgtgacgctgcaggagttaatggatgaagatgacatcttgcaggagtgtaaggctcagaaccagaagctgctggacttcctgtgcaggcagcagtgcatggaggagctggtgagcctcatcacacaggatccgcccctggacatggaggagaaggtccgcttcaaatatccaaacacagcctgtgagcttctgacttgtgatgtgccgcagatcagcgaccgcctcggtggggacgagagcctgctgagcctcctgtacgacttcttggaccatgagccgcctctcaatcctctgctcgccagttttttcagcaagaccattggcaatctcattgcaagaaaaaccgaacaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcactggctgaatgaagagaaggtcatccagaggcttgtggagttgatccacccgagccaggatgaagataggcagtcaaatgcttctcagactctctgtgacatagttaggctgggcagagaccagggcagtcagctgcaagaggctctggagccagacccgctcctcacagcgctggagtcgcaggactgtgtggagcagcttctgaagaacatgtttgatggagaccggacggagagctgcctcgtcagtgggactcaggtgttactcaccttgctggaaaccaggcgggttgggacagagggcttggtggactccttttctcagggactggaaaggtcatacgctgtcagcagcagcgtactacacggcatcgagcctcggctgaaggacttccaccagctcctgctcaacccgcccaagaagaaagcgatcctgaacaccattggtgtgctggaggagcccctggggaatgcccgtctgcatggcgcccgctcatggcagcactgttgacacaaacacacccaggatcaancaggagctctgccggtcaacacgatggacttactgctggacttgnncntttaagntacacctggaatannttttngnacttccnagtggnactantgatagncggtatntctncccangctgcccgtgagagnaggacaaagccngggancgagagcaggnggngcncncatgaacgggaccggnccgg

SEQ ID NO: 675374 - DNA, 1655 bp, Homo sapiens
  misc_feature (1349)..(1350): n is a, c, g, or t
  misc_feature (1355)..(1355): n is a, c, g, or t
  misc_feature (1465)..(1465): n is a, c, g, or t
  misc_feature (1552)..(1552): n is a, c, g, or t
  misc_feature (1570)..(1570): n is a, c, g, or t
  misc_feature (1572)..(1572): n is a, c, g, or t
agcgagcgggccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttccactgaatgaaaaaaattttcttaaagctgcatatactccaagaaaaaaaccacaaatgtttttctgttttgcctgaatacatgatttaaacaagagatttccacagaagctctgcgcttggaaggctgagatgggaggactgcttgagcctgcagtgagctatgattgtggcactgcactccagcctggacaacatggcgaaacaccatctttaaaaataaaatccagtctgacaatgtttgtctttaattgaaatgactatttgcatttaatgcatttattgaaatggttgaatttatgtctggtatcttgctgttttttttttttattttgtctcctctgtttttgttgcttatctccttgtatttttattattagttttggtcttttggattaatccagttgttttaaattatactactagaaaaattcttctagcaggatcctatttcgtcgatggtcttttgtaatccacccaggcttccaccttctctgtggctagaaacaggaccgtccagaagtcacctgtaactgccctatcttgcaagttctgattttggcaaaaaaaaaaaaaaaaagccttgacaaggttggattcacttctttccctggattgtgtgtcatccaagtacgtgagacatctggtagtgcatttcagagagaggagtatctgatatgtgtgtggaggcagccatcttttcctgaaagtccttttaggaatcattatttctggtcctctgaagtttgccgctaccactcataaatatctatccacaccccttacaagaagaataaggaagatcttaagacctagaaggaaaactgattgcagaccaggcttggtggctcagtgcctgtaatcccagcactttgggaggccgaggagggcagattgcttgagctcagcagttcgaggccaacctgggcaacatagtgaatccctgtctctacagaaaaaaaaaaaaaccccaccccaaaatcaaaactgaaggtagtgtcagtgtatatatggagtcccttgtgctgaaagtcaaagcagcttcatttgggggcctcaagagctccagctctgggctcttcacctctaagcnnatggncagtgcccgcccagtggtgtgtatagatcggaggctgcagggcctcacccttagctgcagctgtcgcgtgctggggagcctgtgcaggagggtacaagtaggaaagtgcnatctgcatgggaagaaaaatgcagcgtccttgtagtgcggatggggtccaggagacccaggagctgcccagaggacctggtggcatnctgtagaaagcagccagntnggtatctggggccaggagaggttttggagctgagatgagatgtgtagacaatcaagtaagttgaatagccaagccagagctgg

SEQ ID NO: 675375 - DNA, 784 bp, Homo sapiens
  misc_feature (223)..(223): n is a, c, g, or t
aactggcggatggaatatgattcccgctggccaaatggttatgaaaggcagaatctgcatcaaccctcctgggattaacaggaattgagccctcccctggtaatactttctgggctccaggggacccccttgtttccagacaagaagagataatagtcttccatgtttatggtgttttctgtgttttggtctccctggacccctttgggtgaagtattttttnccaagcgtctccaccatctgtttggggtagaacgtgttgattgggttgcacttgccccccacgcacccctaccgtcacgataatgttgtgagatgctgttaattctaccatacacgcccgtatccaccactccacggagaatgtaaaaagtgtgtttgtgaaagtctttcaacctgtagctctaatttcacgaacttgccccaagtattttgctactttactattatgggtaatactcttctctggcctagttcttacagagctacttaaatagaaatttacttttatggatagaagtaccagaattttgagaagaaactataattttcacccaattttaaggggaaaattgtccattatctaaaaatgttcttataatatctgccttcatcttacccttcatactctgaaattccctatagcagacagagctagggaaatatttaaaatttaccctatttattttttggaactaaatcacagccttaactataacattatgagagtaatgggaactactgctggctttaagtaaataaaagtcattgttttcaaccgtga

SEQ ID NO: 675376 - DNA, 237 bp, Homo sapiens
cggtacacctccaaagccactaccagcccctccaccaaaaccacatgctcactgcctgcctccatagcccccagctgatacccccagacacaaaccgatgttgaacatggtatgatgacaccatggcctcctgcccatgccactgagcctgccccctgataaccacctaccataagcctggcagatggagctcttgcagtgctggggttgtccttggctacggtggtacctgatgct

SEQ ID NO: 675377 - DNA, 831 bp, Homo sapiens
  misc_feature (504)..(504): n is a, c, g, or t
ggatatgggtgtctcaatggggaccttgtgtatcagtgttcccgatatagggtatctagtcttagatgctcccctgtccacaaaacgggatttttcccagatatggcggtctaccaataatttggtggacgccccgttcatacgtgtcacaggcgtgcgtgttgacaccacgctagggacgtccggttgggttaacgcttccgcctatctggtctttccatgtacgtcacagtaccgcgccacccctggccgattaactactgcgagggagcacaagaatttcgtagtgttgctaggacaccacaccagccgtaaggaagcctgggtccgccaaccccgaagctggcccaaacaaatgtgccaaaaacgcggtcttgttccccccctcgtggcggggtcctttaacccgctggggcacccctgacccgcgccataatcgccccccgtggtcgtgcccgccatagcattcgatcgagtggactacatatctgcccgcagtccacngtaacttgctcaggatttggatgctatcctccgtggctccccacgagatattggtgcgcccccataccgagtacaaaaatggcaacccctccagtcgctcccccccggtctttcctttaagggacctcgtccttccgcggacatctatgctgtttcttcccatatgcggccaacctatttaaagacgtcccccacattcagctttcggctcgtatgtccccgcacagcattcacgcggcggcggacacgcgccacatatgcaattgcactgctataggaggctgggaccaccgcccccctccatacgcccccatttcgcccacaaac

SEQ ID NO: 675378 - DNA, 505 bp, Homo sapiens
ccggcaacgtacaccttttttattaaggggcttctattgtgttctgaagttccatctctgtgacaacattaatatactttaaatacctgggatgtggtctggtacatacatggtggatgctgtgtgtgtattatatatactactatattatgaacacctgagtcatggaagtccttgcaaagtgtgccttaaaatcctcaacctttttaacttttctcatacatcgaagtcagtattcttatgaaggcccccatattgaaaaaagtcaccttgtcctgagaggttgtagccatcatcattttccagcggctgccatcttttattctgggaacgttttctgggttcactgacatcattactttgtactaagttttcctcgttgcttaaaaggctgctctgtagcaacaactgtctcatcccttcaaagcttttccaagcagtttagctatttgaaaagggggctttctaacttcatcttttcaaaataaactgctgggcatgcgtt

SEQ ID NO: 675379 - DNA, 650 bp, Homo sapiens
  misc_feature (420)..(420): n is a, c, g, or t
  misc_feature (498)..(498): n is a, c, g, or t
gttatattttacccagatagactcctggaattgtaggccccctaccaggagcctgttacctccttccaagaactactccccctccccagtgtctgcccccccccccacccctgccccgcgtcttctctctgggtggtggacagacaagaaaatctttgcacccactggcacctctcgacatcctgggaccctattccttcaggaaagccctctctctctcctccccgttctccatcagtcataactcctttctgaaaggggttggggacccagaaacatggttggactccttcaagtaatctggagcgagggcgagggctgccgctctgggaatcaggtgcgaaggtcaggaaggaagaagccagccttggttggctcatgccgcctgtgtgccccctgcctgcctgcctgcccccccgncgacccgtcttctgtaaggatcacggacaggaggctgcactgtcccccaggaacgaatgagcaccttgagggtctggnggtacctggagcaaggagaccggcagagggaagagggggtcgcttggtggaagagacatcacgcaggctcctgggtgggtttggagcaggtgaactctgtgttaataataccagaaaggtcttttggcggcgggtccttaggcctgtttccc

SEQ ID NO: 675380 - DNA, 212 bp, Homo sapiens
  misc_feature (51)..(51): n is a, c, g, or t
  misc_feature (93)..(93): n is a, c, g, or t
  misc_feature (109)..(109): n is a, c, g, or t
  misc_feature (116)..(116): n is a, c, g, or t
  misc_feature (118)..(118): n is a, c, g, or t
  misc_feature (169)..(169): n is a, c, g, or t
gccctcccgcgcttccccgggccacagggtcgcctgtcaacccggacagancccgcaagagcgtccattgggcggtcgcagcggcgccgagancaggaggaagccgganccgcgcngngccgtggatcccctcggcctcccgttggtatcttccatctcatgcgttcanattgtaacctcgcggcgggcgtgcagaccggacgcctcccgct

SEQ ID NO: 675381 - DNA, 138 bp, Homo sapiens
caattagggatttcttggggggtttaattttttttggaattttccataaaccagttattttctatttttacgcagataaaaatttgggcataaaatgtaaaaatagtaaaatgagaaaaataaaccttttttcccgta

SEQ ID NO: 675382 - DNA, 382 bp, Homo sapiens
ctacctgtctgaggaacccgagccctaccttgcagtctacctgcactcggagcccccgcccaatgagcgccactgctcggctagcccatggtagctggtgtgccggccagtacagcacgggcaagaccagtttcatccagtacctgctggagcaagaggtgccccgctcccgcgtggggcctgagcccaccacccgactgctttgtggccgtcatgcaccgggacactgagggcaccgtgcccggcaacgccctcgtcgtggacccggacaagcccttccggcaactacaaccctttcggaaacaccttcctcaacaggttcatgtgtgcccagctccctaatcaggtcctggagagcatcagcatcatcgaaaaccccggt

SEQ ID NO: 675383 - DNA, 726 bp, Homo sapiens
  misc_feature (508)..(508): n is a, c, g, or t
  misc_feature (638)..(638): n is a, c, g, or t
  misc_feature (647)..(647): n is a, c, g, or t
gatagcatgggcttaataaatgtgttcctaccagcttcttgccttctctgtagtactctgaattgctgtccatacctgcctcactcacttactctctcattcctttccttacttgatctctaccaggccatttttcatatttacatcaaagatacctgaagtgttggtatctgagaatatctggcactcctatgatctgagaagtgaccttttattgttacgatgactacagacctatatgtagatatgtagtcagaacaatactgataagcaactttgtaatcaaacatcttccagtgttaggaaggtgagaaacgttcataggcaagtctgctgttctatagcaccatcttctgtgtcccctagtcccccaggagctctttactttcccctctagttttgggtgtgcatgatgggagtctgtagtaggtgagttgtaatactggaccattctgccttgctatgggttgttgaagatagcacaattctattctgtgacccttgcccnttgcattcaccgtacttaccacctacctgtcctgtggctgttgagcagcataattatcccgggagaatgattcccctcatagacagacacaagcatccataccgtcctaggtaagtagtcacctggtgtnctgggaatntgctgggtggatcttgagccctgaacttttgtattagatcatacccctggtgagagtacaggccatttagacacgatac

SEQ ID NO: 675384 - DNA, 603 bp, Homo sapiens
  misc_feature (65)..(65): n is a, c, g, or t
  misc_feature (81)..(81): n is a, c, g, or t
  misc_feature (88)..(88): n is a, c, g, or t
  misc_feature (102)..(102): n is a, c, g, or t
  misc_feature (111)..(111): n is a, c, g, or t
  misc_feature (113)..(113): n is a, c, g, or t
  misc_feature (122)..(122): n is a, c, g, or t
  misc_feature (140)..(140): n is a, c, g, or t
  misc_feature (146)..(147): n is a, c, g, or t
  misc_feature (153)..(154): n is a, c, g, or t
  misc_feature (189)..(189): n is a, c, g, or t
  misc_feature (191)..(191): n is a, c, g, or t
  misc_feature (234)..(235): n is a, c, g, or t
  misc_feature (252)..(252): n is a, c, g, or t
  misc_feature (260)..(260): n is a, c, g, or t
  misc_feature (264)..(264): n is a, c, g, or t
  misc_feature (266)..(266): n is a, c, g, or t
  misc_feature (293)..(293): n is a, c, g, or t
  misc_feature (322)..(322): n is a, c, g, or t
  misc_feature (331)..(331): n is a, c, g, or t
  misc_feature (340)..(340): n is a, c, g, or t
  misc_feature (344)..(344): n is a, c, g, or t
  misc_feature (351)..(351): n is a, c, g, or t
  misc_feature (356)..(356): n is a, c, g, or t
  misc_feature (369)..(369): n is a, c, g, or t
  misc_feature (381)..(381): n is a, c, g, or t
  misc_feature (384)..(384): n is a, c, g, or t
  misc_feature (396)..(396): n is a, c, g, or t
  misc_feature (419)..(419): n is a, c, g, or t
  misc_feature (428)..(428): n is a, c, g, or t
  misc_feature (435)..(435): n is a, c, g, or t
  misc_feature (438)..(438): n is a, c, g, or t
  misc_feature (440)..(440): n is a, c, g, or t
  misc_feature (443)..(443): n is a, c, g, or t
  misc_feature (449)..(449): n is a, c, g, or t
  misc_feature (452)..(452): n is a, c, g, or t
  misc_feature (471)..(471): n is a, c, g, or t
  misc_feature (480)..(480): n is a, c, g, or t
  misc_feature (484)..(484): n is a, c, g, or t
  misc_feature (533)..(533): n is a, c, g, or t
  misc_feature (540)..(540): n is a, c, g, or t
  misc_feature (593)..(593): n is a, c, g, or t
cgggcgcgagccatggaggagggggcatcgtccccggggctgggctgcaggaagccgcacctggngaagctgaccctgggnatcacgngcatcctagaatcntccccaggngngactgaagngaccatcatagaaaagcntcctgnngaacgnnatatgatttcttcctggggacaaaagaataactgngngatgcctgaagatgtgaagaacttttacctggtgaccaatggnntccacatgacatggggngtgaagcngggngngcacatcattccactggggagcatggnaattaacagcatctcaaaactgactcagntcacccagncttccatgnattnacttccnaatgnacccactctgggngacctggggggnggnacacatgaagcnagtgatgatcagccagagaggcntcactttgnctctcgnagngnggnatttgngcngggttcatgcaatgggggnggggaagtntgcnttgtctacaaaagtggggaaccagcattagcgagaagacactgagatcngggtccnggacagagcgttatactggcattttctcacagacacctttactgcctattacngcctgctcat

SEQ ID NO: 675385 - DNA, 878 bp, Homo sapiens
gtttctacagtaaatgtacggcggcgaagtgctaaaagggaacggtcgatgaacaaactgtaattaataactttctctgtgaaagctttggaaaacatctttgtttattgtcctttttttgggtcacaccttgagggctgagataacagcctttgtgagtgcacaaactggggtacgtgctgaagctggtggcacagtaggacctttactttgggatgagccccactaccgttggttggctcacattgcttatagccattacaacattgggtaccatatgactatggagtctggtgaaacggtgtacagtgctgcgaggcgctatgttaaacattaaagaaggaaactggtaaaatactccttaactgactttcattctcgtaaggctctctcgtgaatttcgtgaagctgctggtattagcttaataatctgcggcattctaaaccggacgagctacccgacggattatactgggactctatggaatttgaaaagaacttggtcaggaataagattcttaaggcagtaactctgtacaacgctgctaggcatagggcaactactcgtgccaatttttacctgtgacaaacacaacttggtttccaacaattggggggggtcattacactgtgagttgacaccataattaggatggtggcagcaggttacacagggggcctatctccccttagggagctatcctcaacccctaagggggttaaactcacgtgggggcaacccccttaagttctcgcagaagggaggccaacaactggtccgggccacttaggaccccaggaaaagggattgcctcatggaataagggagggacaaaccaatggcacctatggtgtggaaactaaggctctatgaaggg

SEQ ID NO: 675386 - DNA, 276 bp, Homo sapiens
actctacaggatccccgacgagttgtccgagttatcttaacagtgacaacaacaacaaattggggagatatacagaagagaactccataactctttcgacatgtagtgaggcagagtctacgaagtaccctgaagcagttgggtgccgtgaatcctggtggtgcttcagccaatgatggcagcagggctggccaccgtggaaggcaagttgactgagggcttcctaactcaagtctttgtaccacaagacttctcagttgaccttcaaagcaccgg

SEQ ID NO: 675387 - DNA, 126 bp, Homo sapiens
gaaaccaatgtcttgatatgacgttggagaggggtgggtctcctgagccactcacatggaaagtcccttactcggccccttcccctcagtcagtatacaggcacaaggctctccctgccctctcca

SEQ ID NO: 675388 - DNA, 1167 bp, Homo sapiens
cggcgggtcgctatcgcggggggtactagtggcgccgccgccacgagagcaccaaacgctcgtactggcacctctgtatccatgatggacttggctgttggaaagaggactgtcaccgatccctgggacgctcagacggggtgacagatgtgccgttgcttccccatgtgttaccctacgtattgtaccttgtgattggtcatcaatcgctcctaattgcgtgggcttgggaaatggtgctgttcccaaatgtgtcagaagaaacagtgtctcccaccatgatgcacggaacagtgaacggacttagaaaatcaagtcactgaattgaagaaagagaaacgtttaacctaaagactccgcatctatttccttgaggaaggaatggaagctaggaatttacatggcgcccagctgaatgatatctagaaaagtagcattgagctcgaggtggaatgtagagaagtctgaagcgggaactccaggagagagacggagctgcgtcatcaaaggctccaaagcagtggagatgcttagctgaagcaggtggctctgaaatccagcgggtgacgagacagatgctcgaaagaaggtgcagcaggtggaagatctcgtaactataagaatactccttttggaaaaggatgtgacagcctgccaggcagaactgggaaaaggcctttgcagggacagagacggagaaggctcttcggtatgcgtttggaacagcagctttcagagatgaaagaagatgccgaggggggacttggcgaatgggtctggtctgggatgagaaagacagatgattgaggagttgaagctgttgagaaaaagaaagaaagttaatacgaggctaagagtgcggaacacctccgaagtggagtggtcacgcataagcaaggttgtgcactgagagaaagacacccgacggaccacggtggcgcgcgcccacgtgggaacagccgagcatgcaaactgtggtctgcccaccaatgttgaccacacaaggggcgaagacacatatacaaaggagacacagacgagtaaaacctgcaataaagcacgaacacctgatgtactacaaaacaaacaaaacaccgacgctatgtttgtgggcacagaaacgagcaggaggcaacacagtgaaggaaaggccaagtatagaagaga

SEQ ID NO: 675389 - DNA, 547 bp, Homo sapiens
  misc_feature (400)..(400): n is a, c, g, or t
  misc_feature (475)..(475): n is a, c, g, or t
  misc_feature (477)..(477): n is a, c, g, or t
aggtgtagggagtaaggaggctcccaggaaccggagctggaaatccgggcgaggtccagccgaggagcccaagagcgcagagtgatcccctcgtacgctgtgcaggccatgcggggagactggatgcaaactgcgatcagggaagacggagcgagcctcaacgaagcaggattgcagaatgccaagagaaagcctgttgcgtgagcgttacgtctgtgcgagagcttggttgtcatgtgccttagtagggtggtatgggactgagttgccaggaatgctggtagcgctgcgcgagtatcgcttaaaagggtgtgagcaagcccctggtcgcgaaagcatttataccggctccatggccacatggtgtcgccatctgagtgtcataacgtcgtggcttggntgagaggtagaccgtcggctgaagaagtggggcaaaagcctggaatacgctgtgtgtggcaccgagtgcgtgacnantccagcacaatgcatagggggtggcagacggcccaaataccacacgcatggacggcctcacgttccgtgt

SEQ ID NO: 675390 - DNA, 1837 bp, Homo sapiens
  misc_feature (882)..(882): n is a, c, g, or t
  misc_feature (911)..(911): n is a, c, g, or t
cgaacgagtgattctatggctatatacaagcgtacgtcgagaaggcacctaacgtatgctaggtcgcctacgcgtgcgtactagaatgcttgggtgacgccggtagacactctgtcagcaaaagagccacacttaatgacgccaggcacgatcatacgcatctatccttcatactagtctaccgcaccacgactcgttaggctctcgagctagtcgcgtcttgctatcgtatggatagcccctctcctaagccgactcatgctccatagtgcgctcctggtggaagcacatcaaagcatcatgggctcgtgctcgtatgtgtagttcatgagcaccaagcacgtgcgttagtcctgatgcgctggaatgaacggccaaagtacacctccgtaggagttccgggggatgcacgcaattcgaaataggttctgaaagctcatggcccgcgtggagtgccggcacgggcgatctggaagaaacgccgcgacgtccgcgaattccccattgggcggtccattcattggtagaagttgcaagggcccatgaggccaccaaatccattgttcctgagcttccatttcgaggacctattgcatcgtactatgaaaagcttgagggtgcgcctttttcatagcctttgcggtccccaaaaccccttcttcactaaggagccaccattaacacatagagaaaaccgagcggcttcccgcgagcagttcttatcgtgaccgcgtgagacctccattgcaattgccaggcccgcattatgaagagcgcggaagttcaaacagtcaaatgggagtttcaaaaagatgggataagacacaacctaaccatacagttttcatggcaaggccattccccaacgctcctagaaaaatntccccccccttaagatgattcacagaacncccacattttgtagcggattccgatagacggtggcgtaaccgattcacaccaggaaaaatacataatcggatatccgtaccaaagcagcccgtgagccacagagaacagttcgtagcaacaatataacacacgcgctaggtacacagcgggcacccacactgtttgtgcggggccccacgtaaggttctcttaatccacactaaatgtaagcccacgaaaaagtacactacacacagtaggacacttcaactataggtaggcaggtccacacagacacaaaaccaccagctatccaacgcacacagcataaacctaacaacacagagacgccccgatagcggggacaacccgacgacccagcctaacttgggcaaccgtgccagacccaccactagacagcccaggtgaaacacggtggtgataaacacacagacagcggcaacatacgtgcctggtcgccgaacgacaaaggaagagccccgtcaaagcgcagaccacaacacacaactcacccatgggaagacgtgtgaagtgacaaacactacagcgccggcaagaccaaatagtcaccccccgccagtagacagcgaccataaggacaagccgcaactcagaaggcagcacgcactcgcatacagcccaacctcagaccacgcggcctgcatacaaagagggctaggcagccaaaaggaccgagacagccacacagatcgacccatgaggcaccacgccaccaccccaattcggaccacagccggcagagacctagatcccacactggacaaacccatcaaactagaagaaacggcagggagcgcgcacgaactcacagcaccaacagccaccacgagacagcaccgaccaaagcagcgagcacgcacagtgagagcactacacgccgcccgacagaagcgagcaaacaaca

SEQ ID NO: 675391 - DNA, 752 bp, Homo sapiens
aggttatgggacccagtagacgggttcagatgtcaggaacggactatggttgtcatcaccacaggaatgacaccaaggcaagatgtatttcgtacacgcagactgcgataaagaagaataaccccaggaagtaccttcgtcagatgtaggagatggagagactgtggagttcgatcgttgttgtaccggcgcaaacgggtgcggaggcagcacaatcgttacaggtcctggtggtgttccagttcacggcagtaaactatgcagtcagacacgtaaccacttatagacgctatccagcgtcgtaggggtcctccacgcaattaccagcaaaattaccagaatagtgagagtggggaaaagaacgagggatcggagagtgctccacgaaggacaagcacacaaaaaacgcacgacccctacacgaaagagcgcagagtacccaacctctcactacactgacgagagacacactaatggggacagtcaaacccaaagatacatcccacacaccctcccatgtcgccgggaaagcacagatgaatgagaaagggaatggcaaagaacacacaccaagaggatgccaaagaaagaaacaaacaggtaacacacccaaatcgaacagccacgcaaaacatagacaactcagacgcacacatactaccacacgcacacgaaaaccacaaaaaagaagagccacaccatcaaaccaaaaaaacacaaacaaaacacaacaagaaagacacaaagcaaca

SEQ ID NO: 675392 - DNA, 240 bp, Homo sapiens
gaaaggtgtcccgtcctggcatatctgtacggaactggatattggcttgctgtatgtatgtgaccaggtagtgaacaagttctgacgcatctgctggtcaaagtaacccgcgtaggcgatgaacgcagcttactagagacagtccccagctattggtggacatctggtttttgatccgtttcacttgtttttttccatcgttcacgttcagcagactatgctcttcagaagggcagtgct

SEQ ID NO: 675393 - DNA, 258 bp, Homo sapiens
atgagactggggcctaataaaaaggagcgtctatacaggagcttaaatgggctgtaccttgtagcattgaggacaggcctgaattctgagaagcaaaagtggtaaaagtatcgtcagtccttttaagttggtggctgagcttggtgagctgtgtttttaaaagatctttagtccgttctacttttcttgaagacggaggaccgtaagggatataaagttttcactgaaacctactaagagcctgaaaaactgcttggc

SEQ ID NO: 675394 - DNA, 371 bp, Homo sapiens
ccttgctcggaggtgcttttcatagcatcctttttaattaaaggtcaaatacagattgctatatgatgtccgaaagaacctgatactacttcgagagtttctgctcagaagaaaatgagagttatcataataggtagctgtggcggtccatgccaggtgtggtgtgtcacatacagcgatgagagtggctttcacaccttttttttttttaagttcacaccctcctttacccccagcagtatctcaggttatagttatcagagatgcagcagtgacaaatggcattcttacttgtaacctcgtgtgatgatgcttatcattttgaaatagtattataaaaacctggtcccgtttcaccagacatgaatttc

SEQ ID NO: 675395 - DNA, 151 bp, Homo sapiens
accacagttaccaagaagacttatgagatctggcattcgacggcatgactactagctgctagcggcattataaaccatggctatgcccgggtgcgaagacaatccagaatagacccaccgtatgcatcctcaattgagctttcaagggtga

SEQ ID NO: 675396 - DNA, 139 bp, Homo sapiens
aggaagtcgatcgagccggtaccttttctttataaattacccagtctcgggtatttcttctagccttatgagaatgtactaataaacacatgtagcagcatatcgtttttttcgtgtgcacaacctggtcgacgattca

SEQ ID NO: 675397 - DNA, 138 bp, Homo sapiens
tcctcctccagggtcctctgcagaccaggctgagatggaggaacctgctaacatcgctggagattcttctagcctcccagtagggaggcgccagaaatgctatcaagctggcaggcggtgtcgtcactcttcatcctc

SEQ ID NO: 675398 - DNA, 457 bp, Homo sapiens
gtcagctcggccgaagttccgaatggaaatagatcttaagaagatgcacatatatccaactgaacccaacaattaaggttttcttccaggaatacaagaatggcttaacatgagacaactatctatctaattaactggatctatgaattaaagaaggaaaatcacatgatcatcccaagaggtacagaataaaaacatctaataaacatttacgttttaaaattctttataaatggccaacacagtgaaaccccgtctctaccaaaaatacaaaaaattagccaggcgtagtggtgggcacctgtaattctagctactcgggaggctgaggtgggtggatcactaggtctggagttcgagagcagcctggccaagatggtgaaaccccgtctctactgaaatcacaaaaattagctgggtgcgatggcgggcgcctgtagtcccagccattcggaag

SEQ ID NO: 675399 - DNA, 458 bp, Homo sapiens
tcattccttatgagaatctgatgcctgatgatctgaggtgtaacagtttgatttcgaaaccatctctccccagctcccttcccattcatggaaaaactgtctttcacaaagccagtccctggtgccaaaaaggttggtgactgcttaattagaaagtgagcatagaacttatcccaatcagatttgatggatgaatgaaaggaagaaaactgactgttcttagtgtttgctggaaagaggaaaaccatgagcaatgggataaattaaacatttcagttgaataaatgtttaccaaattgctaataaagaataggctctgtacttggccttgggcaaacaatagtgtaaaatatacagtctgccctctagttgcttattggagtgagcatagtacattctgataaatgtacaagagctagaatccagaacatagaattttccttgtggatttgtttaaa

SEQ ID NO: 675400 - DNA, 251 bp, Homo sapiens
tacaggcgtcgcgccaccacgctgactatttttgtatattagtagagatggggtttcaccacgtaggtcacgctgatcttgaacccctgaccttgtgatccgcccacctgagcctcccaaagtgctgggattgcaggtatgagccactgtgcctggccaggaagcagatttttaaaactatttttactttcttactatagcaacatgagatactgagggttaagatgaagcacaaaagacgaaaaactgcc

SEQ ID NO: 675401 - DNA, 409 bp, Homo sapiens
  misc_feature (338)..(338): n is a, c, g, or t
  misc_feature (346)..(346): n is a, c, g, or t
  misc_feature (386)..(386): n is a, c, g, or t
tcattccttatgagaatctgatgcctgatgatctgaggtgtaacagtttgatttcgaaaccatctctccccagctcccttcccattcatggaaaaactgtctttcacaaagccagtccctggtgccaaaaaggttggtgactgcttaattagaaagtgagcatagaacttatcccaatcagatttgatggatgaatgaaaggaagaaaactgactgttcttagtgtttgctggaaagaggaaaaccatgagcaatgggataaattaaacatttcagttgaataaatgtttaccaaattgctaataaagaataggctctgtactttgccataatatttnaaaacatnacctggttagagttctaagtggtacttatttttgtttggntaggggaaacctgaataaaaaca

SEQ ID NO: 675402 - DNA, 398 bp, Homo sapiens
caccaccactcatctgcgacagttgacagcacgagggtgaagcgcgagcatatgcacttgcggcaatcatcttgtcgcaggttgctattctagggcaagctggaggagagaaggctcaataatgccacctcgcaggcgcaacaccaggtgcaggctggactctttctggatgtcgtagtctgatagagtgcggccatcctccacctgtttgccggcaaatatcagacgctgctgctcaggtgggataccctccttgtcttgaattttaggctttgacattctcaatggtgtctctgggctcgacctcaatgggtgatggttttgccagtgagggtcttcacaaagatctgcatgtttgcgtcagctcggccgcctcgctgaagcagatgaggtggtgg

SEQ ID NO: 675403 - DNA, 830 bp, Homo sapiens
gtctgggtatggaaagcaagcctacgtagctcactattacgtataatccttttcttttcaagcatagtctgaggatagtgcactcatggtagaggaggaggtaggtagactttattgcctatcatggctcgcactctaagcccaactacatgtatctacatacatacaataccttctatatactaattatggtatatataatcctataccggtagttgtatctctacactgctacctcagactgccttgtgtactcactatttcactatgtacatccttatctgcctcctctataccaccactctcatcgttcctccgtcgttacaccacgcctgtcattcttcgctctctcttttcctccctctcccacagagcaatgttactctctctgctctctcgcgccttccatctccgctgcactcggtcccttgcacccattttgtcttgactactacatatccctctctctctgccttctccctctctgtcccccctctgcgtcccttcccgcttcttcctatctggctacggtccctcttcctctatcgcttcttgcctgctccgtaccatctctctcagtcccttctgcctccctgcctcctgcctctgctcctggcctttgtcctctaccctggtccctaaccctctggcgccgtctccgcccccttcctcgctctgcggtctgtcgtctcttccaccctccttgcactcggtcttgctcttcacatctgctatggctctgtttcttctctttcttggtctgtcttgccgtctcctctctcttggtctccctctcctcctccccctgtcctcactctccatatgtgact

SEQ ID NO: 675404 - DNA, 161 bp, Homo sapiens
acattgcatgatatagggtgaccagggcaactcatgacgcatattctctttaaaattgggacaagagtaaactagaccatatgcggtcttggcgtttcaccaacatatgtgactttgtacggaccgatacgtgaaacgaaataaatgtgttctcttagaag

SEQ ID NO: 675405 - DNA, 453 bp, Homo sapiens
gtagctgtgcccgccaaggtggggcattaccttggtggatcctgaagacataaccttggggcagagcttgggaacatgttgaaagtgtcttgaggtgcccttgggccatgtgtcgtgcgaggaccccagaatctaagcgcgtgttcccaaggttgccggcgttgattcatccgacaggccctgattcctgggagcaccaatcttgtacccctttacagaccttaatggctcccgaaaaaattcatagacttcagaaggcccttggattgccgctgaactcatccttgggcgcctgcgtaaattgttacggatgcgcccgagaagacagtgaatggcgcaggtagtgttgcaccccaaagaggaccacgtgacaactgttgagatgaccgggagaccccaatggggagtggagcctccaatagcgtcgccatacctactgttgagacccctaag

SEQ ID NO: 675406 - DNA, 368 bp, Homo sapiens
ttcattacgcaaatgaagtatagtgcgatagaaattgaaaccttggcgcattagatatcgtaccgcaaggcgagagatgaaagtattataacctagcactaatatatgcatggactaaccccttataccttctgacatatatgacttaactagcaaataactattgcaaggcagagccagtagctagagacccctcgaaaccagatcgagcttacctaaagaacatgctaaatatagcacacccttctatataggcttaatagttgggaacgatttatagtgtagaggcgactaatcttccgagccgggtcattgctggttgtccatagattataatcctagttcaactttcaatttgcctttattaa

SEQ ID NO: 675407 - DNA, 348 bp, Homo sapiens
tttccttgggggggccttgggccccctttttccctggttttcctttttaccttgggtggggcccccctgggttgggctccttccgggttttttggttccccccccgggcccctttttccttgtgttccattttgtgtaaggggcctgtgggggggcgccccccccaggctttttttagagacccccgtttttggggccttggggccccttcccccctttcccggttttttgccccggggagggggggttccccaactttttgttccctttagggggggtttggccccccgggggtgggccccccccccctttggtttttttcccccttttactttttttttgtgggga

SEQ ID NO: 675408 - DNA, 179 bp, Homo sapiens
ctaaaatgtgaggaaattgtgatttgttctctcccccccaaatgaattacccatttattattttctatcattttgaaacactgcagtttaccatgggaccctgtatatatttcttgccataatggtaaagggctgattgatatatttaagagttaataaatttgtgatttttgctgcca

SEQ ID NO: 675409 - DNA, 620 bp, Homo sapiens
cttttgtctttccgtggagctgtcggccatgagagtgtcgcagctgtgcagttatagcggtgtacaagatctaccccggacacgtggaggcgctacgccaggaccgacgggaaggtttccagttgtctataagtgcgaaatgcgagtcggctttcctattccaagaggaatcctcggcatgataaactggactgtcctctacagaaggaagcagcaaaaagggacagtcggaagacacattcacaaagaaaagaacccgccgagcagtcaaattccatgagtggccattactggtgcatctcttgcgtgatataatggccaatgaggaatcagaaccctgaagttagacatggctcacacgcgaacaagctatcagggctgctaaggaagcaacaaaaggataatgcaatgcatctaaaaagactgcaattggctgctgctaagaggcacctacaagagggcaggtaccctaagcacaccgaatgtgaacgccgtgttgacaaggttggcaggcatccccgcaggtggtggacaaaacggctaacactggcaagaattaagatttacgattcacacgactcggctatacacctcttacagacagaacacagacaaaacag

SEQ ID NO: 675410 - DNA, 85 bp, Homo sapiens
aagctaaggtgcccggtagctttaatgagcaccttttcctcactttgtccctccctctctactcttccccttctgtcgtcttctc

SEQ ID NO: 675411 - DNA, 822 bp, Homo sapiens
  misc_feature (2)..(2): n is a, c, g, or t
  misc_feature (64)..(64): n is a, c, g, or t
  misc_feature (66)..(66): n is a, c, g, or t
  misc_feature (77)..(78): n is a, c, g, or t
  misc_feature (82)..(82): n is a, c, g, or t
  misc_feature (110)..(110): n is a, c, g, or t
  misc_feature (122)..(124): n is a, c, g, or t
  misc_feature (129)..(129): n is a, c, g, or t
  misc_feature (142)..(142): n is a, c, g, or t
  misc_feature (174)..(174): n is a, c, g, or t
  misc_feature (199)..(200): n is a, c, g, or t
  misc_feature (210)..(211): n is a, c, g, or t
  misc_feature (228)..(228): n is a, c, g, or t
  misc_feature (235)..(235): n is a, c, g, or t
  misc_feature (251)..(253): n is a, c, g, or t
  misc_feature (257)..(258): n is a, c, g, or t
  misc_feature (262)..(262): n is a, c, g, or t
  misc_feature (264)..(264): n is a, c, g, or t
  misc_feature (268)..(269): n is a, c, g, or t
  misc_feature (274)..(274): n is a, c, g, or t
  misc_feature (276)..(276): n is a, c, g, or t
  misc_feature (279)..(279): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (306)..(306): n is a, c, g, or t
  misc_feature (308)..(308): n is a, c, g, or t
  misc_feature (318)..(318): n is a, c, g, or t
  misc_feature (326)..(326): n is a, c, g, or t
  misc_feature (333)..(333): n is a, c, g, or t
  misc_feature (339)..(339): n is a, c, g, or t
  misc_feature (341)..(341): n is a, c, g, or t
  misc_feature (353)..(353): n is a, c, g, or t
  misc_feature (356)..(356): n is a, c, g, or t
  misc_feature (364)..(364): n is a, c, g, or t
  misc_feature (366)..(366): n is a, c, g, or t
  misc_feature (372)..(372): n is a, c, g, or t
  misc_feature (377)..(377): n is a, c, g, or t
  misc_feature (379)..(380): n is a, c, g, or t
  misc_feature (386)..(386): n is a, c, g, or t
  misc_feature (404)..(404): n is a, c, g, or t
  misc_feature (409)..(410): n is a, c, g, or t
  misc_feature (431)..(432): n is a, c, g, or t
  misc_feature (455)..(460): n is a, c, g, or t
  misc_feature (462)..(463): n is a, c, g, or t
  misc_feature (468)..(468): n is a, c, g, or t
  misc_feature (477)..(477): n is a, c, g, or t
  misc_feature (486)..(486): n is a, c, g, or t
  misc_feature (490)..(490): n is a, c, g, or t
  misc_feature (504)..(504): n is a, c, g, or t
  misc_feature (517)..(517): n is a, c, g, or t
  misc_feature (528)..(528): n is a, c, g, or t
  misc_feature (545)..(545): n is a, c, g, or t
  misc_feature (644)..(644): n is a, c, g, or t
  misc_feature (710)..(710): n is a, c, g, or t
  misc_feature (731)..(731): n is a, c, g, or t
  misc_feature (798)..(798): n is a, c, g, or t
cnaaggaaaaacgttatgtcttattacaccatgatcctggctaatagcttttcaaaactttgananaaatcttaaannccgnttcccatgtcacctgaccctcacaaatntcccattatcannnacggnctgcctccccccncttcccacgccccctacccccccccccccctnccccccccccccccccccctccccnnccttcccccnnacaatccttcctccacngtggggngatgttattgggtggnnnggtnngttngngggnngggtntntgngtctggtctggngtnttntgngatttntntgcgtttttntgggtggntggggtnggggtntngttggggttgtngtntgggtggngngggggngttgngnngggtgnggggtgtggtggtgtcgngtttnnggggggggggggggggggggnnggggggggctcagtgtggggtcnnnnnngnntaagngccagttgntccattggntgcngggccatagtttcntccaccatatggnccccccatgtncctgctaccgccggagngtcgcgctcttcattgggcgcgtagttagggggttgctggttataatttccaaaatcattgtaatttccacttccataatttcctcctccatagttgtnataaccacctccgtagcccccaccctggttgccatatccaggtcctggtccgaaatttccaccgcnaccacgtgaatccccaaagcnaaagttgcctcctcttccactcctagaactctgaacttcctgcatttcttgtctagaaaaggctttnttacttctgcattatgaccattga

SEQ ID NO: 675412 - DNA, 908 bp, Homo sapiens
  misc_feature (577)..(577): n is a, c, g, or t
agaaacattgctgaagagagctggagatgtatgctaacagtgtttcgtcgcgagacgtaagaatgcaaggagggtaaaggatagagcgccagaaacatgattgagaaaacacacatggtttcaccatcttcgtgcagatctcttcatacatggctaagctcttgaatcacaaggcgagacagctaggggatatgatcgagctatgcacaaatacaatagagatcagttcgtcgtcgagaggagaaagcggaagtgaaaatttccataagatcctggcaggattgcctaccccagaactctttcgagacccctagtcgtgatgtgggggcacagagccaccttgcaagattggacacgagccagaagctgcagcgtgtgacacctgggcacctccggcggctgagtgcccaccggcctgtgaggtctcttcgaggggggaccccccgcccccaatttctggaactggccacacatgcttcgcgggtttgtgcgcccggggcgataattggtacgaaacaataactggcgtagttcgaaattacgtagacacccgtaatattatcaaaattctcgtgcnacagtggggaaaaaaacaacaaaaaaaaaacaaaaaaaaactttttttgcggccgcgtcctgcggccccataagaaaaaaggttttttctataagacccacatctgggttggcgcggagcgcgggcacccacgatggtgtttacggttaacacgtgtggtgcatatagcgtggttcccctagggacaacctcctgccgccaaggaaccaaggcggtgagggattctccaccaaataaaaacgcgcgcgcgggacacaggagggttttgaaccaatccagagggagtgaggggccaaagggaccttacaccgaggtcaaggaaccaattatc

SEQ ID NO: 675413 - DNA, 968 bp, Homo sapiens
  misc_feature (383)..(383): n is a, c, g, or t
tgcccccctcgagaagattttgataaccctccgctgttttataaggggccaaccgttaattttattgctcccaacactcctcccacgtggcgcccagccctcggggggaggttccacagctgagagagtttgtgtaaattattctcgggaccgacaaaattttacttgggggagtggtccaaactaacactatgagagagttgtgcccaacatgatggccccccacagtgtagcgcccttctcccaagaaaggggttaaaattcttgtggccccgaaagtggttaactaccgcctttctctcttgggtgtgtgaacacatatttctctgaaagaggttctccccccttcgtcccacgaaatatgccacgtttttagtttattnaggcccttctcttcccccccacggttgttctttccgcctatttttaccgtcccacttttcccttacacccttatttttgaaataattggttccaagattcaccacatattgcaaaaattggccttacatcttgggataataattttacacccttcttgccatcatactttaacattgagaatagaggagattggtcaaatagagggaacaatctgggtctatcgccctttttaaagtagttttttttaggagacgtgtccagaccaagttgttgttgcaagtagctggagttgtaacatctgcggtggacattttggcaccacatcccacccattaaggacttataaatgttgccacattattcgcccaaaccgggtggtattatcccccgtgacatccggcaccacacatttttttggagacgctggtcccgtgacccaaacacaaaacattttttttttttttacttgcttttttaacatttttttaacccccttaaatattgtcttttgggcccatattgtcccccaaaacccctcccagattgtgaaattttttttccccaaaaaaaaatttcccatttta

SEQ ID NO: 675414 - DNA, 278 bp, Homo sapiens
tggcgccagcgtttggctcttttggtcccggctggcgtgcaatggcaggctctcggctcactgcaacctctgcctcccaggttcaagtgcttctccggcctcagcctccctggtagctgggcctccgggtgcgtgctcaccaggctgggctattttggtattttaagtcgcgcgggggtttcaccatgtgggccaggcgggtctcaacactccggcactcgaggtgcatccatcgcctgggccattgccatatgcaagggtcccgagctcgcaaatcg

SEQ ID NO: 675415 - DNA, 146 bp, Homo sapiens
atttcatgcggtgagccatctgcattaacccctcccttgctgtgctcagcgtacacaaatgccaaggtcactaatcactcagttccataagctttaccttgctctccttatccccctcatagaatgtctgcattttggccaggcgc

SEQ ID NO: 675416 - DNA, 193 bp, Homo sapiens
ccggttcccagacagaaatatcatgttggcttctgttccttttctctccttctcagctgccagcaatcttaatgatctgaaggtctactgagattgctcacatgggtcccacagtcacatgttggaactcaacgccctcgatgcttaacacacccgaatgggcccagcactgatcatcagagcaaactccggc

SEQ ID NO: 675417 - DNA, 1069 bp, Homo sapiens
agcggaggatacctcacctctatctgtatagaaacaccctcaagggctgtttgtacactttccatctgttgaagctgtaatctcaggatatggtttatttcttatcctacaagaaaatttgtaatcataaattatacacataaaactcacaaatgcatatgtaaaacattgattcttcagttatgttccaaatgttttcttcaatgtttaggatatttaaataccttttacaattatcatcactcgattagactgccctatcatgtgggcacatagcaaacattaccttcatgaatgtactctgttttaaatcttttcttctttttcactcaccaaaaaatcagatacattttcatatcagactatcctgcctcaagttactcttcttcttaccaaatagagaaatttctctattaggagtttttttgctgtctttaatttacatatcataaatatccctatcaaataataaacaatggctcacgcctgtaatcccagcactttgggaggccgaggagggcggatcacaaggtcagcgagattgagaccatcctggctaacacagtgaaaccccgtctctactaaaaaatacaaaaaaacaaaacacaaaattatccgggtgttggcggccggttgcctgtagtcccagctactcacggaagcgctgagcgcagcgagcaagtgcggtgaaaccccgggagggcagaacctcgcagtggaacccgacacatgcccgcaccgtgggcccccaccctgggcgcctacaggacccgagtctccacgaatacacattgacatcgaagccgcgacaaccactcctatacacaacgccatccccacactgcacccacctacatcccaggcaaggcgcccccaccactaaagcgacggagacaactaccgctctcaagcccagccccaccaaagccaacgatattccgccccgctaacacgcgagaccccgtgggggcacacccacccccacgcggaacaccaacgccgaaacagcagcagacccccgctcggacaatctcacaccaccggagcgctcagcacacaacctcgaacg

SEQ ID NO: 675418 - DNA, 293 bp, Homo sapiens
  misc_feature (91)..(91): n is a, c, g, or t
gatcacgtgccatgtgaacagaagcaatgtgtgtccttctttttttttaattttttggagacgggagtctggctcagtcacccaggctggnagtgcagggcggcgatctcagctcactgcaagatccgcctcccaggttcacgccattctcctgcctcagtttcccgagtagctgggactacaggcgcccgccaccacaccgtggctactttttttggtattttaagtagagacgggatttcaccaggttagccaggagtggtctcgatctccgtgacctcgtgatccacccg

SEQ ID NO: 675419 - DNA, 519 bp, Homo sapiens
acggatacttgatcagcactatggagagccatgtagtggaaatgaagctctgcatcagcatacttgagcttctatcagtgagaaaactgaggctctgtcaatagccaataagggaatgaggttcttgcaaaaaacatgaatgggccacttggaagcagatactctagccccagtcaaagctttcatatgggttcagcctttagtaaacatcttgacccattcttgatcctgagccagaactactcagctaaaatgctcctgaattcctgacccacagaaattgtgagataactgtttattttcccaagctgttaagtttggcaataatttatggtgtagcaatagataattaacacaatcaaactaccaaagcttgctcaagaacagcttcacaatgtcctatatccgtaaaagaaatggaattcgtggttaaaacctttcaacagagaaaactccaggtctggatagtttcactgttgtattctatcaagcatataagacagacagaaaaaatgcagt

SEQ ID NO: 675420 - DNA, 158 bp, Homo sapiens
ttctgggtactctacaggatcttatggagaccacggtgagggggtcacacggttaggtagaagctgggcgtgacgaatctgctgtgaggcagacgttgggactgtacgaggctgacgggaggcacactgctgggcctggagggcccaccaagaatgca

SEQ ID NO: 675421 - DNA, 166 bp, Homo sapiens
attgccccctgccccccgcccccccagtttgtacggttgcaacagtgttccttttctgggttttaatttttgagcaaatgattgtgctgtgggaacagcacacagtgagggtgcctagcccaatgtctggcccaaagtaggtgcttaataaatatttgttcaatta

SEQ ID NO: 675422 - DNA, 238 bp, Homo sapiens
  misc_feature (27)..(27): n is a, c, g, or t
gaggatcccgcacagtggcacatgccntatccaacatttgagagactgaggtaggaggatgcttcagcccaggagttccagaccagcctgatcaacatggtgagacctcttctctacaaaaaaaaaaaaaaaaaaagggattagaaaacaggcttgtaaggagcaaaatggggggaaaggggaaaaataggagcaccagaattgtccaggggaggcgctcacaggggctggggacccg

SEQ ID NO: 675423 - DNA, 290 bp, Homo sapiens
cgacatatctataacatagaggtgagtggaccatgtactactagatcttaaggtgggttaagcttttccagatagtcaaatgttacctctctcctactcctctgatataacagtattgaatgaatgttggctacaaaatcaattcttggtgtcgttatgaatctcaatataaaacttttggaaaggttctgctagaacagccgggtcctaccaggcttgaaatatggattcgaagatgtctttggtctctttggatttttcactcagagctcattgttagcgcgtgctgt

SEQ ID NO: 675424 - DNA, 1302 bp, Homo sapiens
gctcacaggcagtcgggatgccgaaaggaaagaaggccgaagggagaagaaggtggctccggccccagccatgtcgtgaagaagcaggaggctgacatgaaagtggtgagattccctgtttggagatataggcctaagaatttgtggcttatggacgaggactatctcagaccgcagaacatgaagacctcaccctgctgtgtagaagatggtgcccggctaatatactagagttgctaagacggcctgagtacgtccatcgctcgtgagttaacggctgcgccattgatataggtgctcattccatagccgggaatatacacgcaatgtttatcaatcctctatgggtcctcatgcgtagcacagcaccgaaaaacaatggcataaacgtacaggcttgccgtataaaatggcgtagagtcccacgaccaaaatgtacctatggaacactatggtagaatcaatagaagtcgaagggacgaaatggataggcataagcatgtacctaagtatatgtgtacgcaaaagggtccgggcaagtaaatgcgagaagtgcgtgggcattattgtggcgaacacgtgtgggaacatggttcacggggttcatgtggaaatggaacgtacgcaaacacattgtacactttttcgggtatgcagtggtagggtatgaaaacgaatcgggttctatacgcgactcctttagagatatagcggcaacgtaaaatccataatgtacaagaagggcattccaaagaacgttggggaactgcgggatggcaacttttgacacatccacacggggaaaacgcggatgttaggaaatacaccgctaatatatcggggaatgggacacttggcgtaatcgtaggcgctctcgtatcacacttagtagggcgcagttgggcacagccgccattggggttggatatactgagataaaagaacacatctggcaggggagggcatcaccgccgatgtgaccataggggcgaaggtttatcttcgcaacaccggggatgcaccaccaccggcgtgccaataagtggtaacatgtggaggcagcaacacgacattcggtgtagaggattcgccacccacaggtggccacgaagggaaacccatatggtcaagacccatacaccatttgggtgtcggaccaccgtttgtacacaccgatgtcaacagcggggtttagcaagaagcgattcagaagcgacaacagcaaacctacaaatcaggcggaccggcgcgatgatatgtggaggaccgctcacatcggcgaccattgagggcattggagga

SEQ ID NO: 675425 - DNA, 981 bp, Homo sapiens
  misc_feature (875)..(875): n is a, c, g, or t
gcaagttggtccatgattgataaactatgagcgtgtacgccgtgatgtactgttactactgccttgccgcgcttgctaggtctccgagtctcccgtaattccagccgatgtggtcattcaccttttgtcacccacgatcactcaaggtagtgcgtgagctgcgaactctgtgggttggttaagacttatcgcgtggggacatacattacttggcgaatagccactatgtgagctagatgtcgcactcttcgactctatgctaataactcaatctatctgtctcctcacgatcaatgctactcgtcaagctacctttgattcgacctttctcgcgaatttcgctcttatagcagtggtcgtatcgactcgggagtcgagatactagaacgttggaaaaaaactatagctggaaaccaagacattgcaaactttgcttgttatcgcgcatatctttggaggggaaaggagcaaaaggctccaaattggccatccaaggtgggtccaaatcctacttgtacaggtagattaaactcatgaatcgagatggacgaaatggtcgtggcacataggcgtgatttccaaccaacagttaggtagacacctgtaaaacgacccaattgaccattgccatctacttgtagggcaaaacaaccaacaaaaagaattgccaccaaaagcggccaaagacattcatgcgcgcactcagaattttaggggttgtagaaatctctagaacgcgcctttggtacctaggtgtattgtgtgataccttgtctttaggggcatggaaaggaaactgcaacctgaagatgtctatcctgcacaatcttctcaacgttcatttgtgcatgcctggcccgagaaccccacaattncctcttacttttattactatccccggtactagtgcctctaggcgaggaactcaaaaaggcttagtccagcctgtctgagtgcgactttgttcgccggactgctgag

SEQ ID NO: 675426 - DNA, 141 bp, Homo sapiens
ctcgaccggggattacacatgtttgtttggaacattacatccttggaagccctgaagtgactatcaacattagtcagatattatttattggggatacccaaattaagaatatgaagtcgtgactgaaaatggccttattct

SEQ ID NO: 675427 - DNA, 119 bp, Homo sapiens
tacatgggccatttacttttagtacagtaaaatgtgtatgtgaatttctacagtatgtttgcccaaatgaattatatcttgaatacgcttaacaatatattctggaggcagctttcatt

SEQ ID NO: 675428 - DNA, 1657 bp, Homo sapiens
tgatttcactttccactccataacgctcctcatactaggcctactaaccaacatactaaccatataccaatgatggcgcgatgtaacactgagaacgcacataccaatggccaccacatcaccatcctgtccagagaatagggccttcgactacgggcatacatcgctaattatatatgcctcagaacgtttgttctatcttccgcaggagttgtttgctgacgacctgtttatccaacatgccaggctctagtcgctccgtactccaccactaaacttgatgtgaagggacgacatgcgctcaccctcaaagcaagggacattcaactcacacgtcttacagatccaccgtaagcacattccccagtcccataaaaccacattccgctattaactcgccagtctagagtacgttagtcgacattcatctcttgtagtcctcgatccctagtagaatcgttagatcactagaaaagcaacacactgataaatcctagagcttatcgtgtccaactgcaccatgcactctaattagcacaatttctaactgggagtgcatcgtaatctatcaccccctccgcattactagagccctgcaagatagttgactagtcgctagctcatcgacagtatgcgtacccatctgtctccgatacgaggcccatcttaagcggcctcctaccgaatatcacttcgtgtgagcccctgacacagggacttttcgccaccgagagaacatctcaatcgttccccctcttcattcaggggcctcccaacaccttatagtccctgccaacgtaaatcccgttgcatgttaccactagcccggcccccgaaacgttaaagattcactttctgccaacctttcgttaaccacttcccccaaacatctcattcccaccctcctctcaggggcctatcccagcacacggcaccggatccagccccttagacatataccctgcggggcccatttcacccggcacacaccctgcaatgagctagaacggacccatacatctactccgtcgggcacaatggaatcattccccgaacatcctaattccagactctcgacagcgggcgatccttccaccccacaacacaccacaccggcccaaaacgacaacacgcaacggagcagccagcacccacctcaccacacagaacacttccgcacacacccagacggagcgccacacacacgggtacaaaaccgccgataaccacaaacaagcaccactctgtcgcaacaccacaaagacagcgcacgcacgcccaaacatcaagcgacgcccgcgcaacacccaccaacgagcacaacgaccagctgaggccccgcctagcgtatcaaaaagcggaccgcggcgaccccgacgcgacaccacctggcgcaccacgggcggacacctcgcgcacgagggacccccctcaccaccgcaggcccagcgaccccacaactcacgcccacaccgccccacccagcaccaatcagcccccaccgcgcccaaacacacacaaccacccgacaacacggagacaccaccacccatcaacgccgcaaagcacacccccagccaacacatcaacaatagccacacccacaccagcagcacgcaccagagccacctccgacaccaccccccaccgcagacac

SEQ ID NO: 675429 - DNA, 1156 bp, Homo sapiens
gttttgtgggcccccacgagagagacctttggctactcttagggggtaggctctttttgtctcggtgcgaacttgttttcccggcttgcccgcttgctctccgaaggttgcctgcctgtgtacctatcacgtgggttaaaggctgctgctcgtcggtccgggattgtcgtccagagtcgcaatacgccatagggcgcaaccccgtcatagtcttgcattcctatgccggcgtcgactgtatgctttcggcgatgatcatgtaggcattgcttcccgtgcgatgactcttcttggatactggtacggcgtttgcgattgagttcgtaggtatagcggccagttgatcatgttggaagtcttcctagtaggttaccttaaggcagcctatcgtgtacatgccggcactgcttgcttttgcacatgactcatcatcttagctcgggctatctgaaagcatatgccaaatttcttgccttcaactcgaacgtgagagcctgtctcccgtcacgtctggtcaaatcttaagtccgagtctatagctaggcaagttgaggtggattgaacctcgacttcagtgcttacgcgagatctgtagcattagctctctcaatgtagcgccacattaggatggtatgatgagcagttctaccgtatcaaccctgacgatgaccattcggatattttactagattataggtatccgaaaggagcgtaccacgcattcgctactactcaacttgtcactcctagcacacatcagaccctgcgtactatgctcgcaacttgtaagactaagcgtaacaatgactaagcgaccgcgttagattccagtgccaacacctctcatgctcacactacggaggccctgcccccaagtaaccggcttttagcacaaatgggccattatcgaagattcacaaaaacaatagcctcatcatccccaccatcatagccaccatcaccctcctgaacctgcatacttctacattacgcctaatctactccacctcaatcacactacttcacccatatctaacaacgtaaaaattaaatgacagtttgaacatacaaacccacccaattcctccccacactcatcgccctaccacatacctcctacatatctcctttatataaatcacagacctctttgttc

SEQ ID NO: 675430 - DNA, 965 bp, Homo sapiens
gctctcaagcttggcagtcagtttggtggggttacacgcgggttcaacatgcgtatcgacaaagtgttatctctgtatcggggcccatctactcctggacacggcatgatgttcgtccgccaaccgcatcgcaacggtgtccagcatttcgcccaactctacatgtcatccaaacttcacacaacgaacgcgcaaaccatcgacaaacgacacgcagcgaccaaacgcattcggcgcaacgcacgctgcgtacacccacgctcaccagagggcctaatcaaccaacgaacctcgacaccacgtacgaaaatgaacgcctaaatcaaagtacccccgcgaaccagcccacgcgcacataaccaactaatccgcaaccgcgcacgcaacgcagacgccgacacacacactcacaacacagacacccgcacccacgacacacccacaacaccacgcaacccgcaactccggcaagcgaacacaaaccgaacacgacaccgcacgcacgaaacacgaacacacacagaaaaacacacaaacacacccccacacgccgacaacaacccctacccaccacaaacacgtcacgaaaaacccacgaaccgaacccaacacccccaaaaggcaaacaacaagcacgggaacaacaaagacaacgcccagggactaccaagaacaccatagaagcaaaagtacagcaaaactgattgaagaaaaaagggaacaacgaacatgacacgcactcctactaaacacagccagccaagcgttgcacaaaaccaacactcccagggctccagggtgaacatagtcagaaacaaatacatagcaccccgtctcagacaccctatcacctggtacagcaacgcaaagtccgcccagcatccatacatctactcctagtccccgccacaaagatacaaccagcagaccacccacaacgcacaccttcaatccacacggcatca

SEQ ID NO: 675431 - DNA, 1641 bp, Homo sapiens
  misc_feature (626)..(626): n is a, c, g, or t
  misc_feature (628)..(628): n is a, c, g, or t
  misc_feature (643)..(643): n is a, c, g, or t
gtctggctgaaaggagcgggcgcgccgggaccacccggcgatgctgtcgccgccgccgccgcctctgtagcgagcacccgagcccgccgcggagaaagaaatgaacacacctgtgagtactggatgcctgtgagcttgccattacctgcactgcaaagacacagggcggtggcctctgagaagcagctccttccccttcaccttggccttgcccttcctgctcacggtccaccatggagacgctgtctcaggactctctgctggaatgtcagatctgtttcaattactacagcccccggcgcaggcccaagtggctggactacaagcacacctgctgttcagtgtgcctgcagcagatgaggaccagccagaaggatgtgcggtgcccctggtgccgcggtgtcaccaagctgcctcccggcttctccgtgtcgcagctcccggacgacccggaggtcctggctgtcatcgccattccacacacttccgaacacacccgggtcttcatcaaacttcccagcaaggggtgctacatgctgcccctgcccatctccaaggagcgtgcgctgctgcccggagacatgggctgccgcctgctgcccgggagccagcagaagtccgtcacngnggtgaccatccctgntgaacagcagcctctgcaggggggggctccccaggaggcggtggaggaggagcaggacaggcggggcgtggtgaaaagctccaccgggtcgggggtgtgcactgtcatcttgggggcttgcgtcttggactccctcctcggcatcgtgcttcacaacatgtcttgcatttctaagcgcttcactgtgatatcctgtggctgaagagggctgcagggaagtctcttgtgggtgccaacttaggggttgagcaggttgatgatgagatcccagtgagaagatggggggcaacactgaccatttggtgctgagcgctggcctctgggttgcctcttgattaccccaagacagacacaaagggcagaaggtgcggtctcaacaagataccaggtgaattgttctgagtgttgatggcaacagcttggaagatgattgcatgcatcctcataatcatgtattcaatggactgtaatttatgatttttcaaaatcatgttacaagatagacatattctacttagacgttaaactgtacaagtgcgtacaatgtgaccttctctaaatgcggtagattcaaacaaagatgctctgtagacaagtagaattaaacctgcgaatccgtgtaaaaattcagtgaagacatgcactgctggcttctttattttttttttctttttattgaaacccagtcttcatttagttgctaaggcttttaatacattttgaatggcaccaaaacaaaataagtcaaaatggacagtcattttatttggaggaaatatttgaacaagtgtctccaatgtgttgtgttttgtcatgaaccttcattttcttcacttgtaattagagcttgctacgtgtttatggaactgaaagctcaacaggggagcaataaaccgagaaatcatgagaaatgtctaatcccatgggaaaacctgtatgccgattttcctcaagccatctcacaaaataagaatttcaatgttccaacacccacaccc

SEQ ID NO: 675432 - DNA, 481 bp, Homo sapiens
  misc_feature (88)..(88): n is a, c, g, or t
  misc_feature (101)..(101): n is a, c, g, or t
  misc_feature (182)..(182): n is a, c, g, or t
  misc_feature (186)..(186): n is a, c, g, or t
  misc_feature (196)..(196): n is a, c, g, or t
  misc_feature (198)..(198): n is a, c, g, or t
  misc_feature (218)..(218): n is a, c, g, or t
  misc_feature (225)..(225): n is a, c, g, or t
  misc_feature (476)..(476): n is a, c, g, or t
gtttgttaaaaggggaaccaaaaccaacccccagaccagattccttgaatgcctccccttgccttggccgttggaaggcttgttgaanggggaagatgccntttttgggaagggggccccgtagcctccagggcgtgcacctgtgaggcctggaccctgttaatactgcagtgagccatccntttngctccaggtngnctggtttttgtatatagtgncatagcnttctgctgacattcttagttgtggaaagggggaggggtcagctggcatgagaagtgcttggagttttttctttagttaagtgcagtaggtctaaaactttttaaagaaactgtggaactcatcattgtcagcaaaacaaagaactgcatcaatggaagttcaaaaaccctcggacctaaacacaatttgcaacattctgttgttttttatatgtttagaatgctgaaatgtttttgaagttaaataaacantatta

SEQ ID NO: 675433 - DNA, 457 bp, Homo sapiens
gtctggctgaaaggagcgggcgcgccgggaccacccggcgatgctgtcgccgccgccgccgcctctgtagcgagcacccgagcccgccgcggagaaaggctgaagaaagctcagtctcaattgtgtttcctgcctgtcagcctcttgcctcctaaacgtgtaccatttccacttgatgtcatcacgcagaaggggtgaaagagactcggtgacagatacagtgtggttggcaggtggaccctgctcatcgtagtcactcaaggactcaaactgatggagtcttggtcttgatgtgagcttgcaagatcattgcagcatcgggaaggaaatgctgcagggtcttgctctagcaattatgtgatcctacccagagatcacgtttggctgctaaggcctggactacgttcttcgtggagttgtgagggggctgcttgtgatcgcctaggagtggagagga

SEQ ID NO: 675434 - DNA, 814 bp, Homo sapiens
gctctcgcacggctgtttatccgccgatccggcgtcgcgtatctctgccggtcgcaagtggaagaagagatcgccgcgcgtggtcatagacgatggctccggaatgtgcaaaggctggtttggctggtggacgacgtctccccgaggccgtgtttcccttccagtcggtctggggcgccccagacaccagggcgtcatggtgggcatgggccaggaaggactcgcttacgtgggcgaggaggcgccatgagcaagcgtggcatccttgtactccgtgaaggtaccccattgagcatggacagtcgtcaaccaactgggtactgacatggacgaagatctggaaccacagcttctagcaacgagactgcgcgtaggccccgcgtagggagctagccagtgcttgctgacctgaggacccctctgaaccccaaggtctaacagatcagaagatgactgcaggctctgttcctctcccggcaatgttcctccctgaaggctccagattatgtttgagagcttcaagagcaccgggcatgtacgtggcatccagagcgtgctgtccctctacgcctctgggcgcaccactggcattgtcatggactctggagacggggtcacccacacggtgcccatctacgagggctacgccctcccccaagccatcctgcgtctggaccttggtggcgggaactgaccgatactcatgaagatcctccactgagcgagggtaaagttcacacagggcgaggcggggaaatcgtgcgcgacatcaaggagaagtgtgctacgtcgccctggatttcggggcagggga

SEQ ID NO: 675435 - DNA, 317 bp, Homo sapiens
gacagctggggactggtcaatcccagcagccatacttcaaccaatcatagactgccgagtgttcaaacaaggcaaacgtcaccctgtaaccaattcaggtgtttctgtacctcacttctgatttttttttgaacactttccctttttttggtctataaatttgttctgatcagaaggtacccctagagtctctatgaatttgccgtgattctgggggatgcctgcaccagtcattcactgctcaattaaactcctttaaatttaattcgactacattttaattttaacagttatgattatggccaagcccagctgcg

SEQ ID NO: 675436 - DNA, 611 bp, Homo sapiens
  misc_feature (116)..(116): n is a, c, g, or t
cttgggtcagatgaaaaagataaggatggttccaggacctctttccagacagaaaatgctttgtgaacacatcctttgttcgaagccattgccctgcaggcagcctgctccaattngaggattttggattgtacctgacattttgggacccccgatgatttgcatcaccagtacctatgaatgcctcatatggccgttattaaggacagtccatccagggtctcctcccctgctttgtactcgaaaaaatgttgaagtggcaaagtttcccccccgtgttttgggtgaaaccccagattcctttgaaaagcatattaaaagccttttgcaacgtagggttgccaatccagcatttttgaaagcttttgaaaaggacaaagcccctcctcctgaaaaatgcctaccagcgaaagggcattcagtccctccttaaggaggagggtgaacatataagggaaatggtgaagcaaatcaatgatatccccaatcatgtaaacttttgacccccccaggaggtgactcccccctgaattgaaccccattgaagggttaaacccatattgtaaaacaggtagaattatttaatttataaaaaggggttttgatgccca

SEQ ID NO: 675437 - DNA, 228 bp, Homo sapiens
gctgggcacaaagaccctgtctctaagaaaaaaaaaattttgaataggctgggtgtggctggctcacgcctgtaatcccagcactgtgggaggctgaggtgggagatctcttgagccctggaattcaagaccagtctagtctgggaaacacagcaagacccgccttgctgggcgcggtggctcacgcctgtaatcccagcactttggaaggctgggctgtgccagagg

SEQ ID NO: 675438 - DNA, 990 bp, Homo sapiens
  misc_feature (210)..(210): n is a, c, g, or t
gggtggaacggaggacgtcaccgtccagctgtctctcccctgtccccacatgtcttctaagtctgttggagccggccggcgctcacttgatcttcaggaagctcgtgagcctttggtgtgagccggggtagacggaagggtgggtgcaagagtgaataggcagagtaggtggtacatgcaatctagtccgagagtcgagacttccatggnacggagcaatgatgagcgtgatgggcgagcggcattgccgcgcagcgcagattcttcaagaggaggcccctccatgcttcactcagaacttcatcattccataaaaaggatgatccgacacagttccatgacatgggcagatgggatgcgttctcaggcatacgctgactacatcggattcatccttaccctcaacgaaggtgtgaaggggaagaagctgaccttcgagtacagagtctcctgaggccattgagaacactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagcttcgctgcttcctctgtggtctctgcaagattggggtgctccgggtggattgaccaaaatagctattgtcttcaaggtgttcaactcgggtaccttgaaggttatgcgggaaactccaggaaaagcatccaggatggaggcaggcgggcagccaggagtgtggggtctcgggatagattccaagtttctggccctacatctggggcaggttcgagagtgtatagaccaccaagaactgtagccaaacaccttgtgagtagaaggcgcgaatagaacc

SEQ ID NO: 675439 - DNA, 804 bp, Homo sapiens
aatgttacttataaatattcattatatttccggataataaatgagtataaaaggtgacttacggagtatgttcctctctatcaaattaataatgtgtaaatcatataagcagattgtttgagaaatagttttgttcaagggataagaataaaatatatattttgttcaatggatagaataagacagtatttctagagaaggtaaatatagataagctgtacgacgaaagtaatcgatagctgattagtttagagcattcgattagaaaagttacgttctgaggctttcataaagaaatgatactgtggttattcaatgatacctttgacataccatttattattagtgtcaatgatagtaactttgcaatgtagacctagctagtgttcttgcaaaggacttcatggtcccttagcagaagcacgaggcaataatgatcactgttctgggaaaaactacactaggaaaatgtgagaatctgatgcactaagctatcctagcttagggatatgcactgtctagacattatcagcatgtgtgggtgagatctcacgtgaacatgcagacgtgtgaaatccgtcccaaatcgcattgggtcctagtagagatacaaacttggatttgttcctttcccccaggtaaagtaactctggcattgaatattgtcttgccattaaaaactctatatgtgacacggagcgattcaaaggggtcctaattgacatctcaattttattgtctttgtcttttgtagccagctgtggggatcagagccgttaagtttatgggtctacgaatgggatg

SEQ ID NO: 675440 - DNA, 164 bp, Homo sapiens
cctgtcccatctcttggtgctgaggaggtctcaccaagctttcaatcattgtggaaggcaaagcggggaacaggtgtctcatatatgcagagcaggacgcagagagatagagagtggggggaggtgcatacacttttaaatgaccacatctcaggagaactcac

SEQ ID NO: 675441 - DNA, 316 bp, Homo sapiens
ctctgggatgcaagtgtcgggtgagaggagggaggctgaggaaatgtgggcaatttattgcttttcagaaagcggggagaagagatggtgccagtgacctaagtcacagtttcctcgaaaggtagaaattgctaacaattcaagttgacaactgccaatagcaacccaaccccgtttttctcaccataaatttgaattgttgggttacttttgagaatgttgaaatggagctctcctctcctactgcttggagcagttccaaccctgccctcaaatgtaaagacactttgcaccagaggacactttgcatccagag

SEQ ID NO: 675442 - DNA, 777 bp, Homo sapiens
  misc_feature (281)..(282): n is a, c, g, or t
gcccagttcacagtgctggtgactggacccagacccttggtaatgtgattgtattctgccttgatacagcccacaagggtcattgtgacatatcacagggtgttgcacccaggtggtttgagtctcctcttctgccttggtgctacccacaggtgtttgtgacatattgctgggtctgtgttatgagaatcttttgcttttgccctaaacatataggccattgtaacattgctgagtccaacacccaggtgatgtaacgcttcatcctggacctgtctacnnaggggattgtactgtatgtcttcaccaatcaccctggaaatgtgatttacttttcctgcctgttccctaatcacagggggtattgggacatactattgggtccagcacctagctgatgtgacatttttgtttttttaaggttctgcttaaaaagagattatgacatatgactgtccctaacactaaggtgatgtaacttctttttttttggctctggcttagaaggcattgagacatactgctgggcctagcctaagatgatgggaaggcctctgccctgatcctgactacggggagcattgggacatatttctttacccttacatcttttcttgagaccagctcaggtaatgccctttatactacgtgatgtgacattctcttctggcgggccctgccacagatagagagggactattgctggggcagcaaaaaggatggaatatttggctggtcctgacacaggagtactggatttatgttgggcctccacta

SEQ ID NO: 675443 - DNA, 495 bp, Homo sapiens
tacaacagctccaaatgcagacacgcaggaatgctgactcaccccgtcctcatgctcacctagatcctgtttgggctttgcctttggcttaacctgcagggtatttttcagaaataaggacctaggcattcctgccacttcttatccccacctggctgtggctcaccttgaaccaggaatcagagactggttctctgggccctggggctgggggtgctgcatcccagctttaacatttttattcttcgaccaggcacagtggctcacacctgtaatcccagcactttgggaggccaaggctggtctcgaacccccgacctcaggtgacccgcctgcctcggcctcctaaagtgctgggattataggcgtgggccactgcgcctggctacctcaagttataaacatttcatactaggaaattgtgtgtttccataaaagggtaaagtgaataatgatcatttacttttctacaacaatagtctcccttttagacat

SEQ ID NO: 675444 - DNA, 182 bp, Homo sapiens
tagaggatcccttatcgtgtgcacacccacccgatcaccttgcttactgatggtcagattcaaacagatattgtttcttgcacaaaaatttttgtataaattactttcaggctatatgtagtaaggtggatgtgaacacactgaataatgtaattgagagtcgggtcccgtggatgtatatg

SEQ ID NO: 675445 - DNA, 119 bp, Homo sapiens
gactaataactgccttcttcatagggctgggtgaagcattacatgaccagcgtcattaaggtccttagccctggcacttagtagcacccagtaaccctagctgttattttcactgttcc

SEQ ID NO: 675446 - DNA, 100 bp, Homo sapiens
tactacggatagcccaagaacacgaacgatacacgcgaatgacagcacagagcttgtgtgcgaggatactagggatagcccaagtagaccaagcgatgac

SEQ ID NO: 675447 - DNA, 200 bp, Homo sapiens
caatttttttgaaggggccccttttttggggatttgggggggttggggttaaccagcccttttttgccccccttttttggggtttttaaaaaaaaaagggcctccccccccccccccccccttggggggggggggggggggaaggggggttttccccccataaaatttttcccaaaaaaaggggcggttttggggggcca

SEQ ID NO: 675448 - DNA, 332 bp, Homo sapiens
aggctgaaaggtatgtctcccaggctggagggcagggcacaatcatagttcattgtaacctcaaacttctgggctcgagtgatcctcctgtctcggtctcccaggtagctgagattacatggcccatgtcacggtgcccatctctgcaaaaaatggaaagattggctgggcatggtggtgcatgtctgtagccccagctactcaggaggctgagttgggaagatcacctgagcccagggaggtcgaggctgcggtgggccatgattgtgccactgcactccagagttccagcttgggtgacagggcaagacactgtctcaaaaagaaaaaag

SEQ ID NO: 675449 - DNA, 178 bp, Homo sapiens
gatccgcttggcttattcaggtgggggctcccctgtacccctgcatccctgtggagagctcttcaagctgctgaaggagggccacctgcatggccaagccctgccaactgcacacacgacctgtacatgatcatgcgggagtgctggcatgccgtgccctcccagaggcccaccttca

SEQ ID NO: 675450 - DNA, 224 bp, Homo sapiens
aaaaaaagagtttttcccatgttgcccagactggttttgaactcccaccctcaagcaatcctcctgcctcaccctcccaaagtgttgagattaccaggtgtgaccccccaggctcccccccctaaaattttaaaccctttaaatggcccctggtagggttcctgctaggataaacccttaagcggctgttaaaaaaaataaaagggggccccgtttttgtgcca

SEQ ID NO: 675451 - DNA, 196 bp, Homo sapiens
tccactagtgtaggcatggttttatgcatctgtagtcccagctacttgggaggctgaggcaggagaattgtttgaacccaggaggcagaggttgcagtgagccgagatcgcgccattacactccagcctggtgacagagtgagactccatctcaaaaaaaaaaagtattaattaatcagctgggcacactagtgga

SEQ ID NO: 675452 - DNA, 105 bp, Homo sapiens
aagtcatgctgaattttaacgatctgtttgaatacatctggatccagatttgtctgaaacaacttaggatacaaagatggttcaattcgctttaaatactgatac

SEQ ID NO: 675453 - DNA, 1535 bp, Homo sapiens
tgtggatacaaagtctcgctctgtcccccaggcgggagtgcaggggggcaatctcggctcactggcaaggctcccacctccgggtgttcaacgcagatttctttctggcctccagcctcctctggaggtaatggggagattcacagggctatggcgcgccacctatggcccagttaatatttttttttttttttttttggagagacacaaagaaattcttggcgctgctgctggtctctccccagagggctgggagagtgagcaagaggggtgtgagatctctcgcggctccgctagctggccccagctctccgcgtcttcgcgcgggtgttcccacgcccttattctctcgctgggcctccaaccctcccgcgagagtatagcgcggagagtattatacaagaacaccccgcgcccacacacaccccgtcgggatatatattttgtgtggtgatattttatatatatataaagaacgacgggtgtgtttaacgcgcggtgtgtatagccacgagagtgtgtgtcctctcatatctctccgcgagagacatctggcgaggggatctctatctctctccacgcgcgcggcctctctcacacagagagtcgcgcgggaatatatagcagcgggcaacaaatgtgtttatataaataaaaaagagagagggggtgtacacccacatcgagtggttgggggccccgaggggcgggtggtctctctaacatatctgctctcgagagcactctcggagagggtgtgtatccccacgcccgcgctcactaaaaagtctctcccccacagaggaggggggcgggggggataattaacccgagggtgttttattagaagaccccaacgcgcggggcgcgcgggagaggagttgaaaaaatctctccccaagaggttctaaaaaaaagcacgggagagggagactactccacgacagcagaagatgctgggggggccatcatatacaaagaaaaaccactccctctacgcagaggagaagcggcgtgttcgaccaaagaggcaccccaacaacaactttttttttacaaaaaaacaggctggggaggggagacacacccccccccgggagaggggggcgtgccaccaccaagggggggggggcccccccccacgagggaatcaaaaaccaagagaacacgctgtatctacgctagagagaaacaccacggagaccactacatatcgatcttgtaggtgctccccagcagacgtggtgtgctctcccccggagtagttgtcgtcgcacaaaagtagttcgttctgctgtgtaggtaacaaacccgacgggaccacctatgagtgtcgttagtgagaacaaccactcactacgaagggagcgagcccgccaagcgagcgagagtaaaacaccgacagcgcaagaaaaaacgcggcggcttctagtgttgggcggctgtgtgtaataacccctccccttgtgtggtagaacaagccgctgctgtctttttaataaaaacaccaccaacatgcggtcccgtttcgtggt

SEQ ID NO: 675454 - DNA, 436 bp, Homo sapiens
  misc_feature (335)..(335): n is a, c, g, or t
  misc_feature (343)..(343): n is a, c, g, or t
aaggaattttactaagtaaattttgtttaaaaaatccccgtgaattaaaggaaaggaaatgaaaaaaaagattgtatcaatacgatgatttaaatcagtgttttgcaacttttttacccagtcatcagtgggagtgaatcagtaggaatgtggggaagggagtgaggggagaccccctttttgactcaacagtggtgacggtcggtgggtcctgcaaaccttaaaccaaaataaagggggggttgagccccaggagcccccccagttcttgaatgaccagcggagggcaggggccagcctgtggcaaaataggaaaaaaaaggacaggatggggncttccccntttttttcagccttaaattgttccttaaaccttcatgtccttttttttaatgtatgtttttgtttggtaaaataaaaaagtttgtaaccctga

SEQ ID NO: 675455 - DNA, 506 bp, Homo sapiens
  misc_feature (260)..(260): n is a, c, g, or t
  misc_feature (493)..(493): n is a, c, g, or t
ccagctatcaggaggcttaggcgggaggatgtcttgagcccaggaatttggaggctgcatggagctatgatggtgctactggcacttcagccgggaaatagagcaagacttggtctcttaaaacaaaaaaaaaggccccattttctgccttcggtgatttagcttcatcctgaatgggcgtctctgatgtggataaaattctacagcaattctagacttcatatccaccacacacggtccagaaggagagagagaacggncttctggtagtggtgtcagagaagcaagtgactttttccagaagcccccaacacatttctgatgcctcagtgaccagcttatgggctagggcatcggtggtgatgatgggcttaggctggggttgcctaaactcgtcactcgggggcaagggggtaggggatttcggtgatttatttaaaaggatcaggattgctacccagggagagagaaatggacatgctgttgggtcagncacgatgtctact

SEQ ID NO: 675456 - DNA, 103 bp, Homo sapiens
gctggtagaggatcccgcagaggctcaggatcacatcctcaatcaaggtagagaagaggcccaggaggtgttagccatgcctgtgtcttttatgggaaaagct

SEQ ID NO: 675457 - DNA, 1006 bp, Homo sapiens
tcttttttatttgttaatctagctcataatctattaatctagttttttctttcaaacaacccatttttaatttcattgatcttttgtatgcatttttgcatctcagtattgttcaattcttctctgatggttttttcttctagtagttttaggggttggtttgtacttgtatttctcatttctctaggtatgatgttagatcattaatttgagatctttctaacttttttaggtagatgtttagggctataaactttcctcttaacactgctttagtagcatcccagatatcttggtatgttagtgtctctgttttcatttatttcaaagaatattttgatttctgtcttggtttgttgtttactcaaaagtaattcaggaacaagttgtttaattatctatgtaattgtgtggtataggggagatcttcttggtattgatttctgtattatatccactggtgctctgaagagtgatggtaaggtatgatttacaatttaaattactttaaatttgagaatttccttatggacaaaatgtgatcaactcttgagagtatgtaccttgtataaatgagaagaaatgtaatataccaatggattgattgaggtgaagtgatcctggaagaatagtatgaaagggtccaatattggtacacatagatgacttaaaggtccagcactgtcagctacaagaacatggcctctatggatccagatatgtcacacagtagaggaacatagaattccttaacaatatagaggagagaaggaaagaaaaggccatactatatcagaaagggtacaaaacagaaagctaggtttatagtgaaaatctgagtattaataccaaatgtataggaatagattaaaatcattaacgcgagatagtacaactgtgattggatcaaagttatatcttttacgaaaagtagataactagcacatcaatactaccattgataaaaaggtgctaactagaagttgttttaacagaataataaaag

SEQ ID NO: 675458 - DNA, 161 bp, Homo sapiens
  misc_feature (7)..(7): n is a, c, g, or t
  misc_feature (70)..(70): n is a, c, g, or t
  misc_feature (104)..(104): n is a, c, g, or t
  misc_feature (134)..(134): n is a, c, g, or t
  misc_feature (137)..(137): n is a, c, g, or t
ggtgagncgacctgcggggttggtgaggttcttccatgcgacggcgtgttcgatcagtgtacgttcttcnaggggggggcgttgggcttgtgggtgaggtgggncgatgtgcgtcacagggcgggggaccgggnggntgcgggtaggggtggtgtcgcatt

SEQ ID NO: 675459 - DNA, 1025 bp, Homo sapiens
gaagaactaatgttagtataagtaacatgaaaacattctttcctccgcagtaagccatgctgtcactattaaacacactgaactgacaattacacgagcccaagtatctacaatcgaatcaagccaagatcattattaccctcgactggtcaacccaacacaggcatgctcataaggaagaggttaaaaaaagctaaaaggaactcggcaaacatcttaccccgccgtgttttaccaataaacatcacctctaacatcaaccaggtctttagaaggccccggctgaaccagtgacagcatgtacaacgggccgcggtaccctaaccgtgcgaaaggtagcataatcaagttgtgtccttaattagggacctgtgatgaatggctccacgagggttcagctgtctcttacttttaaccagtgaaattgacctgcccgtgaaagaggcgggcatgacacagcaagacgagaagacctatggagctttaattgtattatgcaaacagtacctaacgaaatccacaggtcctaaataccaaacctgcattaaaagattcgggttgggggcgactcggagcagatgccaactccgaaacagtaatatgctaagaacttcaccagtcaaagcgaactactatactccattgatccaataacttgaccaacggcacagttacctatggatacaagcgccatcctatctaaagttcatattcaacaataggttacgaccccatgtggatcaggacatcccaatggtgcagccgttttaaggtcgtaggtcacgattaggtcacgtgatcgcttaaccgaatatcaagaggtcataaatagtaaatctcctgacatagcacacaatagcttacaacgcctcccgaataatatcagtggatatacccccaccaaagttaaacaaaataaccaacaaagggcacaaatcacgagaaaacaacataacacaatacacataagcgcaaaggacatataacatatcaaacacataaaacaatacatataaccactactc

SEQ ID NO: 675460 - DNA, 511 bp, Homo sapiens
  misc_feature (340)..(340): n is a, c, g, or t
  misc_feature (501)..(501): n is a, c, g, or t
gtcttacaaaagtctagagaactttcagccaaaataccatcacatattgtcccttcccagttcccttcttctatgagaacactcactaaacacatgctgcactttctcactgtatattccatgtctcttcatgattctgtccacattgtgcattttttaaaaattttctgtaatgcactctgaaatatttatgaactctcaccatggccatgtctaatctgatgagttcatttttgagtttttaatttaaaatactatgtttttatacaaactacttttcaaatttgctacatcaattttttagtctcctaaaaatatattcattttttttaaaattttntgaaagcaaatgtactttataatctaacagtgatatttctactaatggaacctttgtggatctgtttgtactctttttctgctttcctttcaaatggtggaatatcatttccttgtgtacttaggatgcctttgaatggacaaatatttaattttttctcnggaaaaatta

SEQ ID NO: 675461 - DNA, 905 bp, Homo sapiens
ggccccactggctgctctgaaaccatctttgcattgttcctcatccgcctccttgctcgccgcagccgcctccgccgcgcgcttcctccggccggccgcggaactcggggcaggcttaatcggccagaaggtcccttgaaactctcgcattcctatttaaattccccttgcaatcgggattcaccggggagttgcccaaaccattgtcaggagggcagccctgtagacacccagcttcgggaaattacgcacagccaatgggacttttacacggcgccgacaccaccgggacctgtttgtggcacccgacgcgcacggacccacgtggaacggacgaccgcccctggaataaaccgggggacgttggtcactctgacgggacaactggggggaaacacagtgagctggtttgcacccactctaggaacggggtaacgaaccgagaggaaaacacgaagggggaacacgacaccgtggcttgggaggcaaaggcaacacacaccgtacaccgagatccgcgaccgcgacaccgcacaccgggtagacaactgggcttagaccgagacacaaacgcgaacatcggcacaatttggaccgcaactggcaggggcaaaacacccgctgtgagacgttccacagcgcatacaacggggggcgcacaaaagggccgggggcgcacaactgcactgtgagaacccgcggcaactgcgcatatcgcgacacggggccaatacgacacgcgaacaatgtcgtccacgagaaatacacccccacagagcgaggcacaacggacagaagaaaaaacagcaaacccccgagaacaagcgaaacggtgagacatgtgagcacttgacacgacaccgccggcgcccagaacaaacaaccacagcggccacacaacgcgg

SEQ ID NO: 675462 - DNA, 781 bp, Homo sapiens
gctgtgagtggtcagttatattagaggatctcgatgctaacaatcgcaacaggcaaactttgtgctcgctgttacccaaaaaatcaagatcacataatacagatgctgccctgctcccctgcatcagttatcctgcattcgccctggatgatgaagttctttttagccctacactcgataaagtggttagaaaattaaaaggaaaatatggatttaaacgtttcttgagagacgggtatagaacatcattggaagatcccaacagatgctactacaagccagctgaaattaagctatttagatggcattgaaatgtgaatttcccatatttttactttatatgaagacggatggaatttttagaggcaatcctatgcaagtccaggaatatcaagatcttttgactccagtacttcatcataccccaaaaggatatcctgttgaaccaaagtactattatgtgccagatgactttgtaaaaatgaaaaaaataaccctgggaaataaaaactaattactaaaaaactggggccgggatggaaaactggttcctttggggacaagaattatatatcaacacagaacatgctggatggtgaacttatgagcgcaaaaaatatttgacccctgtacaaagctaatggcccactcaaggatctacgaaaacaggagcgagaagtgttcccaatcaaggaaacatacgtgggattaaaaaaggtttactatcctatccacgtccctcagttgcaaggaaaaaatacattagaggacacacctaaga

SEQ ID NO: 675463 - DNA, 544 bp, Homo sapiens
  misc_feature (538)..(538): n is a, c, g, or t
cacgagctcggagattccattgataaggattataacttttaaaagcaacccgtcattacactgtcgtatgggaaacaggcgcaggtcgcactttgggggaaggaggtgctgccccattcagcacctatttaagacagaaaataagcagatgcatgagtgggagtccctctacaatgtgaccagagcagggagcacttcaccaagagcttctatgtatttcagagtaaacgcactcattggtataaaaaaaagagcccttctgtcagctaggcccctgaatgaatgacagacactcctgataatattttctagaaagcgtggcttctctccagcagctccaggccatcacttattcctcattttgacaaagtagcatccaacttcaggcacgaccgtatatataactccacatgcagctgagccatcataaacacgccaagtataaaggcatgtcaaaaagacattttacttccccaaagcatgggcccaagaagccattattataatagagtatgaatttctgctgcaggttattagnctatat

SEQ ID NO: 675464 - DNA, 244 bp, Homo sapiens
gtctgatcgctgagaccttcgtgctatggttcctgtccatcaccggcgccaccagctgcttcgtgggtctggcagttggtaggagggttcctctagtgcttctctgtaggccttttggtgtgggcttgtctctgttctactaacgtctgtgcatggggttaccctgttgaaaacaatgtggcttgataccttgacctggtggctgtgcaggagtgaaaggggcaggcccagagaagctgtggcg

SEQ ID NO: 675465 - DNA, 301 bp, Homo sapiens
agacgacacacatgcccacaagaacatcactaaaagctcaagcatcaggtggtggcaaccattgtggaaagaaaccctatgtccacaatctgggcaatgttaacaagttttcccacttagaactcatcaaccatccctagtacaaataacattacatcatcttactgaccactactagatttactgaatctatacctgggtatagctgttaccctatcatacaactcacagctacaaaaacgtatgaagttttaacaatacagccgagatgctagcttctcacctgtgaatatagttcaca

SEQ ID NO: 675466 - DNA, 298 bp, Homo sapiens
ggtgaaacaaactcatctgtgctgtagctagccgcgggacctttagccatgaactttgtgattttgtcttggagagcactgctggagagactcctgttgttgctatcagaactgctaaaggagagacgtttgtcatgcaggaggagttctcgcgtgatgggaaggctctaccgaggatcctgcagtattactatgatggcaatctgaagagacacctgatgtctgaacctatccgagacagcaatgatgttcctgtgaagattgagaaagcagagaattttgatgcaatagtgaataa

SEQ ID NO: 675467 - DNA, 765 bp, Homo sapiens
  misc_feature (432)..(432): n is a, c, g, or t
  misc_feature (754)..(754): n is a, c, g, or t
gcgctagcttttaagaacgtgtggggctgaccgaacgtagtctgcgacactaatacacactgtttattacaaacttcactctctcgaataagctgtaacaaaggagcgcacgcgtgcctcgactgaccagcctctgccagaagacagtttaccagccagggcctcattataaacctaagggcgctgaatgaccgggaaaggtaaatgcacgacaattgagctgcgtctgactgtgccactacctacaacaagcgcattaacatcagcttccacaggatcccttggcatgctaaacgtataaaagaatgggttcgtctggctaggcgcacctatcatgcgccaaggaaacacactatcattcgttcaaagcactttgaagcctgctgtattgacctaacaggacacactctacgacttaaacatggatgctgntccaaccattaattgcgttctggtacccatattaaaggctcatgaaacttcaacccacaggaacctgtttgcacgaaaaaaaacacagtgtactcccagatggaccatccaaatttaaaaataaacatttacgagcccggaggtggctacctgaaaccccgtttggcttttggatttctatggggggcaaaatgaagggtctttaaaccggaaaaagattagccagcccaggaagaaaaatggaaactttccttcaaatgaacccctgcctctccaaatggcacaaaccaacggcctgttactaagggttgtcttggaaatntaagacctgaa

SEQ ID NO: 675468 - DNA, 181 bp, Homo sapiens
taaattcgcggccgcgtcgacccagcgtacggcggccagtgttgacctggagaaattgcccagcgatgtcgaggccactcaatccgtgacgcaattgaccctcaccgaaggggccattggctaccgatccctggaagtgatttccggccagaaggccatggcgattcttcgtcgacgcggc

SEQ ID NO: 675469 - DNA, 705 bp, Homo sapiens
tcctcctagaagcagagaagccccagacagaatagctgcctcttcccttagtagtcactgcccatgcctcataccttccctcccccgaccctgtatttcctagttgggctggctgaaagcctaagtttcctgatctgggcctgaggtaaggcagtctgatgccaggtctgtggtggtggggatgtgtgttttatagttacagatgacatgtatgcagaacagacggaaaatccagagaatccattgagatgtcccatcaagctctatgatttctacctcttcaaatggtgaggctttattgtgacttgctgtccatgtgtgcgcatgtgtgtgtatgcgtgtgcatgctcacttgtgtgatcacttatcataggggagaggcattctctagtcccaaaccaagtaaaaacacttccagaaagctaaatttagaagcagccttgctctggctttccaaaggtgtgtcgatgtgcctagcacctgatagaaccacggggtcccgggtcccctacagtccacctttcatgacacacgggtatgaaggtaccagagaatcctaccttccatcacatattcgagcattggccctgctttcctgaccttgacccttttgtcacttgccatcattaatctaggtgagactcctcttcagcttttctccctttggcccctccaatgggttctcattacatagtattctttatg

SEQ ID NO: 675470 - DNA, 347 bp, Homo sapiens
aaaagttcaaattgttcaccttggtgtgaggccttttacaacctggctcagatctgcctttttagtctcagattgcagcgtcttatggaaatgttatctccatttttgaaccagttaacctaccaaaacaaaagaaaaatttggtcagtaatttatgatttcttcttttaggaattgaaatgttttaagtattgaaagagtgtaaaatcagagtgatcattgagtaaatcggtattacttatatactgtaattgaacctacatgttaaattccattttgatgttaaaaatatatttaaatttttcattggaatagaactaaaataaattgtgccaatgaattgttaa

SEQ ID NO: 675471 - DNA, 801 bp, Homo sapiens
atcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataacttttttaaggggatttctcttcttaagacacgcaaaaactatctgaagatttccagttggtcaaaaagtaatgattcctggactacactggtgtagctaatgtctttctagaacccagcgagttaccttaaagctgaattcatatttagctaacttcggggtcaatacgggatagcatgaattctgcatttgagaaactgacatagcgtgtcataacaatgaaactttctttctaaagaaagatactcacatgagttctgtgaagaatagtcataactagattaagatcggggtaaagtttaatagttcgaagtgcctgttggggataatgataggtaattcagatgaatccaggggacacacaaagttatcctgcagatatgtcgagggcccatctctcccccaaaaccccagagagctaacggggtaacagggtttactccagaaagttcccaattccatggtcctggcgttaccatgtcgcaaactaccttggcattgctcctttgaagtgccatttcgttatagtcctatccttcaggtaccatgttacc

SEQ ID NO: 675472 - DNA, 162 bp, Homo sapiens
ctggtgctggcaggaaaatgacgtggcgatctgggatacgcgtgacgcagcactacgccaacgcggattatctgccgcagcggcgcatatgcaccgcgcgacattctgggggataggcctttttacaaggcctgaggcttaggcttcgaacgcctgcgttaa

SEQ ID NO: 675473 - DNA, 328 bp, Homo sapiens
tatttccacagggtatgaaataagagtcgactgggcagtgaaggcatagctgatggccctgattttaacacatgtgacgttagtgagaatgcttttattgaaatcaatgacgtttaagctgagacctgaaaatcaaatagcatttagccaagcaccgtagggaagagaggatgggaacgaaacatttcagaagaaatagaatgtgaaaaggcaggatcttgtaacctttaaaaaacttttttataaagacctatgagatataaatactatatttttcattttagaaattgggggaaccaaagctctatattaagtgatttgtctaaga

SEQ ID NO: 675474 - DNA, 402 bp, Homo sapiens
  misc_feature (19)..(19): n is a, c, g, or t
  misc_feature (25)..(25): n is a, c, g, or t
  misc_feature (32)..(32): n is a, c, g, or t
  misc_feature (41)..(41): n is a, c, g, or t
  misc_feature (74)..(74): n is a, c, g, or t
  misc_feature (165)..(165): n is a, c, g, or t
  misc_feature (222)..(222): n is a, c, g, or t
  misc_feature (224)..(224): n is a, c, g, or t
  misc_feature (249)..(249): n is a, c, g, or t
  misc_feature (299)..(299): n is a, c, g, or t
  misc_feature (380)..(380): n is a, c, g, or t
gtaaagtgtccacattttncaaggnctagtantacataatnaggaccaggaaaaaaggttttacttacctaagnaaaacactatctatgttgacagttaagtcccaaaggcattcatggtgtatggatgaaagaattaaataatgcctgtgtctttggagaacancggaaagggtagtcaagggtgtgactgaaggctgagaaatttgggaatgctgggggngngaaaaatagaagagcactcaaagtnagtctgttcctacattcacattgtcttggagagacaggtttgcatagttntttacagaggcaggctctgagaggggtgagcctgggttttcagtcttagttctcttgatctttggaaagtcacttaacctnccaactagtctcctcatgtata

SEQ ID NO: 675475 - DNA, 273 bp, Homo sapiens
agcgaagttactaactggttcaaaaacgattatgtgcatgatgggcagtattgttgcagttcaatcaccagtattgcttccaccagatttgtggtctatatatgtgtgcatatggaatagatttccacagacccacaacacggaagcatggcacagaagatgggaaaaaatggggatactcatgtagttgtatactaaaccatagaagacttttgaaagagcagtgtcaaatggaaataaatgtgacaaattctccaggcagccatttcgtaa

SEQ ID NO: 675476 - DNA, 982 bp, Homo sapiens
gcgtggatgggcgtcgtgggcgcccgaaccctcgttgtgctactctcgggggtctttggcctgaccctgagctgggctgggtctcccactccagtgaggtatatctagacttccgtgtcccggtccggccgctgtgagtcccgcttcatcgccgtgggctacgtggacgacacgcaattcgtgcgggtcgacagtgacgcccgctacgcggcaaagagactggagccctgggtgcgccgtgggatagaagtcacgcgagtggtgccaggagtaattagtgtgaaccgtaaacaacaccgtgaaatgtagaatggccacgagtcaacaagaacgtgttcctgatctggcatccatgtaggcaaactctgcagtcggcttatcgtatctgactcaagaagactgagtgccagtgttctcaacacccactccagaattagttgtacttggccttgcgactatgcgggtgtctgggactggtgccgctctccttccgaggtgttactctggcaggaggagcccttactggacgtgctacacgtgattgacattcagcgcctgacttcgacgtggaaccttgcgctctttgtgactccgcaggagggatcacttggacgatctacaggaccccagctcattggcacatttttggtgactgcaggactgaggtcggtggaatctatgggggtggaggccttatctgggagggtcaggtgcgtggtgttgttcccctgtattgcctggacaaccgggaccggaaggactgtgcagcgctaggacggcccccaaggtatgcatgtgatcgtcacgcgtgctctctggaccatgaagtcaccctggggtgcttgggccatgagcttctacctgcggagattaccttgaccttggcgcgggtgtggaggacctgaccacgacacggggttctctgggaacatgcttcgggattaacctcctaatggatggggagtatcgttgtccagtgggt

SEQ ID NO: 675477 - DNA, 123 bp, Homo sapiens
aggcgctcagaggataccggacgtatcgggggtggtcgtcctcttagaccgagcgcgcagcttcgggagggacgcacatggagcgggagggaggaaggggacacccgcctagccagccaccac

SEQ ID NO: 675478 - DNA, 596 bp, Homo sapiens
  misc_feature (16)..(16): n is a, c, g, or t
  misc_feature (92)..(92): n is a, c, g, or t
  misc_feature (150)..(150): n is a, c, g, or t
  misc_feature (196)..(197): n is a, c, g, or t
  misc_feature (201)..(201): n is a, c, g, or t
  misc_feature (210)..(210): n is a, c, g, or t
  misc_feature (216)..(216): n is a, c, g, or t
  misc_feature (233)..(233): n is a, c, g, or t
  misc_feature (253)..(253): n is a, c, g, or t
  misc_feature (264)..(264): n is a, c, g, or t
  misc_feature (318)..(318): n is a, c, g, or t
  misc_feature (322)..(322): n is a, c, g, or t
  misc_feature (337)..(337): n is a, c, g, or t
  misc_feature (341)..(341): n is a, c, g, or t
  misc_feature (346)..(346): n is a, c, g, or t
  misc_feature (356)..(356): n is a, c, g, or t
  misc_feature (365)..(365): n is a, c, g, or t
  misc_feature (371)..(371): n is a, c, g, or t
  misc_feature (380)..(380): n is a, c, g, or t
  misc_feature (382)..(382): n is a, c, g, or t
  misc_feature (386)..(386): n is a, c, g, or t
  misc_feature (415)..(415): n is a, c, g, or t
  misc_feature (427)..(427): n is a, c, g, or t
  misc_feature (431)..(431): n is a, c, g, or t
  misc_feature (449)..(449): n is a, c, g, or t
  misc_feature (469)..(469): n is a, c, g, or t
  misc_feature (529)..(530): n is a, c, g, or t
  misc_feature (562)..(562): n is a, c, g, or t
aaaaaaaaaaaaaaanaagatgcaggagaaaagcctcaccaaccagcttcacgggggcaggcatctctgtccatcccatgcctttgggtcanagggggcagcaagaccaagaagaccacagccaggccctgggttcagcttcagagccancacccgctgcctcccccaacccccaatctcctgaaggaggagaatnnctanggacaaganccaganccctttccttcagcctntgcttcaccaagggggcctngactgcgcccnaactcctcctggcctgcccctcaggggtcccaggtcctcacctctgctcttcangcangaaaagggcaggganagangaatngaggaggganagggaggcngggacncagagaaanangagnggggaaagaagagacattaggagagaggncccttcacacanaganagaggccgagaaaataanggagaaggggggggctgaantgagacataagaaggaaagtgaaatttgggggaaaaggaattggaaaggaataggaaggnnttgggaagttcagacaagggaggcgcaggtgnaggaggacgatgggagggaaggaggagaggaaaa

SEQ ID NO: 675479 - DNA, 191 bp, Homo sapiens
tgaagatcctcggtgtcgccatgggccgccgcccgacccgttgttaccggtattgtaagagcaagccgtacccaaagtctcgcttctgccgaggtgtccatatgccaagattcgcatttttgacctcgggcggaaaaaggcaaaagttggaataagtttccgctttgtggcacatggtgtcagatgaatat

SEQ ID NO: 675480 - DNA, 348 bp, Homo sapiens
ccgagcggaacatgcagggaaagaaaaagaagacagaaagacagagagacagaaagaaagaaagaaagaaagaaagaaagaaagaaagagcaagctgcagacttaaatgtccctgtcggacagctttgaggagagtgggggttctcccagcatgcagtttaagatctgagaacagacagactgcctcctcaagtgggtccctgactgccaggtagcctaactgggaggcacctcccagtaggggcagactgacaccccatatggccaggtgcccctctgagacgaagcttccagaggaagaaccaggcagcaatatttgctgtgctgcaatatttgcttgttccgctg

SEQ ID NO: 675481 - DNA, 260 bp, Homo sapiens
agaaaaattagggcagggttaaaaaagatgaatttttctggtcaagttcataaaaatgaaaaatcaagaatgttgggtgggttttataaaaggctttaatttctttccttgaaaactttcataattttaaggatttcagggcaaagcagccttttttatgttggccactttttttattgtgaattaaaaatatatcccactcttattttgcaacttatttatgaaaatcgaacttcaataaaaatattcattattgggca

SEQ ID NO: 675482 - DNA, 174 bp, Homo sapiens
gtcttaaagaacctaataagctgggaccagtaaaatccacaggaattcactcttgccttgaagaacttttgaacactgtttaaccataaaaaaataataaaccaacggggctggaacctagtttctgaacccaattttaacagtcatatttggtgtctcctcagttacattggg

SEQ ID NO: 675483 - DNA, 467 bp, Homo sapiens
ttttttcttttcggaaatcttaacccctaagaaactaaggacggtgtttgggggggccttgggaatttttagcccccaaaaatattttgttccccaaaatttctgtaaacccggttaaacccgggtttaaagtccccgtttcttgcttggggcacttgggcccccaatgggtttaaattgccaaattgctaaggagctgaacccttgcccgggtttttacccccgggttactaaaaaaaaaatgaatgcccccaaaagggggttggggggggggtccccccaaaaacccaaaatgttagggggtttaaatttaggggtgttaaaaatgtcctccccagccaagccccggggcggttggcctttgaaccctttttggcccacccacccttggaaaattttttcctgattaaaaatcccccggggaaatttggaaaaaagggggaaataaattttttataaaagggtta

SEQ ID NO: 675484 - DNA, 117 bp, Homo sapiens
gtactctgaggatcccgaatctcgacagttgtgcactgcacagtacttattattaacaaaaataaaaataaatctattctgaagcaatttattccatatgcacaacttgtcgagatt

SEQ ID NO: 675485 - DNA, 123 bp, Homo sapiens
gtccggaggatcccagtggaagatgtgctacgcacaggatctagaagaatatgtcaaactataaacggcttgtgattgtgaatgacttggttcttggctggtgtttttcaatttcgctataat

SEQ ID NO: 675486 - DNA, 108 bp, Homo sapiens
tattgtaatgatatgtggtgttgtcctttattgataaggttcattacattaattaactttctatatgtgcagataacatgatattgtatgtagataataacaatgtat

SEQ ID NO: 675487 - DNA, 378 bp, Homo sapiens
tacgttgtagatgcctactgtaatatggtgtcatgattgccatgtatcactggagggatgaaggttcacctagcgtttcatacaagctgatcacagcaacaggatgcccagagcaacaaggaggctcttgcttgcatattgaaaatgaaggcgcctcttgtctcagttgtgaaataagcaaaggttatccacagagacgcggtctcatttttacttttacaaaggtgactatgctgaatctttttacgaaaagttcccctttcttctttgttacgccgtcaattttttttttagttgaagactttttaaaactttcccttcctgaacatttcaccatgagcccagactgccagggaactttggcaaagaggagagcag

SEQ ID NO: 675488 - DNA, 304 bp, Homo sapiens
gcacagctgcttaacttatcttggtcggtctgtcggcaactttgggaacaggaggaggatgtggtcagatcagtacttgctgagctaagtgaagcatgtcgtcatttctttttaatttgtctggctcacttctagtccctaactaaatgctcactcaagagttttagcttgaatgtcaaatgtcagaacattacttgggtgatgtgctctccatttctaggataagaagaaagagaagacatgaagtgaccactccagcctttcccaagttagacttcctctccttccaccccgtcgggtggcg

SEQ ID NO: 675489 - DNA, 374 bp, Homo sapiens
atgagatggaccatgcggtacgctgacggaccgggagcctgagcgctccacatcagatattaagggctctgaatcctatatctgtatatctctggagcagctgaggcttacacgagtgtgactgatgacagggattaccgctcattggacctcagcaagtgtgatccagattacctatagggacattgtgccaagatgaaccatggagtaactggcgatcaatacccgtgctaagtattacttacaggactccatgggcatgcctgccggaatcagatgggttcatccgattgctacattgtttggtgccacgcacattgggatatatccatgcatgtgggaatcttggaactgggtgttgagcctcttactgt

SEQ ID NO: 675490 - DNA, 271 bp, Homo sapiens
atctagaggacccccctcggggaccttattaaacattagttatatacatatgtgtattatatggtgtgtgtgtctcatattggggttacagctatactcagcaaatactaacaaaactgaagtagacacaaagagagcaatacaaattatagtaggatatctcaatcctaccactaaacagaagataaaaaacaagacgagaatattagctaagagaccccagaaatacaccaaggccgtcataaaaaccattcttttaaatcacggatcc

SEQ ID NO: 675491 - DNA, 442 bp, Homo sapiens
cttaaaatcaattatttacatggctggaaattaacatacttacttgatgtaggtgagagcgatcacaagtagtagggatgaaatttatagtaaatcatcctatggctggagacagtaatgaagagccccatccggttgatctgctgaccggaaggggactggttcattcagccttcagggacatgcacatcataagggaggccaagcaaaaatcaaagcaaacaatagctcacttgttgggcaaaaatatccatcgaattacacagacaggaataatgaccagtggagtcacctgctcaagggggacctttttaaaatgtgacagtcatctatgaatactgaaatgtgagggtcaaggggtccatcatcaacacacatcccaagggaaactcattagcacttccgggggggatgcaacaaacaaacaaaacaagggggcccc

SEQ ID NO: 675492 - DNA, 1520 bp, Homo sapiens
ggctcatgtcgcgacttgccaccgttactaccaggactacaccgtttagccagaaccattgacccaaataaagtataggcgctagactatttgcaagctgtgggcaatgagatataggtgagccgcaagggcaaagatgagagaacttatacaccgaaggcagtacctataggccgggacgtaagcccctagtacctatctgcatagagtggaattcaactgtagacaatcaactgtaagcgaaggcagagcccaccaggtggaagcacccgcacgcacagacgctagaccgagctaacctgaagcaaccagctcaagaagagcacgacccggtactcattgtcagctaagaatgagtccgggcacagcatgtgtgcatccagcgtatagaaagcgccagcacgaaaacgcgtccacgctgaaagcccatggggctagcctggtagcctcgggtcggtgcccccacacggatccaggaaatctttgacaagtgtaccaagactgttgaagatttagccgccgacaaagcaaacccacttcctggaaattgccccactttggtcaaatatttctaatactgagtgtgaagtgccgccataagcgagtgggaaacgaaggtgcgtactcggaggaccactaaatcggaaatataacaggctttcggtaacgtaggaaggaagttgagaacaaatatggttggaaagggacgccccactaagcttacggcgcccgtcaacagaatggcataggacgcacacccacaggtggacatcgcaacagaaggccgttctacaacagccttcgagaccatcccaccatcattaacacgtgacacaggcacagattccccgaaggagcggataattcaggaccttggaaaccttcctcttacaacgaaccgcaaaagtctgagaacgccaaatgcctaacttcaacaccctttacttacgaacacaaaacctgcaacttgcgtgaagcttatacaggtcagacccaatggaacaaagactggttctatccgtcccggaggatcaaagccctgggcggatcaggaatctatataccaccaatcgtgggaacgtcggggcacgactttgaagcacgccgcgccaattcattcgtaaccggagttcacagaatcacaacaaaaaggggcgacttaatttaaacgcactccaagatgtacaacaccccgatagcacagtgatctgcaccataagcgacagcggcttcccacccacacgtcaaaccgggaacgttcggccaaatcttacagccagcaggtctccccaaaaaaaataaccgcatcaagaatcaccacgcatagtagaaggaccggccgtggcaacagaacagcgggaacagggcgccagaaacccaaaacgggcggaaggggacaccacccggggcagtcaaacagagcccggcaaaaagggctcacaacgagcagcggccacccctaccaccagacaacagcggccgcaaagaggcactacaccagacaacccgacgaagcaaag

SEQ ID NO: 675493 - DNA, 541 bp, Homo sapiens
  misc_feature (1)..(1): n is a, c, g, or t
  misc_feature (4)..(5): n is a, c, g, or t
  misc_feature (14)..(14): n is a, c, g, or t
  misc_feature (17)..(17): n is a, c, g, or t
  misc_feature (32)..(32): n is a, c, g, or t
  misc_feature (40)..(40): n is a, c, g, or t
  misc_feature (42)..(42): n is a, c, g, or t
  misc_feature (47)..(47): n is a, c, g, or t
  misc_feature (52)..(52): n is a, c, g, or t
  misc_feature (56)..(56): n is a, c, g, or t
  misc_feature (61)..(61): n is a, c, g, or t
  misc_feature (64)..(64): n is a, c, g, or t
  misc_feature (70)..(70): n is a, c, g, or t
  misc_feature (73)..(73): n is a, c, g, or t
  misc_feature (112)..(112): n is a, c, g, or t
  misc_feature (117)..(118): n is a, c, g, or t
  misc_feature (126)..(126): n is a, c, g, or t
  misc_feature (137)..(137): n is a, c, g, or t
  misc_feature (142)..(142): n is a, c, g, or t
  misc_feature (150)..(150): n is a, c, g, or t
  misc_feature (160)..(161): n is a, c, g, or t
  misc_feature (169)..(169): n is a, c, g, or t
  misc_feature (188)..(189): n is a, c, g, or t
  misc_feature (197)..(197): n is a, c, g, or t
  misc_feature (215)..(215): n is a, c, g, or t
  misc_feature (288)..(288): n is a, c, g, or t
  misc_feature (305)..(307): n is a, c, g, or t
  misc_feature (309)..(310): n is a, c, g, or t
  misc_feature (314)..(314): n is a, c, g, or t
  misc_feature (316)..(316): n is a, c, g, or t
  misc_feature (321)..(321): n is a, c, g, or t
  misc_feature (323)..(323): n is a, c, g, or t
  misc_feature (327)..(327): n is a, c, g, or t
  misc_feature (329)..(329): n is a, c, g, or t
  misc_feature (332)..(332): n is a, c, g, or t
  misc_feature (341)..(341): n is a, c, g, or t
  misc_feature (365)..(365): n is a, c, g, or t
  misc_feature (371)..(371): n is a, c, g, or t
  misc_feature (374)..(374): n is a, c, g, or t
  misc_feature (386)..(386): n is a, c, g, or t
  misc_feature (407)..(409): n is a, c, g, or t
  misc_feature (413)..(413): n is a, c, g, or t
  misc_feature (415)..(415): n is a, c, g, or t
  misc_feature (431)..(431): n is a, c, g, or t
  misc_feature (433)..(433): n is a, c, g, or t
  misc_feature (436)..(436): n is a, c, g, or t
  misc_feature (439)..(439): n is a, c, g, or t
  misc_feature (460)..(462): n is a, c, g, or t
  misc_feature (480)..(480): n is a, c, g, or t
  misc_feature (507)..(507): n is a, c, g, or t
ngannctggaaggntcncattttttccatttnttttttcncncaaantttangaancttcnccnttaaanaanccaacaaccccccaaggcaaaaaattgaaaaaaaaaaantaaanncagggtcnaattttaaaanggaangaaaaaanaaaaacccanngcaccaanaaattgaaaaaaaaaaggnnaaaccccncccccccccccccggaanaggaaaaaagaatggggggggggcccagggcagcggggggaggggggcagggggggcaggggggggggggggnccccccccccccccccnnnanncccncnccaananaaananaanccggggccnttccaaaaaaaaaaacaggggtcnccaaancanaaagggaagggnaggaacaaccccccccccccnnncccncncaaggcacccgtcccncnccntanaacccgggaaagacacccccnnnccccgggccccgcccccncctgccgcccgggggtccccccccccnttccacccgagcccctcccccccccccccccggg

SEQ ID NO: 675494 - DNA, 511 bp, Homo sapiens
gtatctcagcagaattgcaacttctgattttaggttcttgtcaatctattctaactcttagcaaaagattcttgctgttcagcctcagaaacacttttatcttagtcgactttcctgaaatcatgctgtattgagctatgattcttactcaaatgtagttcctatgtcagaatctcatcaatgagaaatttcgcaagattgcgtgccaaaatatccagtaccacgcttgcatatttttacttcaaacagaattaacactgcatcttagacacagcgtggtttaccctgctagtcatctcaaacactgaagacggtgactgtactacatgattatttacctgctcagctcaggttcccattgttcacattcacatcaagacagatcagcactggcacaaccactgcttttattgggtatatcaagtgttaacagatccttcaatgtgtttctcaaaatctctgttggcctatggtaaagaaaaataaaatctattttgaaaactcaaaaaaa

SEQ ID NO: 675495 - DNA, 388 bp, Homo sapiens
  misc_feature (1)..(1): n is a, c, g, or t
  misc_feature (15)..(15): n is a, c, g, or t
  misc_feature (82)..(82): n is a, c, g, or t
nattcgtgaattggncagcctcctgagccagtagactctgagattccggcacagccaagtggtgaaggatttatgggcaganaaaggaaagtgatgtacagaacacagaagtgaggtacagaaacagctggattggttacaggttggcatttgccttattgaatacagtttgaacagatggctacatttgattgtccaaaactcagtgattggcacaagtgtaggctatggtccgtttatacctccacttgttatagttcacaatgtacagagaaacctttaggctgaacttaaaatatgtaaggaggcagctttaggctaaacttgatttaacaagtacccaaaaaagacccaagagagccccaataggccgggcacggtgaaacac

SEQ ID NO: 675496 - DNA, 196 bp, Homo sapiens
cacgcacagcaactgcctgactccagaagttaagctgcttcatgcacatgtatgggagaggacctaatcttcttgtacaacctatgttgtactagaagcatacgtgtatgaggcttatttttacacaagcatcttactcatgtcaacacagtgctctgacggcgggagtgatcaactccaagctcagggacgtttg

SEQ ID NO: 675497 - DNA, 699 bp, Homo sapiens
gtcacacccaatggtggcagaactgcttggattcccgtgcctggcaccccgacacctttctggggatggtaccacgggtggtgacccaccctgagccggcatcactcacatgtgcttcacagccccgttacacaccaccccgaggctccacgcccgaagagtggccagcgaaaatctagaggaggtgtctctctactgagggggctgaagaaaaatggcgcaccagcgaccagaagacagataggccctagcgtagactacccagtcatcccagacccctgcccccctgagactgttttctgagccctccggacctgagactgagtatttgtctttttcctttagccttagccagtgggtatgaggtgtcccgggggactgggtggcttccactccgccccattcccaagagggctctccctcccaccactgcgagccgggagcctctgcgtgtcctttcccagccgcctctgctcctcgggctcatcccacggttctgttgcctgtgctctgtttgtgttggagggaaggactggcggttctggtttttactctgtgaactttatttaaggaccttcttttttattggcggctccctggccctcggccgcttccccccgctctctgttgtacactttccatcgacccttgtttcagactaaaggcccaaacctaatcgtaaaaacagttaaaaatata

SEQ ID NO: 675498 - DNA, 468 bp, Homo sapiens
gacactacagtatctgtccctgggttggcagagacttgaaagcctttgtgacctggcttaatttgtttttcatcctatggtttttctaatggattttctggacttttgtaatcttgtaactattcaagctccactttctaaattttaagaacttcagtggaaagtttaaattgaaggtgctgtttgtagactcaccacccaacggacgcccagccaccacggcaaatccttgagtgttctctaagaatacgatgctggtcatcacagcttcagcatctcctgggttttgatgcttggctctttgctgatcttggcttcctggcttttcctccttcagttccttctcaccctctgctgtccttgtgtagtgatttggtgagagaaagcttttgtcccctgccctctgcactacatatgcggttcaagttttattattgcaataaaagtgctttatgctggcttttctca

SEQ ID NO: 675499 - DNA, 792 bp, Homo sapiens
gaactttaaggattggtcgagccacagacactcttcctgccagcattcctcacgtcattgcccgaagacacaaacaactaatgggcagcccctatacaaggacagttggctcctacagggaggtgactaagataaaccagaaagtcctgaacaaagacaagaatggccttataacatggtgtgatcacagcaagtatggtctaaaacagatgtccaatggtacaagacgcattcctgtgtcccctgaacaggcacgcatcctacaatcagcacgatgcgacctgcaattttagatcactgtgcgggcaaataggtggacaaacacagtctcatcacccatgaggtatgtagttaggagaagaggccttgtatgttaatccactggactgattacacatattcactggccgtaatcagaagaggtcagcttaaatacttcacccaggacctgtggggctctcttacagcgtggtactggcagatattgaagtacatatggtctcatgcgattgacaaaaatccttggaaatcccactgaagagatttgaacgtatgactagatgtatctggtccaattcctgcatatctatagctaagcaagcatcgcgcaaagcaacgcagtgcaatacatgataacgcacacacgaaccgaatgcaggaaaggaacacgaggcacattggagcaacccaaccagagcaagtcatgcagacgtagccaacacctaatggacgaacgtcgagcaacacgcacagccaggcagactccgtcagaccgacgcagcgaccacacac

SEQ ID NO: 675500 - DNA, 714 bp, Homo sapiens
ttcatcattaactgatcaaaatggtagatattgggccagggacggaagctctcgcctgtaatcctagcacttgtggaggccaaggtgggcagatcagttgaggccaggtgtacgagaccagcctggccaagatggcaaaaccccatctctactaagaaatacgaaaagaattagctaggcctggtagcacacgcctgttaatccctgctacttgggggactgaggcacaagaatcactatggacccaggaggcagagggttgcagtgagccaacatcatgccaactgtaccctagcccctgggcgacagtgagactgtatacattgaaaaacaaaaaaaaacaaaagggcacgggggacttaaaagaccaggttacacgccgggcgcgggactcacgcctgaaaagtcaccaaccactatatggagaggccagagacaggtggatcctgaggtcagagaacgagaaccatccctggccaaacatggctgcaagactccgctctctccactaaaacaatcacaaacaaaggtggagcgtagagatggcacgccaggtgaacccagcaagctaggcaggctgagaccaggaaactcacttgaaccccgggaagggtggcagaatgcagggagaccgaggacggagcccatctgcacatccagccggagacagaagtgaaatcggtccaaaacacaatagatcaaaaagacaagggg

SEQ ID NO: 675501 - DNA, 598 bp, Homo sapiens
gctgctccaaaaaatggaaattgcaaaacctccgaactccttcgggaaagcgaaacccaaggctccggcgcccagcctgactgactgcattggcacggtggacagtagagcagaatccattgacaagaagatttctcgattggctgctgagctagtgaagtataaggggaatttcagggcacttcaagaagatgagagagggtcctgcaaagaatatggtcaagcagaaagccttgcgagttttaaagcaaaagaggatgtatgagcagcagcgggacaatcttgcccaacagtcattcaacgatggaaccaatgcccaattataccatccagtctttgaaggacatcaagaccacggttgatgctatgcaaacactgggaagtacaaggaaatgaagaaggcatacaagcaagtgaagatcgagcagcaattttgcacgggaattttacaagagcagctagaggatatgatggaagatgcaaatgaaatccaagaagcactgagtcgcagtttatggaacccagaactggatgaagcatggatttaagaaaagggccaaggaaaggttgggatgcacataggtgatgagctctggtg

SEQ ID NO: 675502 - DNA, 120 bp, Homo sapiens
  misc_feature (7)..(7): n is a, c, g, or t
  misc_feature (112)..(112): n is a, c, g, or t
cgtaagnaagacgacaagaagggacaggggagtacaggcagaaagagaagagaaggaaaaagaagaccaagtaagacaaggtgaattttttgttggcttcaagtaacacttnggaaactg

SEQ ID NO: 675503 - DNA, 129 bp, Homo sapiens
  misc_feature (41)..(41): n is a, c, g, or t
cctatccggtcgctgctcgagatgcgcgatcaccaccgtgncgcgtgctcgaccagtacctggtcttcacgtgcttgtgttgatcgcgatgccgcagatggtctcccccggttgctcttattgatgtca

SEQ ID NO: 675504 - DNA, 1664 bp, Homo sapiens
ggatgtggtgtggtagctagtgtccgctgagccgctgtgttgtggggttgtcgcgccggtcggccgccctctcttgggggtagcagaggaggtgtctgtcgacgtttgttccttcggctggtttggagatgtgttcgcggagggaacacctcggttggtgtggctccggcccagctgcgttgagtagcgccgatgatggccgaccccgacggcgcttttggtgtggtggagtggcgtccgcctgtcgggggtcgccctgtctgatagcgtgccgcgcgtgagttaatgggtgtgtaagctgggctcgttacttgggggaagaaacgttgtactagacgacgggggcgagaaggacacacatagagggctgcttataatttgtctgacactcggacgaacggaacctgtgggtagagacaaaaattatgtcgcttcggggggggtgtgtcataatctcgagcttgggagacgcccgcgcgtcgtgtctgctgtgggtggagcgcgggtttgcgtgttcgggggtggtgcggttgctccccgtagcgagcatgcgttttatccggggctgtgtggcgtgagaaggtaatatgggcgcccctcacaggggggtgtgtttacgttaggcctcctgcggggtatggaacgttacacgcgggggggccctacttgttaatggggggccacaccttatagtgtgttcttaatgccgtccatcgctcctcgggcgcggcgttggcggtgtttggcccctcttcttagggggggacgcggtgtgaacaccccctctcgtgggtgcaagtgtggtggcccgcaggttgtgctttgtggtcgtcgcacgtgttacgcccacggtgtggggggtttccgccgctaagttgtgtttcaccggggggaggtttagccttggggaagccttttttctgtgggagggcgccacctgagttggtgacccactacttttataataggcgggggtatctatagaggggctggtttcccccgtcttgtgtgtcccgctctctgggttggggcccgcgtgtgtttggcggagctgttttttggagcactcttccacgggttccctcgagtggagagaaaagagctcttccaacgggggtcttttgtagaagtagatgtgtcacgcagttcgtagatggatgctttgtgtgccgtctgtgtggccccgcagcacgccaccagccgctgtggagagaggcgccctgtgtaggtagaaagatgggcaccagagttgtcttgtagaaaactctctcggcgcgcctctctaaaggtatactcgggctgggtttaaagggaatacacaccccaacctcgtgtttgtttctgtatgttcacataatagatttcttcgggagataacaccaccaccaccaccaccaccacataataataataacaccaccaccacaacggtagataaaccaccaccaataacaataataatatataaaatatatcctgaatggccacgagtttttttcataaatattctgcctacgtgtaaataatgggttcctctgaggttgttttatgagaaaattagcgccaatgtattaaaatccagtgttagggaatttcactggtcttacctaccataacttttattttgggattgaactattattaaattgtatcttatcctggga

SEQ ID NO: 675505 - DNA, 240 bp, Homo sapiens
gcggttatggtggaatagtgggagctgccccacatgctgcagatgcctcgccttcatagtggaagtcacagtggctggctcgggtccgacactttgatgggcaggtgcttgtacacgcaggttccgttgcgcacagcctttgggtccagcagtacgacacggttgtcacccacgcaccttggccaccgtgcaggttctccagggtccaggtctcattcacctgccggagagggatggcat

SEQ ID NO: 675506 - DNA, 278 bp, Homo sapiens
cctgcgtatcgcagtgtttgtgtccctgggtacttgagattagcggcgtggtgatatctcttaaggagcatgctgccttcaagcatctgtttaacaaagcacatcttgcactgcccttaatccatttaaccctgagtggacacagcacatgtttcagagagcacagggttggaggtcaggtcgttggtctgcaacacagcttttatgagcaggaggtcatctgcagttttccagcggcctagatccttggtcacctgaagtggctgtttactcttctt

SEQ ID NO: 675507 - DNA, 426 bp, Homo sapiens
ctatacgcgaatcacactgtaacactctcgtacattgctccatagtcctcatcctgctgggcctgctgctcttcaacaatgtaccccattgatgagtgacgatgtgcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgttaggaagggaacttaagactcaaggaggtggcccaggacacttgctgtgctcactgtggggccggctgctctgtggcctcctgcctcccctctgcctgcctgtggggccaagccctggggctgccact

SEQ ID NO: 675508 - DNA, 889 bp, Homo sapiens
  misc_feature (122)..(122): n is a, c, g, or t
  misc_feature (126)..(126): n is a, c, g, or t
  misc_feature (129)..(129): n is a, c, g, or t
  misc_feature (184)..(184): n is a, c, g, or t
  misc_feature (198)..(198): n is a, c, g, or t
  misc_feature (234)..(234): n is a, c, g, or t
  misc_feature (237)..(237): n is a, c, g, or t
  misc_feature (260)..(260): n is a, c, g, or t
  misc_feature (264)..(264): n is a, c, g, or t
  misc_feature (273)..(273): n is a, c, g, or t
  misc_feature (282)..(282): n is a, c, g, or t
  misc_feature (309)..(309): n is a, c, g, or t
  misc_feature (320)..(320): n is a, c, g, or t
  misc_feature (327)..(327): n is a, c, g, or t
  misc_feature (333)..(333): n is a, c, g, or t
  misc_feature (355)..(355): n is a, c, g, or t
  misc_feature (416)..(416): n is a, c, g, or t
  misc_feature (425)..(425): n is a, c, g, or t
  misc_feature (436)..(436): n is a, c, g, or t
  misc_feature (447)..(447): n is a, c, g, or t
  misc_feature (472)..(472): n is a, c, g, or t
  misc_feature (475)..(476): n is a, c, g, or t
  misc_feature (520)..(520): n is a, c, g, or t
  misc_feature (543)..(543): n is a, c, g, or t
  misc_feature (572)..(572): n is a, c, g, or t
  misc_feature (581)..(581): n is a, c, g, or t
  misc_feature (591)..(591): n is a, c, g, or t
  misc_feature (602)..(602): n is a, c, g, or t
  misc_feature (620)..(620): n is a, c, g, or t
  misc_feature (624)..(624): n is a, c, g, or t
  misc_feature (632)..(633): n is a, c, g, or t
  misc_feature (641)..(641): n is a, c, g, or t
  misc_feature (646)..(646): n is a, c, g, or t
  misc_feature (654)..(654): n is a, c, g, or t
  misc_feature (658)..(658): n is a, c, g, or t
  misc_feature (670)..(670): n is a, c, g, or t
  misc_feature (674)..(674): n is a, c, g, or t
  misc_feature (688)..(688): n is a, c, g, or t
  misc_feature (691)..(691): n is a, c, g, or t
  misc_feature (696)..(696): n is a, c, g, or t
  misc_feature (699)..(699): n is a, c, g, or t
  misc_feature (702)..(702): n is a, c, g, or t
  misc_feature (714)..(714): n is a, c, g, or t
  misc_feature (739)..(739): n is a, c, g, or t
  misc_feature (746)..(746): n is a, c, g, or t
  misc_feature (758)..(758): n is a, c, g, or t
  misc_feature (764)..(764): n is a, c, g, or t
  misc_feature (766)..(766): n is a, c, g, or t
  misc_feature (792)..(792): n is a, c, g, or t
  misc_feature (797)..(797): n is a, c, g, or t
  misc_feature (882)..(882): n is a, c, g, or t
ggtgggtgagtgcaccgcgttctcgcacgcgtcatggcggtcctcggagtacagctggtggatgaccctgctcactgccaccctcatgcacaggctggcgccacactgctccttcgcgcgcnggcngcnctgtaacggcagtttgttccgatacaagcacccgtctgaggaggagcatcgggcnctggcgagggaagncgaggcccagaggcaggaaagagcggtgggccaatngcnttagtgaggagaagccactgatntgtnccccgagangccccgttncagctggagaactgccccctcacgacngtggatgcacnggaggcntactantacatagctgggaccagcaaangagaataaaattgctgtgtatctggtgcctgcacacggtgacacaaatccatcaagatgtncctgaaagnaaaaaggctgnacttcagcgcngaggaggggggtgagcgctctgtangcnncaactttgcattaatcttcctgctgctggaatgctggtgaagtngtgcgggaggagaacctcgagcngggcctggagcatagatggccagcatganccagaactnagagccactnctgaagaagcngggctgggactgggcgcntccngtggccannctggctanccgcntgggactngcantggtgggctctntgcngggtgcctccctcnccnccccncgnctncggctggcccanacccaccgggacgcactgaccatgntggaggncacacccatgcngcagtntntcctgcacaccagcatcctgtgtacnctgtncaccctgtggctctggacacaccccaccgcacgggactccctgcaccacccgccgtttgggggagacgcgtatttccctgctgtncgattct

SEQ ID NO: 675509 - DNA, 122 bp, Homo sapiens
  misc_feature (74)..(74): n is a, c, g, or t
  misc_feature (97)..(97): n is a, c, g, or t
  misc_feature (107)..(107): n is a, c, g, or t
tgtcgtagagtgtatatggctgaatcatcgctacttcacgccaatgcgctcatatctttatctgcctcttcccnttacacatcggcgaggctatatnacggatcatntctctactcagaaac

SEQ ID NO: 675510 - DNA, 206 bp, Homo sapiens
gccacgtcggcttccggaggtgctgggatgacaggtgtgtgagccgccacgcctagctgtctctttgccattttttaatttcttgtttcatttttcctctctcccttgcctctctttttcttcttccttttattctttcctgtcttgttctttccttcctctctgtttctccctttctccctgaagaccctgaagattgcttgtgg

SEQ ID NO: 675511 - DNA, 139 bp, Homo sapiens
  misc_feature (124)..(124): n is a, c, g, or t
tgggttgaagctcagagaggcaggtccttgatgaccccataactcccactgcccctttaacaagggactcttaacgagccggatgataacccaaatcctaaacactgttgcctcatgacgcctncttccagcacacagc

SEQ ID NO: 675512 - DNA, 702 bp, Homo sapiens
cctacaaagagacttagtctcccacacaataataatgggagactttaacaccccactgtcaacagtagacagatcaacgagacagaaagttaacaaggatatccaggacttgaactcagctctgcaccaagcagacctaatagacatctatagaactctccaccccaaatcaacagaatatacattcttctcagcaccacatcgcatttattccaaaattgaccacatagttggaagtaaagcactcctcagcaaatgtaaaagaacagcaattataacaaactgtctctcagaccacagtgcaatcaaattagaactcaggattaagaaactcactcaaaaccgctcaactacatggaaactgaacaacctgctcctgaatgactactgggtacataactaaatgaaggcagaaataaggatgttatttgaaatcaatgagaacaaagacacaacataccagaatctctgggacacgttgtaaggcagtgcatagagggaaatttatagcactaaatgcccacaagagaaagcaggaaagatctaaaattgacaccctaacaccacaattaaaagaactagagaagcaagagcaacacattcgcagcagaaggcaagaatagctaagatcagagcagaactgaggagatgggacgaacgctcaagatcatgatccggactggttttggaagacctggtggc

SEQ ID NO: 675513 - DNA, 178 bp, Homo sapiens
gaacaacaatgcggacaatgtatcccactagactacaaggcataaattgtggcccacacttcactccatcctttgccaaccttggtcgcactaaccttaacacccgtgggcccccaaggggtgggccaggtggggagctgccccgtgggccgactggtctgagaccccggcgctctca

SEQ ID NO: 675514 - DNA, 745 bp, Homo sapiens
ggcggcgaagcgctctggagaatcccggacagccctgctccctgcagccaggtgtagtttcgggagccactgggtccaaagtgagagtccagcggtcttccagcgcttgggccacggtgggcggtcctggtgagcagaggtggagcgaccccattacgctacacagatgaaagtgctggaggttgggctggccctgcttctgggggccctgctgggaatcctgcctgttgctcggtagtgagccaggatctccactgtggagcatgcatgggctcgtggatgagatgaactagtaattgggaaattgcccaggtggacccctagatgaaagaccattcatgatgggatctttccggatacatgtccagtatggtcgagccagtcagtgtggtgtgaggtaactgttactgtttcccccataagcaaagtagtctcactctgggctttggatgaaattcgagctgcttgaaaagaggaccttggttgtactagaacactgaagaaagacatgactcagaaaataacagatttggctctgtctcattttggacagaatgctgcaggcttattccccatgcacctttgcttcctggctgcgaaagccttaatactttgtttctgctgtagaatttgttagcaacacagggagtcctgatcagacccttcttcagatccacatgactggtttttaatgtagcactgtggtatacatgcaacatccgttcaaaatctgagtcggagctaa

SEQ ID NO: 675515 - DNA, 544 bp, Homo sapiens
ccggtctaagcggatactaccgctactgagagacagtaacagtatcacctccagatgcgtcttgccaggccacctctcctacctaagagctaatggaacaatttgtgataggtttgtcagtgtcccccatcgactctctggggctagatcactatagttattaggcctctgctagcagccgtacatactagatccaaagtgtggcagcgaagaacagagtaccctctatcaagccccggtcatgataggaggtcacagccacagggaaacatgagctcagtggtcttggaacagctcactaagtcagtccttccttagcctggaagtcagtagtggagtcacaaagcccatgtgtatggccatctaggccttcacctggtctgtggactaatacctatgtgcttggtttacaggtccagtgtttcttcagcccatgacagatgagaaggggctatattgacgggcaaagaggaactgtagtatgaatattcctgagagcctggcttagtgctggcgcatctcttaaacctcattacaatgaggt

SEQ ID NO: 675516 - DNA, 185 bp, Homo sapiens
tgaaaagaactgtagatgcccggctgcaattaagtgaggaatagagtagtaggtagatagaagccaaaacctattgatgtacaagtacattacacaccacatgcagcgatatacagtttagagtaaaggaggatcaatagctaggctaacacgcctgaatatactaaccaagtaatagccacacc

SEQ ID NO: 675517 - DNA, 233 bp, Homo sapiens
aggtctagaggatcccttcagcacatatagtcaggcgtgagctaccatgcccagccaaggctaggtatttaaagtgtcaaggagttgatttcaagcttagatgcagtgacccccccccacccctgggaagaaaggtacattacatcacattggccatcttgaagtaagattcatggatagtataatcaaccacacacacattaaaacaacaacaacaataatataatactcta

SEQ ID NO: 675518 - DNA, 1016 bp, Homo sapiens
tgcaccacatcatcaacgtagatatctgcctatacactttaccaactaacttctttgggaataatagtatgagtcgcctcattaatgtcgatgatctctcactctagctatgccttatgaagtgatttaagttctatgcgcttgtctcgattttagatcattctcataatgctcagatagctactcccgtcgtaatcctttattgtgcctatctgctcgtacgtaggctaggctcagctcttgtgcaagcaacataaaggggccttctcattacataggtcttactactcttacgcaataacgttattgagacgggagaaactactctatcattatctcttaaaactttaactcgaatcgtctgccatactaatcagatcctcaaagcagtgatatatctgaacagctgctgtgcaatttgcctcctgaactctttaatctgagatctagtctcaagtcattcacacatggcattaatttcatttatacattcaatacccatacgattgataattttaccctgatcaagcaaggaacgtacctggcttggacctcgcatacttgttgacttcccggcgccctcggtaaaatccgccactatctttaaatacatgtggaagatgtgacttaaccggatcatagaatggtgccctgcatcccgctgaaatatgccatgtaagtcagtcatttaatatattatcattatctaactatgcttcttgacaaatctctatgatctgagtcagtctcatgcgaatcgacacggctcatcttatcaaaatctcgtgcaggcacctgaatccctactatgttttatgtcgcgtgtcggtcggagcctaccgctgaacattgttattgccaaattgaccataaggcatgccttgacgcgggttagggaatccaagtcatggtggcgccctgcttgcagagcttagtcccgacctgggatgtagggggccaaaaacgggagctagccagagcctggaaaacacaagaagacacaacgaactaaaaca

SEQ ID NO: 675519 - DNA, 220 bp, Homo sapiens
ggatcgatcagagcatacccctagttcaatactttcctataccccaaagctctatactttgaaggaaaacagatacagtatccaattatgacactttccttgcccaattaatagcactaggtacacccagtggctcatatttaacttaccccagcttcccaattcaaactggggggagaaaaactaaatcattgggagttacttgccaacttggaagttg

SEQ ID NO: 675520 - DNA, 395 bp, Homo sapiens
gcccacggcaggtgtactgagccagatgcatgacagagcaagactcggtataaataaaaaacaaaacaaaacaaaacaaacaaaaaaacaaaacagaaagaaagaaaagaatcttggcaaggcacagtggctcacacccgtaatcccagcactttgtgaggatggcttaagcccaggagtttgagactagcctggacaacatagtgataccttgtctccacaaataatttaaaaatgagctgggtgtggtggcatggatctgtggtctcagctactcaggaggctgaggtgggaggactgcttgagcctaggcagtggaggctgcaatgagccgtgagtgtgccactgcattccagcctgggtgacagagtgaaaccctgagtacaacctgccgg

SEQ ID NO: 675521 - DNA, 126 bp, Homo sapiens
gactcactggaacagaagcccacaaggctgaaagtatgcgatgtcatttgaattttgatccgaactctgctcctggggatgcaagagtttatgactaagtgcaaagtagtggtcccatggttgtga

SEQ ID NO: 675522 - DNA, 1055 bp, Homo sapiens
ggataaagccccaggtctcatatgcaaacaggcacttccgcgaaagcttacactaatgtttctggcatggagcgagccgtcgatggcgctgcgcatgcgatgccggctgttactacgatccatgtcgacatcacacagatggcacgaggaatcacatgaacgacagctccctcacggctcatgacgtggcccgagtgcctgtgctggatgacctgttgtgcctgaacttaggtcgctattgagtcgactatcttacctcgcactcgtgctcgacagtggacaaatccattggcagcatagctttgtgcactgactgaagtttgccccttgaacggacctatcgttgcacgcagctcaatcttcggattgcgctttcgttttccttcaaccgggccttcttccaaagggaaacgcgaccagacaccgtgtgcacccgtgtgctaatcgtgcacgctattgcgagaagtttccctctcaatatttactatccctattagactaaccccacgctaattgtgggcttagggcccccaccgaagatcattaagagtggccttggagaccgatagcgtggttattgccaagggaacacgaggaggcccccctttgagaaaggcgccgttaaatcacaggtggcgcccaaggaaccggccaggtaagacggaaggggcccatcgcgtggaaaacagtgaacaggcctttgtaagccttcagcgcaaagggcttttccgggcaccgcaactggaaaaaggccgataggcgagaggactgcaatggccgttgggcggaagtccgaaccccctgagagaacagtgggccgcaccacaagagtccgcaccccggaggccaaacccaaacggtggaccttttggcgggagggaaaggaaaaccaggccccctgcggagccccgccttagtggaaaagggcctgtaggcgaccgcagcatacgaccgccagcaatgagcacggttagacaccgagagggacaccacggcagtaggacaccaggcgcagggcgtacggataaggaaaggggaggcgcaccctactgcag

SEQ ID NO: 675523 - DNA, 1005 bp, Homo sapiens
  misc_feature (620)..(620): n is a, c, g, or t
  misc_feature (655)..(655): n is a, c, g, or t
  misc_feature (662)..(662): n is a, c, g, or t
  misc_feature (741)..(741): n is a, c, g, or t
  misc_feature (786)..(786): n is a, c, g, or t
  misc_feature (788)..(788): n is a, c, g, or t
  misc_feature (798)..(799): n is a, c, g, or t
  misc_feature (808)..(808): n is a, c, g, or t
  misc_feature (821)..(821): n is a, c, g, or t
  misc_feature (853)..(853): n is a, c, g, or t
  misc_feature (864)..(864): n is a, c, g, or t
  misc_feature (890)..(890): n is a, c, g, or t
  misc_feature (895)..(895): n is a, c, g, or t
  misc_feature (929)..(931): n is a, c, g, or t
  misc_feature (935)..(935): n is a, c, g, or t
  misc_feature (939)..(939): n is a, c, g, or t
ctggtacgaggatcagcagtgatttctttgaggaggagagcccgtttcttcactcacaggccatgtctgagtgtatcaagaagaacagagtgcccttttatgagatttgtctgcgtagaccactagcttggactggtgctctggatggctgaggttttaatgtgactggatgtcccttggagtagctcccaggctgtgctcttgtggttgggtgctcctcctggagggagagaaaagtctctcctaggtatttggttgtccacctcaaccacttgctgagtcttccgcaagaccaggcacctcggcagagatttctgggttgtcaggcagaaccgagcattcaagggtgataactcactggagtccctgaaatccctgatggacgcaccaggcggaattctccacgagtttgagcagcctcgggtttcccaccacctccaaatcatggaagacacacggtgcaggcagagcccccggagccatggccagcccttccggcagctccgaagccactggcaagccccgaggcagggatggccggcccaggagggaggaggacgacgtccctcccgaagagaagaggctgcggctgttgctggaggggggaagcgcacagcccnaggactgcgaggacggggaggacgcgccgcggccnggcaggnaggagaccggcacccagacaggtggcgacggcagaggagtgcagtggttcacacctgtaatcccagcactttgggaggncgaggctggcggatcacctgaggtcaggagttcgagaccagcctngncaacatggcnnaactgtctntactaaaaatacngaaattagccaggtgtgatggcacacacctgnaatcccagctncttgggaggctgaggcaggagaatcntttgnacctgggagacagaggttgcagtcagccgagatnnnaccnctgnacttcagccacctgggtgacagagcgagactctgtttcaaaaataaataaataaataaaatagaaa

SEQ ID NO: 675524 - DNA, 105 bp, Homo sapiens
tatgtctcctttttgagcctgacatgtctcgggtcgctgctatgatacccagatgcccagcccagggccaggcacacagcagagcgcaggacctcggatattaag

SEQ ID NO: 675525 - DNA, 480 bp, Homo sapiens
tcatcccatcctccagggcccacaagtccatgactgctgcctctacccccaaccctactgacctgaaatttggcccttgctttcatttctgggagcatacaacacttacaccaagcattgatgggttttattgacttcatttgagttgtggggccatggagagtgttccatgatccttgcttggtgttgaccaactcattgacttttctcctttgacttcacccttcccttttctactcacatcctctgtcatggattgctatgggaattctgagccctggttcctttattttgcagataacttcactcttctctgcaacgaatcccaaaagtatataattgagctgactgcaaggtacttgacacgcaagagactccacaaatgggattcagcctctggaaagtggtggtagttccagatttatgtggatgttactttgtttttccctataaaatatattatttaaactatcaaaaaaa

SEQ ID NO: 675526 - DNA, 377 bp, Homo sapiens
ttgggacagagacctatggcctgcaaagctgaactatttaccatctggctctcaagaaaagggaaaaaaaaatgcttatctttgtaccgcgacagtcttagattaagaggactttgtaccaccctgacgtcccaggcggccgtgagtccagccacccctgaaatgtacacaagtctgggctagggttgcagcagataacttcactcttctctgcaacgaatcccaaaagtatataattgagctgactgcaaggtacttgacacgcaagagactccacaaatgggattcagcctctggaaagtggtggtagttccagatttatgtggatgttactttgtttttccctataaaatatattatttaaactatcaaaaaaa

SEQ ID NO: 675527 - DNA, 129 bp, Homo sapiens
cccccccccttttttgggggtttcaaaaaaaagtgaacttgatcccccggctccccctaaacccagttgggccaaaatttaacgtgccaccagatcgaaaggttatagaaataaaactaatgagttcta

SEQ ID NO: 675528 - DNA, 838 bp, Homo sapiens
ggctgttcttctcacatgacaaaaatagcccccatctcaatcatataccaaatctctccctcataaaggtaagccttctcctcactctctcaatcttatccatcatagcaggcagtgaggtggataaaccaaacccagtacgcaaaatcttagcatactcctcaattccccacatagggatgccataatagcagttctaccgtacaaccctaaataaccattcttacatttacctcttcatattatcctaactattaccgaattcctactactcaagtttaaactccagcaccaggaccttaatatatctcgcaccctgaaacaagctaacatgataacacccttatttccatccaccctcctctccctaggaggctgcccccgtaacggcttttgcccaagtgggcattatcgaaggatcacaaaaaacaatagcctcatcatccccacaatcatagccacatcaccctccttaacctctattctacctacgcgtaatcaatccactcaaacaccataatccccatattaagcagtgtagaaatacagtgccgcgttgggaacattataaaaaccacaaccaattcttccacaaaattcattgccctaaaccagcttaatcctaactaatttcccctttaatactagtaatcttaatagcaccaacaacatcacctacaacccaagtttggggccccgccctcgaagagctctaacaccattgttggggccgcgccccacggtagtaacaggccaccggtcccacgacacggcgcacgtgtggtgttccaaaaaaacgggcgcggtcgcccccggttggctgtatagggcggcacgg

SEQ ID NO: 675529 - DNA, 416 bp, Homo sapiens
  misc_feature (21)..(21): n is a, c, g, or t
  misc_feature (39)..(40): n is a, c, g, or t
  misc_feature (55)..(55): n is a, c, g, or t
  misc_feature (59)..(59): n is a, c, g, or t
  misc_feature (69)..(69): n is a, c, g, or t
  misc_feature (79)..(79): n is a, c, g, or t
  misc_feature (251)..(251): n is a, c, g, or t
gtccgcgccgcgcggacccancgagcccgcgctcagacnncccagctccgccganaggncgctcgcgcngggtccttcntcttccccaggtgcaggcagagcccccggagccatggccagcccttccggcagctccgaagccactggcaagccccgaggcagggatggccggcccaggagggaggaggacgacgtccctcccgaagagaagaggctgcggctgttgctggaggggggaagcgcacagcccnaggactctccagggagtcggcgaacgcgccccgcccccccacaaagagcagacccccccccctaacaaaagagcgccgcgcacaaaagtcgccgtttttcaatatttttcgagcctctgcgtttctccaccacctcccacaatatacggcgaacgagctagaggt

SEQ ID NO: 675530 - DNA, 826 bp, Homo sapiens
  misc_feature (21)..(21): n is a, c, g, or t
  misc_feature (39)..(40): n is a, c, g, or t
  misc_feature (55)..(55): n is a, c, g, or t
  misc_feature (59)..(59): n is a, c, g, or t
  misc_feature (69)..(69): n is a, c, g, or t
  misc_feature (79)..(79): n is a, c, g, or t
  misc_feature (251)..(251): n is a, c, g, or t
  misc_feature (286)..(286): n is a, c, g, or t
  misc_feature (293)..(293): n is a, c, g, or t
  misc_feature (430)..(430): n is a, c, g, or t
  misc_feature (436)..(436): n is a, c, g, or t
  misc_feature (440)..(441): n is a, c, g, or t
  misc_feature (463)..(463): n is a, c, g, or t
gtccgcgccgcgcggacccancgagcccgcgctcagacnncccagctccgccganaggncgctcgcgcngggtccttcntcttccccaggtgcaggcagagcccccggagccatggccagcccttccggcagctccgaagccactggcaagccccgaggcagggatggccggcccaggagggaggaggacgacgtccctcccgaagagaagaggctgcggctgttgctggaggggggaagcgcacagcccnaggactgcgaggacggggaggacgcgccgcggccnggcaggnaggagaccggcacccagacaggtggcgacggcagaggacctctgcctcagtctcctcttctggaaagtgggattggaaaccacatctgcttctctcccagggactgctaggaagacaaagattagatggcccagganggaaantacnngtacagccaacttccttgaggnttcgtcttttgcatcagggtgtctcaaactcctgcccttaaaacacctgcaagagaatcatctaggtggcttgctcgctctgcatgcagaccctttagaatcagagtcagaatacctggggctggagccacaaaatgaaatgacatttcaacaagtttgtcatcacgtaagagagaatagataacttcactcttctctgcaacgaatcccaaaagtatataattgagctgactgcaaggtacttgacacgcaagagactccacaaatgggattcagcctctggaaagtggtggtagttccagatttatgtggatgttactttgtttttccctataaaatatattatttaaactatcaaaaaaa

SEQ ID NO: 675531 - DNA, 885 bp, Homo sapiens
  misc_feature (620)..(620): n is a, c, g, or t
  misc_feature (655)..(655): n is a, c, g, or t
  misc_feature (662)..(662): n is a, c, g, or t
ctggtacgaggatcagcagtgatttctttgaggaggagagcccgtttcttcactcacaggccatgtctgagtgtatcaagaagaacagagtgcccttttatgagatttgtctgcgtagaccactagcttggactggtgctctggatggctgaggttttaatgtgactggatgtcccttggagtagctcccaggctgtgctcttgtggttgggtgctcctcctggagggagagaaaagtctctcctaggtatttggttgtccacctcaaccacttgctgagtcttccgcaagaccaggcacctcggcagagatttctgggttgtcaggcagaaccgagcattcaagggtgataactcactggagtccctgaaatccctgatggacgcaccaggcggaattctccacgagtttgagcagcctcgggtttcccaccacctccaaatcatggaagacacacggtgcaggcagagcccccggagccatggccagcccttccggcagctccgaagccactggcaagccccgaggcagggatggccggcccaggagggaggaggacgacgtccctcccgaagagaagaggctgcggctgttgctggaggggggaagcgcacagcccnaggactgcgaggacggggaggacgcgccgcggccnggcaggnaggagaccggcacccagacaggtggcgacggcagaggaagataacttcactcttctctgcaacgaatcccaaaagtatataattgagctgactgcaaggtacttgacacgcaagagactccacaaatgggattcagcctctggaaagtggtggtagttccagatttatgtggatgttactttgtttttccctataaaatatattatttaaactatcaaaaaaa

SEQ ID NO: 675532 - DNA, 403 bp, Homo sapiens
caaactcccttactagacttcttaaaagcatcttgtattacaccagaactatcctaaagcaagtctacaacacaaagagcctcaacttaagaaaacatcatagtcttcaaggacagaagaaaatctttaaacttcacttcagcattatatatagacagtttcggtcttcagtattatagtcccagatttctggaacccttctaattggtcaggtttaagcaaatcaataacctctctctaatctaccacaggacttaagtcagcattatccatcaaaggaatataagtagttgcatgaataaggggtacatctacgaagacattttcagtctattgtatctttgatgaagcttacttcttccctgatccactaatcttgttaagtctcttggtggtagaacat

SEQ ID NO: 675533 - DNA, 123 bp, Homo sapiens
agtcacagtatgatcacaaatgggcaccgttaaaacagtaacaaaaaacacaccacacattgaaaaatccttgtcactaaacacagtggaccaacagaggcaactctcacagtgtcttaaggt

SEQ ID NO: 675534 - DNA, 276 bp, Homo sapiens
agtcatttcactattcaactagacaaccagcagcgtaaacttgagtaatggacgagggaataattgatatacactctttctttgtcattattgcgtctttatcttatgcatcagtattcttacgaaggaccttgtctcttccattcgagattgtgtgtcttatgaactgaacagatgttgcctttcatgtgatgtaactattaattttttcctgctcatacttcttaagcgattcctacctgcctctcatcatgaatcattgaagataattctcca

SEQ ID NO: 675535 - DNA, 276 bp, Homo sapiens
gggtcggccgtgcttggtgcatctcggctcatgtaacctctctccgggtttcagcaattctcctgcatcagacctctgagtagttgagattacaggtgcatgccaccatgcccagctaatatttgtatttttagtagagacagggttacaccatctaggccaggctggtcttgaactcctgacctcgtgatccacccgtcttggcctcccaaagtgctgggattacaggtgtgagccatcacgcccggactttttttttgagacgacgttccactc

SEQ ID NO: 675536 - DNA, 109 bp, Homo sapiens
tcccggttgggatcacaggtcttggtgaggagggtcttgactgaggagggtcttggtgaggcagcacaaactggaaggttgtgctagaggttgtgctgaggttagtgct

SEQ ID NO: 675537 - DNA, 290 bp, Homo sapiens
ttgctggttgagccctcccaacagacatgtatctggcagagttgggacattgagtgtgggggttgcggggaacatgtgacatctttggaatcatgacggtgccagagcggataccttgaaatgtactgttgggccgttatagaggtctaaaacagagacctgtggaagtgacttggtccggacagtgtggacattattcctatagtgggggcattcaagatctaggcctgtgattgactagcacaatacttaaagtattggtcaggattgattaaacaactcctgcctgt

SEQ ID NO: 675538 - DNA, 642 bp, Homo sapiens
  misc_feature (305)..(305): n is a, c, g, or t
gcgtgcccgaggctctcgcctcccccgtccgcatcggaggcagctcgagcccagtccggggcccattgcagcagcgccgagagcagcccagtagccatgcgctcatgtggccgggtggaactgcctacatcgacttacctcatggcggatgggacctgtcaggacgcgggcatcgtgggttacaaggactcgtcctccgtctgggccggcgtccccgggaaaaggttcgtcaagaattacgccagttgaggtgggtgtcctggttggcaaagaccggtccatgtttttagcgtgaatgtgcgctngacacttgggggtgccagaaactgttctggggtgatccgggactcactggctgcgtggataggagcggactttagccctggatcttcgtatccaagagcaccgttggggcccccctacctgttccaggtcactgctcaccaacgactggacatatagcgctaagtccgtgtcttgagtgggcatacagaatgtgtgtcccacgagctgagtttggacttcaagcagcgacgactgttactgacatgggctctgccgatccttcggctgttgccagctactgagcctcgtacttgtccccattccgcccttacatccggctcctacaacaagggttgg

SEQ ID NO: 675539 - DNA, 330 bp, Homo sapiens
gcaggaattcggcacgagctgcccagagggcgagcaggagccaccacagcttgcaccgtctgtgccacctccaggcacagtggactctgaacctcgggtgtccccagtagctcccatggaatctgggatatttcctgataagtattccctgcagtttggctttgggccttttgagttaccccctcagtggctctctgagacccgaaatagcaagaagaggctgcttcccccactgggcaataccccagaagagctgatccagacaaaggtgcccagagtgaacagggtggaacggaagatgagcagaaacaataaagtgagcatttttcc

SEQ ID NO: 675540 - DNA, 796 bp, Homo sapiens
  misc_feature (129)..(129): n is a, c, g, or t
  misc_feature (189)..(189): n is a, c, g, or t
  misc_feature (201)..(202): n is a, c, g, or t
  misc_feature (204)..(204): n is a, c, g, or t
  misc_feature (206)..(206): n is a, c, g, or t
  misc_feature (253)..(253): n is a, c, g, or t
  misc_feature (256)..(257): n is a, c, g, or t
  misc_feature (277)..(277): n is a, c, g, or t
  misc_feature (300)..(300): n is a, c, g, or t
  misc_feature (325)..(325): n is a, c, g, or t
gtattcaggtacggggctggggttcattgataaatactggcctgggctggacaattacatcggtgcccatggatctccatgctcaatcccttcagttggtacagtgacatagtgtatgtgatctgggtnagggatgggggacagataatagaacgagcaaagtaacctatacaggccagcatggaacancatctcccctgnncntnctcctggcttgtgacgctataagacagagcaggccacatgtccatcntgnnccccattcttgaaagctgcngggcctccttgcaggcttctggntctctggtcagagtgaactcttgcntcctgtattcaggcagctcagagcagaaagtaaggggcagagatccatacgtgtggccaggaagtagccaggtgaagagagactcggtgcgggcagggagaatgcctgggggtccctcacctggctaagggagataccgaagcctactgtggtactgaagacttctgggtactttccttctgctaacccagggagggttcctaagaaggaaggtgactttctctctgtatgttcttaagttgcactgggagatttctggacttgaaggcccactctctccagccagccactgccttctatgtaataataaagtgccttgagcttaggaatggggacagggggacagggtcagactagcgaatggagccgaaaatcaatcagcccaggatatagtagaataaaacttaataagaaatcaacaaatacacagggatcaacataatgttaattatttgattaacacaacaaaca

SEQ ID NO: 675541 - DNA, 155 bp, Homo sapiens
taaacagagtcacccaggcgggatggcagtggcacaaccatggctcacggcagccaagcctgggcaacagagtgagactctgtctcaaaaaaaaaaaggagagagacggggggcgggggctcaggccttttaccccagcacttggggagggggga

SEQ ID NO: 675542 - DNA, 929 bp, Homo sapiens
gccgtgtgcagctgttggtgggccctgtgtgggaccctgtgtggccctgaggatggtggaacctgcggtggcttccagcgagagggttatcggagcagtggacatcctgtgaggccgggggtcgcaggcctgtggaactggtgtgcctggggcccagaggcgcggcgagacgcctcggagtagagcgcaaggaccagaggataacggagtgaattgcccggacacccaaatgtttggcgaccgactatgatacagagggcacattgacagaatcaatgctccccttgggaggagacgcatcctaagtactcatatcttaccctttgccatattacagagggaacatcaagaagaattcagtaaggaatttactttaccttgagggggagccctttcattccttccaaaagggactatgaagaggatcctgagaacaagacacttatatattggcccaagtgatggccacaagaaacagtgaaaagcaacacaccgattgcccgagcgcccaatggcagtgcacaccagaacgggttatccacaaggggagcacattatgatgtatgagggacatacatacaggaggaagcacataaacaaatagtgggcgaaccacaaccagaatatggggagtatcagtaggggagaggttggattaacacgaggagatgggacgatcaccacgaacacgggggtaaaatgtgtttatgagtccaccaactcgcagtgcgagcaagattcacatagtagtgagtagtggagccgcagcaattcccaaagttcctcgtgtgggagccacaccagaggacgatattcagataccgcacaaagttacggtaatcccccccacaccaggtatgtgaagcggccaacggcaaggtggtcaccacaacagattggggtggtgacgaaaacaccaaacagaggaa

SEQ ID NO: 675543 - DNA, 857 bp, Homo sapiens
ggaaaaaataagtcaaattatctttcttgctgacaataagattctatacctagaaaatcctaaagattctccccaaagactcctagatctgataaacaacctcagcagtctcaggatacaaaatcaatgtacacatatcagtagcatttccatacccaatgacattcagctcagaagcaaattaaaaatgcaatatcatttatggtagccacacacacaaaaaataaaatatccggcaatatatctaaccaaggaggttaaagatctgtacaaggagaactgaaaacactactgaaagaaatcgcagatgacacaaacaaacggaaaaacattctatgcttatggatggaggaatcagtatcgtggaatgtttatactgcccaaacacatctacaaattcgatgctattcctatcaaatgtgtgagtcactgttcacagaattagaaataactgttccaaaattcatatggaaccaaaaaagagcccaaataatcaagacaattctaagcaaaaagaataaagctggaggaatcacattacttgattcaagctatactacaaggatgcagtaaccttaaaagatggtactggtacaaaatggcacatagaccatggattgatagagaaccagaataaaggtgcactacaaatactatatttgcaagtcacataacatggggaggaatctatcataagggtgttaacgaaatgaaggggcggctttcctttaaaaaaaaaaaaaaaaatttgggggcgggcgcggaaataaaattggggggcagagagaagaaaggtcggaagggaaaggggcacaaacggggtgaaagaggttgtaatctacacaggtgggggggga

SEQ ID NO: 675544 - DNA, 361 bp, Homo sapiens
  misc_feature (115)..(115): n is a, c, g, or t
ttttggaagaaagtgtgggtgaaagtacattccagaaatagtaaagctcccctgtgtttaaccgtgttggtctctgtgttcctgaaaaacaggaacagcatcttttaagctgttntaaggtgtctcgttagagccaaagtggaatcggaaggcagccagagctgaggctgccccaagatcagacttgtaagaattacgccgccgacttcaaacccagagagcatctttttttaggcgaaaacgcatatatttattttttgtaagttaaccattctttcacattagataataagttttgggggatccttttgtaatgacgtcctggaaatggaacatttgcagtaaaaaaatatatataatt

SEQ ID NO: 675545 - DNA, 222 bp, Homo sapiens
agcggaggggccccgcgcggtgcgcgctcacgcacgcgcacggcctcgcctgcgcgctcacgaggcctctcgcggcacgcgcgggcgaggagcatggagagaaagaggagaggaaagccaggacgagcaccagaagaaaaacacaagcgacgaggacgagcacagcatattaacaaacagcaaaagaaaaacacaagcgcaagcgagagaagagcaacacag

SEQ ID NO: 675546 - DNA, 145 bp, Homo sapiens
ttttttcccaaaaaaaaattttttaaaacccttttaaaaaaaccccaagcccccccccataaaagtccccccttgccaaaaaaaggaatttcctcccttttttccccccccccccatttaaaaaacctattttaatgtttgtgta

SEQ ID NO: 675547 - DNA, 185 bp, Homo sapiens
agggtgatgctgtcaagctatccgtaagcaatgaacatcatcccatcattttgagtaatatcgttcctatgtagatatggaggcgttacactctatcatttctcctttggtttagtaaactcctggagcagttgtggagctgaaagtgaggtctgtatctcagtcatcctgtagcattagggtga

SEQ ID NO: 675548 - DNA, 111 bp, Homo sapiens
tgctcgaattcaagcttctaacgatgtacggggacatgttggagatctctattgtaatctctattggagattacaatgattaaatcaataaataactgaaacttgaaaaaa

SEQ ID NO: 675549 - DNA, 386 bp, Homo sapiens
caaagaaagtttttattacaaaaacctttactacaaatcaatgttttattaagactaaagtcaggaccttgccaacttactgaatcataagaaaacacatgaggaaagtcaacatggtctttaggctgacttgaattattccttgactaaaaattctagggttatgtggacttttctgttaacatcctgacttagttcctttctttagcagcaaaaaaaacagcagaaattaaaattttggcagggttgttttccaaataaaggggaccaatttgaaatttggatttgaagggcaaaagcagcaagttaccacaatgaggggttttaccctcaagaaaaaaaagttggtttccgaagttttttttattttaaaaaaattttaaaat

SEQ ID NO: 675550 - DNA, 933 bp, Homo sapiens
ctaaagtacgagtaaaccttatctcataaacccaagtttatgtgtcagcctggtgtgtgcgtacctggattaatctgatgtctaggtgccttgtaagcattctaagagatgacctcaggctgggtgtggtgcgcttacagctgtaggtcccagacacttattaggaggccgaggtgtggcaagatacacgctagagttcaagaccagcctggacaacatggggaaactccatctgtactaagaaactaacaagtagaatagttgggcatggtgatgcatgcctgtaatcccagcttcacgggaagtctgaggcaggagaatgtgcttgaacctgggaggtcggagatggcagtcagcctagatcacattcattgcacttgcacgcccagtactgggtgacaaagctccgtctcatgaaagaaagataaaaaagaaaaaaccgagaggggccaaaataggggggggggcgaaacagggatgatgaaacgtgcaagccattggtgaaacacgagaagtgacgacgcaggcccccagctctgtgatggggcccagcagtggcgaacaagcggagggcacaacacaatatgagggggggcgtcaaacaaaggttcgggaaatggccgggggagaaccgcgggcgtaaaaaaaagagaccccggggcaaaagggagacacactgacggggtacggacatacgacgaaagatgacgcacaagatgaagggtggcaattaagacacaacaggataccttggaagacggggctcgtgagcacctagcacagggacagccacgactcaagaaagggaatagtaagggaaagagtgcagcatacataactatcggccttgaagacacgaagcaccaggaggatcagacacgagaataagagtgagcaccaggtaccgatctgaacaccgttgagcccacatag

SEQ ID NO: 675551 - DNA, 398 bp, Homo sapiens
  misc_feature (100)..(100): n is a, c, g, or t
gctttagaatttcttgaacctaggaggtggaggttgcagttagccaagatagcaccgctgcagtccagcctgggggacaagagcaaaactccgtcttaanaaaaaagaaacccagacatataatcaaaggtgtgtcattgtttaattgacaattttttctctcttccttagtaaagcataaaataatactgagttttacatttgatggcatctcgtattcaagaaatacagtagctctccaagtttataccccccaaaaaacaaaacaaaacaaaaaacatttgctgagtctccccactccctgaatggagatttctactttacctctttcctaatgtcccaggaaaagccccagatgagttgtgactggctcctttccctaggctcagcaagctgca

SEQ ID NO: 675552 - DNA, 515 bp, Homo sapiens
  misc_feature (217)..(217): n is a, c, g, or t
acatcttgcagcaggtagcagctcgagtggaaaaggcaagacttgctgcctggagtggggatgaagaaacatttaggggcaggaaggcatcaggtttgagacacagtgactggaggatggtggtggtaaggcggtccacccacctaacaggaagtgagagatgtgcagctacaaaattgtttgatttatttcaatacaaacatttttcagacttaanaaaaaagaaacccagacatataatcaaaggtgtgtcattgtttaattgacaattttttctctcttccttagtaaagcataaaataatactgagttttacatttgatggcatctcgtattcaagaaatacagtagctctccaagtttataccccccaaaaaacaaaacaaaacaaaaaacatttgctgagtctccccactccctgaatggagatttctactttacctctttcctaatgtcccaggaaaagccccagatgagttgtgactggctcctttccctaggctcagcaagctgca

SEQ ID NO: 675553 - DNA, 194 bp, Homo sapiens
cgaaaacgcgtcgtaagctgagtggagatgcacagaaataatctggtagacttgtttaagagctagtcccgaaatgcaacgtcaaatctacagaatcccaggtgaagctcagtaatctgtatttttatccgttctccccaaagtaattctgagtgtgcagctcggggtaccgaggctcgaagttcgataagtca

SEQ ID NO: 675554 - DNA, 203 bp, Homo sapiens
gggggggggggttctccccccccttttttttctttgggccgggggggggggaccttttttttccccgggacccggtttcccccttccccctttccaaaaaatttttttggtgcccctttaaagggggcccccccggggggggggggggtttttttggggggccccccgggggggttttttttttaaaccccttcccccggtta

SEQ ID NO: 675555 - DNA, 196 bp, Homo sapiens
gggtggagcgggaataggttagcaactgagcaaccgtcagtatagccggaacagaactgcagggaggaagcggctcagagatagagagccagaagatgggcaggggagcagcaacgagaggagcgacagcgggcaggcagcacgcgccggacgagggcgtgcaagaggaagacgacaaggaagagggacggaaaaa

SEQ ID NO: 675556 - DNA, 132 bp, Homo sapiens
ggagcctgggatactactgtctctgtccagtagagaggagcttctgggtcctgtatgccccttccgactcttacttgaatgcaccatctacaaacgtgtctatctctacccctaggcttcttagctcttcag

SEQ ID NO: 675557 - DNA, 585 bp, Homo sapiens
agcgggtgcggcgaggcggaatggcggcggtgcggactcgttctcaggcggcccgcggggtgcggttccgaggtcgccgcactcaaggtgctggcggagcactgcgggcgacgcggagggcggccgggcgcgtggggtgtcacgggcggggcgggccggggcctcgtgtgacctgtgggccgtgtgatgcggggccagggtagtgatggcggacccggggcgaggctcggttgagggacccgagcggggacttctcggtccgcggcctgagcgggtgccgcgcgggcggccctgtctagttcccaggaaagtatgtgatcggtggctgggcagtggttccaggccttgccaggccctgaagccctgccctgcaggctgtgcaaacatgaccagaccttttctggaataatcccgatccattgacagttatgtgggacactgcgggggtacagcaagatttacacagggacatatttccttaagaggtattgttggcactgttgttcgcaaaaccaacgcaaaattcgcgaaactatttagcaaggttcatcaatgacttgttggaattccatggacacttttcaa

SEQ ID NO: 675558 - DNA, 110 bp, Homo sapiens
  misc_feature (14)..(14): n is a, c, g, or t
tatctagagcctantccttacctcggacctgagtaatgaccttaacctcgtgacctatacctacggagcctttacctcttgagccttaacctacggagccttaacctacg

SEQ ID NO: 675559 - DNA, 631 bp, Homo sapiens
cggaaggaagtttgggaagttgcttcatataaaatgggttatgtttaggagccgtgggaagtccggctaagagcatagattggagctgctgagattgaacgctcctgaagtccagttaaactttgctcctaggtggcaccagcctagttactactgctcacgttcataggtcgccgttggggccagtctgggaccacgggtctgtctaaaatctctcttcagcgcagcaggttgtggttcactagacaggggtccgaactggtaaagctttcacaagtacagaggcgttgatatgtagtgggccagaatcgatgtgtcatcaatgttgactgctgacgcaccgtcttgccagcatatctgaatgagatccttcacagagctgctttagatgtgcgcgtccgctatagttactagacaatgcgttctaagagtgtgctacgttgtttagaggggccaaatggcctatatccgtgtctcggtaatagaaccgtagttccattatgatacagttcggtgctgacgttcatgagcacttcttccgcttgtctcatatcccaggtcttcgggaccgcgctgcttgtacctgtgatgtctggagcctgtaaacgatattgttcgagcacgattgacc

SEQ ID NO: 675560 - DNA, 502 bp, Homo sapiens
gagcgatcccccatcgggtcaccaacagggactagagtggcatgtctcataaagcatactgcatcaaggtccaagagacctggtacgcacagtcacacgcctgctggtcatccgctgggtgacccttggcgtgtcacctttctctgtctctacttcccatctgctaaatgcacgtgacagtctctgccctgttctctcacccaattaaagtcttaatgatgatggcaggcacgagagatgaaactgacgggccacaccagttcgatgtcttgtgtgtatactggttctctttccctccacagcctgaccatactgttccaacctgttgctctggtggttttacattccccgggcggcactacgaaggcttcctctccactcccaactttgacatgcatccagctgggtcttgactgggatgaccgttccgttttaaaggtcctcttggttaaagggtcccaagttttagttgatcttttttagacaccaggtttcatcgtgg

SEQ ID NO: 675561 - DNA, 584 bp, Homo sapiens
  misc_feature (11)..(11): n is a, c, g, or t
  misc_feature (140)..(140): n is a, c, g, or t
  misc_feature (143)..(143): n is a, c, g, or t
  misc_feature (149)..(149): n is a, c, g, or t
  misc_feature (154)..(154): n is a, c, g, or t
  misc_feature (161)..(161): n is a, c, g, or t
  misc_feature (175)..(175): n is a, c, g, or t
  misc_feature (178)..(178): n is a, c, g, or t
  misc_feature (189)..(189): n is a, c, g, or t
  misc_feature (193)..(193): n is a, c, g, or t
  misc_feature (198)..(198): n is a, c, g, or t
  misc_feature (200)..(200): n is a, c, g, or t
  misc_feature (213)..(213): n is a, c, g, or t
  misc_feature (223)..(225): n is a, c, g, or t
  misc_feature (232)..(232): n is a, c, g, or t
  misc_feature (239)..(240): n is a, c, g, or t
  misc_feature (267)..(267): n is a, c, g, or t
  misc_feature (278)..(278): n is a, c, g, or t
  misc_feature (281)..(281): n is a, c, g, or t
  misc_feature (283)..(283): n is a, c, g, or t
  misc_feature (309)..(309): n is a, c, g, or t
tgaatgggtcntgctaagaagacaagtgttgggattacaggtgtgggcacgcacccagccaaatgacactgattttttaaattaatttacagatcagtacaagccatgattttttttttttttggtaggagtcaccttgntantttttnctcanggttccntttttttgtctttncanttgtttcttantccnttgtntnccctgtaaccaanaattgtgggnnnctcgatnaccctannttaaaccatttctgcaaaattgcttcntaggggatgtngtngngcttcatcctgcagcacagaaggcancccccggttgccgctgttccatactagttatgtggggccgtttttgatcaccgggtttagggttgttgtttcccagctttcctccattttctggtggtttcctaaacatttcctctttggtcctttgggacttattttcttagatcgcttaaagacccccggcctcccttttgggagccccagcccagttgaatatagggctaaagggggaagaccccttggaccctgtaaggtgtcctctgtccagctaagtaatggtggtgggctgagatttc

SEQ ID NO: 675562 - DNA, 887 bp, Homo sapiens
  misc_feature (268)..(268): n is a, c, g, or t
  misc_feature (282)..(282): n is a, c, g, or t
  misc_feature (285)..(285): n is a, c, g, or t
  misc_feature (289)..(290): n is a, c, g, or t
  misc_feature (296)..(296): n is a, c, g, or t
  misc_feature (300)..(301): n is a, c, g, or t
  misc_feature (306)..(306): n is a, c, g, or t
  misc_feature (312)..(312): n is a, c, g, or t
  misc_feature (320)..(321): n is a, c, g, or t
  misc_feature (323)..(323): n is a, c, g, or t
  misc_feature (340)..(340): n is a, c, g, or t
  misc_feature (345)..(345): n is a, c, g, or t
  misc_feature (348)..(348): n is a, c, g, or t
  misc_feature (505)..(505): n is a, c, g, or t
  misc_feature (511)..(511): n is a, c, g, or t
ccgtgaacgcagcctgctgagtgatcatctccgattttcagacccctctcctccgtttttctctcccctgggaggccagttaaggtttgagtgaaggcccccgggactggggcggcgtggatcttacgcccaccaactagtgagggaggccatccggccacccgtctcttccttccccagctccgcaaaggaggcgttggcatttcaggtgtttgcttacagagttttcaaagatttttcaccctcccttagttgtgggaaaatgatncaacctacccaagngancttnncattangtcnnaattntaacgntgaggaanngnaagcctttgaatatgtntatgnctnaaacgtgtttgtttttgcaggagggagagtgctcattttacctgaataaatcaagattgagttggtgtggcacagtgctggcataggcctggggaaaggggtgaaatgctagagatctggtagatggatagaaagtggacagacgggttcgggtggnttttgnctcagcagggccctaaattcccaccaaatcctcctctgtctgtcttcaccaaggtctgaatctgtccccttggtaaataacgtttaaatggtctccgagcccctcttggtgcctgtaccttaaggagagaagaagagggctgatagctgaaggcagcaagccacgaacttagctttgttttgaaaattcacctctgggctgggattatatgcatgagatactgtgcctgaccatgtaataatacattttatgcctgaaagcctttggtttatcatatttctctgcaacaaaaatacatacaaaattaaaacttttttaaaattgtgttatcatgagtattaaatgtttcttttggattgagttgtcacaattataa

SEQ ID NO: 675563 - DNA, 740 bp, Homo sapiens
  misc_feature (121)..(121): n is a, c, g, or t
  misc_feature (135)..(135): n is a, c, g, or t
  misc_feature (138)..(138): n is a, c, g, or t
  misc_feature (142)..(143): n is a, c, g, or t
  misc_feature (149)..(149): n is a, c, g, or t
  misc_feature (153)..(154): n is a, c, g, or t
  misc_feature (159)..(159): n is a, c, g, or t
  misc_feature (165)..(165): n is a, c, g, or t
  misc_feature (173)..(174): n is a, c, g, or t
  misc_feature (176)..(176): n is a, c, g, or t
  misc_feature (193)..(193): n is a, c, g, or t
  misc_feature (198)..(198): n is a, c, g, or t
  misc_feature (201)..(201): n is a, c, g, or t
  misc_feature (358)..(358): n is a, c, g, or t
  misc_feature (364)..(364): n is a, c, g, or t
agcttggattccttgagggcggattttaaagaatccccccagaggcaccagggaggccaaggggccactgacgccagagccacagagtggggactctccctataggatggactaaatgatncaacctacccaagngancttnncattangtcnnaattntaacgntgaggaanngnaagcctttgaatatgtntatgnctnaaacgtgtttgtttttgcaggagggagagtgctcattttacctgaataaatcaagattgagttggtgtggcacagtgctggcataggcctggggaaaggggtgaaatgctagagatctggtagatggatagaaagtggacagacgggttcgggtggnttttgnctcagcagggccctaaattcccaccaaatcctcctctgtctgtcttcaccaaggtctgaatctgtccccttggtaaataacgtttaaatggtctccgagcccctcttggtgcctgtaccttaaggagagaagaagagggctgatagctgaaggcagcaagccacgaacttagctttgttttgaaaattcacctctgggctgggattatatgcatgagatactgtgcctgaccatgtaataatacattttatgcctgaaagcctttggtttatcatatttctctgcaacaaaaatacatacaaaattaaaacttttttaaaattgtgttatcatgagtattaaatgtttcttttggattgagttgtcacaattataa

SEQ ID NO: 675564 - DNA, 372 bp, Homo sapiens
  misc_feature (57)..(57): n is a, c, g, or t
  misc_feature (204)..(204): n is a, c, g, or t
ccgcggtaatgtcttacggtccccaagtctttttgttttgttttgtctttttcccanactcaaactggagccgaagacaaaacaaaaaataaacccaccatcaccaacaaaacacatgctcattggcatgatctgaggcattgttgataaataaagcagagcaatactggggaccgtccgtaagacataaccgcggccgcggtnatgtcttacgctgccttcttacaacattcagatgctgtcaccagtagtatcagctggggcttgaccagaaaagcatgagcagaatgagtgatgtggaaaaaaggatttctcatcaggatgaaccctgacacccgtaagacataaccgcggggggatactctaagaaca

SEQ ID NO: 675565 - DNA, 388 bp, Homo sapiens
tgcagatccttttcttgccacgactcgtcttgcagggaacgtctgtgtggactccgtgggggcacaaatggccccagcaggcacagacagaagagtgatgtgtcccttgtctctgcctattgcaccgtattccataaaaaataaacacttttttttggactgttttgtatattgctaatgcggtggcactctgggcactggcaggctgcagagagccgcgttgccattcatccaccagaatccatccagagacagccttgagggctgggatcttttggagctttcctttggaaggactacgcagtgcccgtctgtctggtgctctacacagtgctgtgaacatgaaattacacggctaaaaaccaaatacatccatgggtaggaaata

SEQ ID NO: 675566 - DNA, 333 bp, Homo sapiens
catagctgatgtaaaaccttatgttaactttgttttcctaaaggcgtaaatatgatgtttaaaatgaagtattacgtttgtacaaatatgctcaatgtatgcatataaatgtgcctttacaccatctatatagcccaataaagatgctattgtctaataacaagccattactaaaaaccttgtgggggggccagaaacccaattccaattatagagagttgtattacaactaactggccgacccaatacatctttaagactaggaaaaccatgcagtgcctaacttaatcttttgcacgctcatcctatttcgtcagctggcgtattattgta

SEQ ID NO: 675567 - DNA, 346 bp, Homo sapiens
attatataatagcgcttcccctccaacagaagaacatgtaccgattaatgattcattaaggcagtcactcctccagttccataggtaaaccgtctgttttctgtcttggaggatttgccttattacgaacatttcatattaaatggaatctgtatctattgtgtgccgttggtgcctggcgctttttcagtcactagctttatcctgtgtgtaaatctgtggcataggctgtatcagaccttcattccttgttatggctgagttctgttctattgtatggatataccacattttaatggtatggatataccacatgaatctatctgttgatggaagcgtcgcgcat

SEQ ID NO: 675568 - DNA, 120 bp, Homo sapiens
aaaatcagttctgccctgtgaaaagatccagccttccctgccgtcaaggtggcgtctacttcgggatttctgctgtggttgtggccttggtaaaggctcccctaagaccaaaggaaggct

SEQ ID NO: 675569 - DNA, 809 bp, Homo sapiens
  misc_feature (34)..(34): n is a, c, g, or t
  misc_feature (142)..(142): n is a, c, g, or t
  misc_feature (151)..(151): n is a, c, g, or t
  misc_feature (189)..(189): n is a, c, g, or t
  misc_feature (224)..(224): n is a, c, g, or t
  misc_feature (246)..(246): n is a, c, g, or t
  misc_feature (293)..(293): n is a, c, g, or t
  misc_feature (313)..(313): n is a, c, g, or t
  misc_feature (330)..(333): n is a, c, g, or t
  misc_feature (373)..(373): n is a, c, g, or t
  misc_feature (379)..(379): n is a, c, g, or t
  misc_feature (389)..(390): n is a, c, g, or t
  misc_feature (423)..(423): n is a, c, g, or t
  misc_feature (466)..(466): n is a, c, g, or t
  misc_feature (468)..(471): n is a, c, g, or t
  misc_feature (481)..(481): n is a, c, g, or t
  misc_feature (485)..(485): n is a, c, g, or t
  misc_feature (488)..(488): n is a, c, g, or t
  misc_feature (491)..(491): n is a, c, g, or t
  misc_feature (501)..(501): n is a, c, g, or t
  misc_feature (503)..(503): n is a, c, g, or t
  misc_feature (507)..(507): n is a, c, g, or t
  misc_feature (521)..(521): n is a, c, g, or t
  misc_feature (634)..(634): n is a, c, g, or t
  misc_feature (804)..(804): n is a, c, g, or t
tttaatatatgttctccatggggtatctctcagntcttctggctcctaggtactcctctttataacacactaagagagaatcatccaactctctctagccaaaagctttccctcatcttcttgaagctcttctgaccctttnggtactaanactctaatgcatagagttgggttggttggactgccctntctcagagtagatgaggtggaacttcatgaggtgnacttccctcaatgtcgttcttntcttcttttcagattggctctaccagtgcacctggacagggaggaancctggctcagcgggagtttnacaggcgactctccccnnnntttctggactgggcaccctttggggtcatgaccccccccnccatcngcatcccccnnctattgtggtactccagcaagaggaaatatganactcccaaaacgaagaagaacaaattggggcttccacagcccncnnnncccaagaaanccangcnccnctcgtaagananccangtgctttccagacnccaaagggtatcttaaatgcaatctcttctctcttagcccttggcactttctcctggatcctgccctgctctcagccatagtgaaggaccagccctaggagtctgcgagagcntccttggttccatcgtgaagccataaacaggaatgcctttgcaatagccttgagcctagagggccctctgatgcccactgaggtgctgttggtttattctggcacgtgaattctctcaggggtctaggaggggcattttggagactgcctgacaccacccctatcccctnccccc

SEQ ID NO: 675570 - DNA, 339 bp, Homo sapiens
actcttccagagagcctctggtacatagccactgtagcaattacaacggtaactaccacgtaagttaacacaaatcccattgacacatatatcagagataccaaagcacatacatagctatctcttccatccacaagtgataactactccactactacaaaggccgtggaatacagctgaataaaaagcagggaatggctggccagggtcctccaaaaccatagtctggatatgaacagaaacatacggacttggacactgcaccggggaaaggccgcaacaaccactccttacttgatacctccatagcaagtactgcagcatgtgcatatcaacaac

SEQ ID NO: 675571 - DNA, 733 bp, Homo sapiens
  misc_feature (34)..(34): n is a, c, g, or t
  misc_feature (142)..(142): n is a, c, g, or t
  misc_feature (151)..(151): n is a, c, g, or t
  misc_feature (189)..(189): n is a, c, g, or t
  misc_feature (224)..(224): n is a, c, g, or t
  misc_feature (246)..(246): n is a, c, g, or t
  misc_feature (293)..(293): n is a, c, g, or t
  misc_feature (313)..(313): n is a, c, g, or t
  misc_feature (330)..(333): n is a, c, g, or t
  misc_feature (373)..(373): n is a, c, g, or t
  misc_feature (379)..(379): n is a, c, g, or t
  misc_feature (389)..(390): n is a, c, g, or t
  misc_feature (423)..(423): n is a, c, g, or t
  misc_feature (466)..(466): n is a, c, g, or t
  misc_feature (468)..(471): n is a, c, g, or t
  misc_feature (481)..(481): n is a, c, g, or t
  misc_feature (485)..(485): n is a, c, g, or t
  misc_feature (488)..(488): n is a, c, g, or t
  misc_feature (491)..(491): n is a, c, g, or t
  misc_feature (501)..(501): n is a, c, g, or t
  misc_feature (503)..(503): n is a, c, g, or t
  misc_feature (507)..(507): n is a, c, g, or t
  misc_feature (521)..(521): n is a, c, g, or t
  misc_feature (728)..(728): n is a, c, g, or t
tttaatatatgttctccatggggtatctctcagntcttctggctcctaggtactcctctttataacacactaagagagaatcatccaactctctctagccaaaagctttccctcatcttcttgaagctcttctgaccctttnggtactaanactctaatgcatagagttgggttggttggactgccctntctcagagtagatgaggtggaacttcatgaggtgnacttccctcaatgtcgttcttntcttcttttcagattggctctaccagtgcacctggacagggaggaancctggctcagcgggagtttnacaggcgactctccccnnnntttctggactgggcaccctttggggtcatgaccccccccnccatcngcatcccccnnctattgtggtactccagcaagaggaaatatganactcccaaaacgaagaagaacaaattggggcttccacagcccncnnnncccaagaaanccangcnccnctcgtaagananccangtgctttccagacnccaaagggtatcttaaatgcaatctcttctctcttagcccttggttccatcgtgaagccataaacaggaatgcctttgcaatagccttgagcctagagggccctctgatgcccactgaggtgctgttggtttattctggcacgtgaattctctcaggggtctaggaggggcattttggagactgcctgacaccacccctatcccctnccccc

SEQ ID NO: 675572 - DNA, 264 bp, Homo sapiens
acgaccgtccgacgtgcattcccgattcctcttggttccaagtccaatatggcactcttaaaggatcagctgatttataatcttctaaaggaggacagaccccgagaataagattacagttgttgggttggtgctgttggcatggctgtgcatcagtatcttaatgaggcttggcagatgacttgctcttgttgatgtcatcgaggcaaatcgaggagagatgatggatctccacatggcagcctttcctagacaacaagatgt

SEQ ID NO: 675573 - DNA, 1070 bp, Homo sapiens
  misc_feature (185)..(185): n is a, c, g, or t
gatgagatccactgtcaagaggaacattggtagttgtgtccgtatggctgctaatggaagcctaatttgccaaatctgacatggagactcgacatggctgccagaaccattgtcaggtgaccgtggcaaattgtgacatagtgaaggttggataagaggctgtgtaaaagaagcatgacggaganctgcagctgcccttagcggcttgtgtggtctgccagtcactgtgagtttaggaaccttttccaatgtctcgaagctgaatggaaccactgagaggactcattagtgcgtggcccgcgagcggaactgatagttgcgaccaactagtgggtacccgcgtagttgttcacgtccgtggaacagcgatgctgcgcaatgcactacgaccccccttggaactgctttcattgggggcgaggacgacgcgcgggggatgcgcgaaactgggagggaagtctgggcacatgtcttggcctgaatccccatgcgcgttgttacatgcgtatctgggagtgggacctgcgttagggcgtgcctaccgaccgttggacccttactgcggaaacaaccggccagtgtacacaaggggcggcgctttcgactggaacgagaaacttgcgagagggcttcattcagggaaaagccctactccccgaaattggaggaagttctggaaccaggcttacaaaaggtgtgccccctcgtaagagaaagcctcttttttgggcaaattcggaggcatgtgctaaaggggcccccctggaatttaggaacctctttgatcgccgaagttccccaaaggtgataagattcacttgaaccacgcgggcccctggggagtataattacacgtcgtctgaggggagaaacgttaaaaatcactctcgcattgttcgggagaaggaagcaagtcgagcatgtcagagagtcggtcctgggccatattgcgtgcctcgtttccagacacgtgttcccttaggggggacggaacccgccctggacacgagaattggcgtcgtagttggaaaggccatatcgagtgaagcaatgcgatgtggaagggtccc

SEQ ID NO: 675574 - DNA, 288 bp, Homo sapiens
  misc_feature (119)..(119): n is a, c, g, or t
  misc_feature (247)..(247): n is a, c, g, or t
caggcatgtgcttgccagccccacacagcccacagcacgttgcttgcgatgaaacagcagaatcctatcttccttctacccggacggcgcgaaccgatgcaccaggctgccagcacggncatcaccatggcgggccattcaagtaacccaatccaatattccatgaaaccttccaactgataatggggtatctgaagctgatcacctgccagcgtcctgagcgctggcaggtgatcgcttgactaanccgctcgcttctcgcccttgagcatctttttctgcatttcc

SEQ ID NO: 675575 - DNA, 666 bp, Homo sapiens
  misc_feature (40)..(40): n is a, c, g, or t
  misc_feature (365)..(365): n is a, c, g, or t
cttccgccatccagggtgggaagatgaaaccgtttaaacnccccagataattgcttagagtcccagcacgcggactcgattttcttttaaaaaaaattctcatggtctagggagtatctagtcccatctgctaccaagctaaagacgttagaatagcaagtttcccttcatttccgacaagctttgctaaagttaaatatttgtagttttcaaatgaaaaatagtggacacaatagcagcaattgatttacaaacagttcaaacttagttccgttgtagaattcaagaacaggtgcaaagcatacatttcagcatttgttcattcaagatgtaaaatgtataaagtcgcatgtgctcacataccncttcttagaaagatgtttatatctttggaagttttacataaatcaaaggaagaaagcacatttaaaatgagaaactaagaccaatttctgtttttaatagaaaaaagaatgattgatgtatcctaagtactgttattggttgtggtgtcttaattcgccgcttggctagagtgaggtgcaacgtgatctgttaagagctgtcatcgtgaggtaacggttagttatatgtcatgttaaatgacaaacccgcactcagagcgtagaataatgtatcgacgagaatcatcagagctctgctcgt

SEQ ID NO: 675576 - DNA, 436 bp, Homo sapiens
gccgttcgggggttcctgggccgtggtgggcgagaccaggtgcccattttgcagatagggagactgaggctccgaccctcagcccgctcgttagggcgtgttatgtcttgggctggggtcttcgcgcccgtcctctcgatctgtcctagcagcagccctcgaagcggttcttttgaggctcttgccttacagaagtggaaactgagtcatggggaattggccatgggaaaaagacagtggcatctcaccttaatgagcatttactatgtgccaagtgcttcacgtgcattttcacactcttcagttcttggtgttaagtgctgttatgagcccgtctgacaagatgaggaatctgaggctcagggagggcatggaacttgccaaggccacacagtctgcacgtggtgagaatgggatttgatggaatttgaacctg

SEQ ID NO: 675577 - DNA, 843 bp, Homo sapiens
gccgagatgataccactgcacttaggctggccaccagagtaggactctgtctcaagaaattaaaaaaaaaaaaatgattgaactgaacagataaagggaaacatcttgagctaaattagcgaggaatatatgtaaaagaacagaggacgtttaaggatgtgagatacgcataattacgaaaatgaccatagtgaactatgaatctggaaagcagaaagggttgaattgctgaagagttcatctgcaaggtgaagatgattaggatatcttgcaaaatgtagtaataaagtgctttgaatagggaatgatttagttaaatttgtcttttaggatcagttggaagagttagattaaatgcaagaagggcaattaaattaaaaagaactgaattagtacatgggaaaggtcagaaaaaggacctagatgtgacagtttactgcatatagataatacttagagccataagatgatcagttggagttcaaagtgattggcttaatcttgagccacatccacatttaagggttgtgaagaagtggagccatctgggaagattgaaaaaaaaaaattagagaaatagggaaagcatcagaatatggtattttcaaagtcaaaggagaaataagcctcttataggttatcattaatacgaatgcctctgtgttgaggagggtggaggactgagtttatcaataatggggccattactttgagagaggagtttcaaaggaatgcagaattagacagctagatcacatgtgattataaaagtaggatgacctgaagattttatcttcaggccctattttatgacaatgagtgtgttgatggtgtaaactgatg

SEQ ID NO: 675578 - DNA, 204 bp, Homo sapiens
atttgggttttaactttaacagggcagttccgcttcacctccctttgatggagttccatccggggggtttcaacccccccgtcagtcctgaggcctcctgaccctgacgttgtgatacgccccccagagatctaagtttcttatattattattattgataataattattataatattattatgtaataaatttataagaaatga

SEQ ID NO: 675579 - DNA, 82 bp, Homo sapiens
aatagtaaattaaaacttttttttaaactaaaggggatccggggttaaccaccaactaatttaattcttgctttttatttta

SEQ ID NO: 675580 - DNA, 647 bp, Homo sapiens
tcagtacccgggacgtcagaatgcgcctgttccccctcctcggcccgagagcagagtccgacttctgcaggttccaggacccgctcaggtccgggctgacccgactcgctgtgcagcttcatggagaacttccaaaaggtggacaagatcggagagggcacgtacggagtcagtgtacaaaagccgagaaacaagttgacgggagaggtgagtggcgcttaagaaaatccgcctggacactgagactgcagggtgtgcccagtactgccatccgcagagatctctctgcttaaggagcttaaacatcctacatatttgtcaagctgctggatgtcattcacacagaaaataaactctacctggtctttgacatttctgcaccaagatctcacgaacattccatgatgcctctgctctcactgcattcctcttcccctcatcaagagctatctgttcccagctaggctccagggcctagctttctgccattctcatcgggtcctccaccgagaccttaaagctcagaatctgcttattaacacagaggggccatcaggctagcagactttggactagacaagcttttggagtcctgttcgtacttacacccatgagtgtaccctgggtaccgagctcctgaatctctg

SEQ ID NO: 675581 - DNA, 107 bp, Homo sapiens
gagtcggacctcagtacatggaggatggtaactccaagataactgacattagcagcccctgccacaggaccccctctgcatctcagctctaatctccatcctcctga

SEQ ID NO: 675582 - DNA, 336 bp, Homo sapiens
cgccacagcttctccgggctctggataccatcaatagccgagatactggctactgatgtgtctgtggacggatgaggaagggactgcaagccccaaggctgatgttcaattatgctacctggaagcacaaagagatgctgtttagcagatgtccctctaagctgtacagcgagccagtataccagcagcagcaagcgaaaggaagagtttgctgatatgtcaaatgttcattcacgtgggaagcaatgggcttctggactttgattcagaatatcaggagtctctgggacttggtctgattgatcattgatgtcccttgctgaatggacaggcccc

SEQ ID NO: 675583 - DNA, 423 bp, Homo sapiens
  misc_feature (22)..(22): n is a, c, g, or t
  misc_feature (217)..(217): n is a, c, g, or t
gtttcccaggctggagtacagnggcatgatcatagctcactgcagcctcataatcttgggttcaattgatattcctgcctcagcctcctgaaggccaggactacaggcacacgccactatgctcagctaatttttgtatttttttaatagacagggtctctcactatgtttttcaagctggtcttgacctcctggactcaagcaatcctcccctttngggggccctctgtctcccaaagtactgggattacaggcatgagccaccatatctgggccatcctgtcactttcaacctatttgagtctctgaatctaaaattagtctcttatagagagcatatagttggattatgttttcaatccaatctgccagtatcagccctttgattggagagtttaatccatttttaattaacttttctgg

SEQ ID NO: 675584 - DNA, 333 bp, Homo sapiens
cggatctcacgaaacacagaccggatcatcgtcagactactacgtatgaattctagaaggaagaagctaggaaagccgggctatagaaataggatagtccatggcctgctgagcctcgtgtatcatctcaaggaagggctggaacatggcgtggaagttcaggggctcgtacggagagcagggcatcaagctgcggacgatgcgggacttgggaaagaagaagtgaggcctccggtggggcaggctgaagggcaggtagtggtaggtatcctggggctcccgggtgaagaacctgtcctggaagagctcgtctatgatgctggacgcgcggct

SEQ ID NO: 675585 - DNA, 655 bp, Homo sapiens
gtccctcccgcggcgggggggttcttataaatagaccgggggcttcttattttttgtagcctcgtctcctcggtttccctcgggtgtaggcacccctctccaccgcgctcggtgttgggaccccccactcaggggagaacacagccgcgtggggcgcatatctccaactctcccgcgggctgttttatcctctgttgcctccgcggtgccgcggtgtatccactttttttccaccacgcgcgaagcccgcgctatttcgtgccccacttggcccctcttttggtgtgcccactatttggaacgcagagtggtgttcccaacaaacgcgaggctgtgcgtgacgcgctgccgcggaattttgctcgcggatatatattttggacacgccgcggctccctcgccggaagagcgtgggtggggccgccgcaacatctttttggtggacaccccgcgaggcttcccccggagtttccactcgcccatgttattgggtgccaccatgttcctctactcatatctggcttttttccccccccctaatttttctcctttcaacccccaaaaccccttgggtttaaaccccccccctaatttggccttttttaaaatgggttttattttttttttattttccctttttttggggggggtttta

SEQ ID NO: 675586 - DNA, 281 bp, Homo sapiens
tgatatttctctgttgtcgtggaggctgaggaggagaatcgcttgataccgggaggcggaggttgcagagagcctagatcgcgcattggactccaggctgggtaacagagcgagctccatgtaaaaaaaacaacaaccaaaaaacaggattgtgaggcctagagagagttcagtggaagggcctggggttcctactggacagttggaaatctggggagctgagtttcccagaagctgggggaccagctggcaggttttgggtagagcagcaggggaagaca

SEQ ID NO: 675587 - DNA, 430 bp, Homo sapiens
tatcagtatcacaaaggacaacaaaagttgtaggaactgttctagtttaaaggaaacagaagagatatgacagctgaatgtaatgtgcaatggatgattaaaaatacagctataaaggatattactgggataattgggaagttttgcatacggagtatattagatagtatttttgtaataatttaaattttgctgagagcaatcttgtagtgtggttgtgtagagcaatatatatcacactgaatttatgtgctgtggaagtatttagggatgaaatctaatgatgagtacaactaaatctcaaatggttcagaaatatgtgtgtgtgctcgtatgtattttacataaaacaaatatgtcacaatgttaactggtgaatctaaatgaagggtatatggttgttcattatactattctagcaataaaaaaa

SEQ ID NO: 675588 - DNA, 380 bp, Homo sapiens
tgaccttcgttctcttcacagctcagcatttttgcaagcaggtagcactatcccccttcacagttgtctgagggaccaggcttacgaggattaagccacatgccgggtccatatagctcctattgaccgggctggccaggagctgtgaaccagagtgtagatgagcctccgtatctttttttatttatctcttcattgcatctcttttcccctcaaattaatcatttcctttgtagatcacctgaagtgtataacaagcctatagccaacaactattttaaatattggcagaaaagacacatgccctcgagaactgccccccgaactctcataacaccaggcctgtgaaagatacctgggggcagtccttgtgggcctta

SEQ ID NO: 675589 - DNA, 89 bp, Homo sapiens
tcacctattaaagcaattttccccagcccaacttcactggcacttcagacaccacctccaacaacacagcaaccgtgatttccacagcg

SEQ ID NO: 675590 - DNA, 936 bp, Homo sapiens
gcactcagtgcccttactgctacgtctcagcaaggaggagactgtgctggcaacagtccagtgctctgcagacagcatcccacctgtcccatgcagtgctgacctgagtgagcatctgttggagtgagatttgcatgtgaccattgttgctctgcctgtgatgaactctgtgggtgctgtgtatctccaagtatatgaagaagtgcacattgtgaacacaaacaagcagttatatcttgttgtgcttgcccaccttaccacatgcatccattgtgcatccattgttgtggtgcacttgatgcccatccccattcaatgtgcagggcatccatgtgtcaatcccgagcattgcattgcacacggctgcatcatatcccaggcgacaggcacagcacactattcgcgatgtcccatcctccctgcaacagcccttatcccagacatgttgggcgcctcatagccaagcattgcaatggttgcatctattctgcccatttacattccctgccataccacgcaaagctgcgttggccccacaggattataggttggagataatagatacgcaccctctgccacgttggtcgccttccgtatggcattactacacctggccaacacaactataccacaatttgccaacacccacgttgccgtccaatgccatatatctgggcaccgtcaggtatctcgggtccagacacggtttacacgcacaccagcccagaacaacttgtagagttcatcagaccctatctgtgtcacctcataacgcaagcggacccgttaccctttgggcacacgccttatcgaaacgagtggacacgcaactagctgtatggttctaaaaagagaacagccgttacaaggaggaaagcacccgcactttactgtcccttacaacgacacttacactttaggattctatgtgggcaa

SEQ ID NO: 675591 - DNA, 1061 bp, Homo sapiens
aaaacatccgatcccacttccagcacgttttcgtcatcgtcaggctgcacaatccgtgctctgacagatgtctgttcatagtgtgcgctgtgaccacgtccagagatgtgccttcctttggtgcctcccatttcctaaaggggtacacatatatccctaagtcaaatgtgtccagggactatccttctatgggcgaacagtgattaaatgcacgaaaagtgctgctcagtaaactcggatgaagtttcggggccgatggacaatctcgtgacctcgccaggaatacctgaatagatctggcacgaaaagaatgtcaccaatgaccccatatcgagcccttctgacaagttttgccgttcatctactctggcttccaagaagaaggaacagtctaagccatatcgcaggagccgagctacagcagcactgtggggccattgtactgagcagtccgggactgcaagagctactacaaggccatggaactagactgccttgtagggatctccaatgagtacatagtagctcattagaacaggacacaaagagcgtaggtcttcaactagtacctagtagagcatgtcgatagcggtggcatttcacactgacacaccagacatcagaaatctttgctatgacccgaagcgagcactgctcgtccccagtcgcggctcaccgccaatcacacattcgaagcagatccaaagcagattgctcaaacggttgacagaccggcacccacaaacggctgcgaactcccgtggcccatgacgtcctgcaaacaaatggagcctacgacacgtttagccctcccactggtccacctaatgacggccactttgttcgaagcaaatgttgtagccccccctaacgggtcatcgcccctagcaaacggcaacgaaatgtacagtcgcctagcaccgcaacgacccgatgtgtgaacaaacatttgaaaaccgtgtcaagataaccacaactcgtagtcacccagaccaaactaaataacacaccctgcaaacaatctccgccgcggctaaacagtggctacaaatacccccaca

SEQ ID NO: 675592 - DNA, 594 bp, Homo sapiens
  misc_feature (58)..(58): n is a, c, g, or t
  misc_feature (60)..(60): n is a, c, g, or t
  misc_feature (65)..(65): n is a, c, g, or t
  misc_feature (71)..(71): n is a, c, g, or t
  misc_feature (73)..(73): n is a, c, g, or t
  misc_feature (81)..(82): n is a, c, g, or t
  misc_feature (85)..(85): n is a, c, g, or t
  misc_feature (96)..(97): n is a, c, g, or t
  misc_feature (106)..(106): n is a, c, g, or t
  misc_feature (109)..(109): n is a, c, g, or t
  misc_feature (125)..(125): n is a, c, g, or t
  misc_feature (154)..(154): n is a, c, g, or t
  misc_feature (174)..(174): n is a, c, g, or t
  misc_feature (199)..(199): n is a, c, g, or t
cgttatgtatagctgactcttgaggataaacgaccatcagaggagtctgagtcatgancntaacntctatncngagaaagnnagnatcatcactgnngaaaacatnggntttattttttccaggnctgagcaaataaggtgtataaaaaatggnaggtatctgtttaaatattnaactgattttataatagcaaccttntgctcctaggttacatagtgttaaatattgtgttcatttgtattttccaatccaataagaacttttttttttacctcggcaggaatctgtctgggaggacatcagagggtgaatttccaagttctgggacaacctagctgtggaaaagctttcggggttgggggggtatttcagagtgtccttaaaggtgtagcagacacagataaagacacggggagccaagtgaaacagcagtggagggttggcgggtgtatcacttttcggtattttatcacccccttccggcaacattatttatcgggaatctaccggccctttggtttttaagatacaggggctgggtttggtaacccaggcggttttcagggccatgagatgtgggagggggggatcct

SEQ ID NO: 675593 - DNA, 121 bp, Homo sapiens
gtgcagctgagcaactagcaaagtggatttctgacagaacggatgttcatattcggggttttcagaccacccaactactcttgtaccatttctttggccctcttagtgtcgcttgttggag

SEQ ID NO: 675594 - DNA, 1597 bp, Homo sapiens
  misc_feature (427)..(427): n is a, c, g, or t
gctgcgagatatccctgttcagttactggtctcagcccagcaatggtatggttgtattttcccgggccttctttccaggcttgaaacacagcatcgcgcacgacggagctgaggccctatgttgccctcgtctatctgcaggcgtctactctaccaatgctgtggctgacgtgccttctctgtgacttacctggagagccaaggtgtcagacacagtgtaaattcgtgagacatcgtgaggtgtatgaagctgctatcatctccactacgttgacgtcacccgcacgtgactcttaccactcatggccacatgcctacaagcagactcaaggagtgagtgcttgtgtgcatcgctcatctactgacccgtggggactcgtacacaccctgcgcctatatgagtgtattgttcaccactacatgcganggctggatcacataccttggtaataacccacgcgttgccctttgtagaccgtaccggacgagaacgctcgactttaccacgtgcttgacatgcggtggaacgtactggtccacgagcacagcgcaggtcgtcgactcatcatggacaccttaccgtgtcctcgtgtgggcggccctgttactgcgatgcgcaatacagggggcccaggggccctggggatccccttcgacgggccactcccacggagttcacccttgccccgggagggaccccgtgtcatggcgggggactcgggattcgaggtgttggccggttcttgtactttgcccattcagcagaggtttgccagtcaggaatttgtcatccctgccatcaatgcaagaggaagcgcaaaatcccctggaagcgtgaaaggccctctgcgacgcgtcacgtcaataggttgacaacaacaggacctgggcacaagtgagctggagtacgagtcatttgcacgggctgtgttcccaggtggcatcactgacgagctaccgcggcgaggcaagaatggcccttcaatggatggtcacgaaccaccacggcggggctgccggaggggaccatgtcgtctgttcagcaaaggtgacatacggaggcctcagaggacagctccatcaaacggggctgactgagtgacgcgcgccaatgtttggctgcccgcgtcaacacacgacccgctgtctgcaggacaagataacctgtgggggatcccctaacccgcacacttatgtggcgtggcgagagaatgacgtccccgatgagtacaccccacaggtggccttgccaagggtgacactgtaacgcacaagcccggctccactggggaggactcaacgcatggttaattgggccctgtggcactcatttgtacggaccctacagtttgcggtgaatgtcgcctcaactcgcgggacagaagctcaccctcgcgctcagcaagcgcatctctcgcacttcgtctctcctatcatcgtgatccccacagctagcgtccagtgtcaaagcaagcctgtcatcgttctgatccattcggcccattctggagcttccgatgccatcctgcacaaaacgtcggtctcgtcatgacgaccctcatcctggcccagtgcgatgatgtctccatatatgtac

SEQ ID NO: 675595 - DNA, 419 bp, Homo sapiens
  misc_feature (151)..(151): n is a, c, g, or t
  misc_feature (162)..(162): n is a, c, g, or t
  misc_feature (213)..(213): n is a, c, g, or t
  misc_feature (219)..(219): n is a, c, g, or t
  misc_feature (229)..(229): n is a, c, g, or t
  misc_feature (296)..(296): n is a, c, g, or t
  misc_feature (324)..(324): n is a, c, g, or t
  misc_feature (327)..(327): n is a, c, g, or t
  misc_feature (335)..(335): n is a, c, g, or t
  misc_feature (369)..(369): n is a, c, g, or t
gccacctatcgcgatgtgtgagtgtctacctcatatgcgtggagtgctgagactggggtctgtgctgttccgtacttcaacactcaccccttgtctcccctcagtgctatggcgtgtgcttggtggtgctgagcgctgcttactcctcgtntacagcctggnctcagccgcctcactcctggctgctggcctgtgctgcacgcccgtgccctngtggcnggacagggtncacctgctgctcacttcacctcttttctggcccctgtgcctcggtcctgcacacagctgatcctctntgtgcagctgcctttggggtgtgcagtnccntgaacaanactggactcagcacactcctgggaatcttgtacnaagacaaggagagacaggacttcatcttcaccatctaccactggtggcag

SEQ ID NO: 675596 - DNA, 476 bp, Homo sapiens
taacacgcgcttgaagcagggagatgggttacagggagccaagatactgccaccgaactccagcctggacaaccgagtgagactgtgtctcaaaaacaaacaaacaaactaaaaaaaaagctggaaagaaaaagggaaaaagaacaactgcagactcaattcatccttcatgaattaagacaaaaaatccgggcatggtggcgagtgcctgtaatcccagcaactcgggtggctgaggtacaagaatcactcgaaccccggaggcggaggctgccataagccaaaatggcaccactgaactccagcctgcggtgacagagtgagacccccatctcaaacaaacaaacaaacaaactataatgacttccagcctggttaactttaacaaaattccctagtaaaaaatttggaaagacccgatgacattttgcaactagattttttaattatatcaagaccgagtttcattctcttgc

SEQ ID NO: 675597 - DNA, 707 bp, Homo sapiens
  misc_feature (707)..(707): n is a, c, g, or t
cacggtggctcacgcctataatcccagcactttgggaggccaaggcaggcggatcgcctgaagtcaggagtttgagaccagcctggcaacatggcaaaaccctgtctctgctaaaaatacaaaaattagccaggcgtggtagcgggtgtctgtaattccaactattcgggaggatgaataggagaatcgttgtgagcccgggaggtagaggctgcagtgagctgagatcccactatgtgcactctagcgtgggcaaccaaagaagtgaaaactcccatcttaaagaaaaaaaaaacgaacaaaaacaaacaaaacactgtgtgtgtgggcgcccgccctgggccccttgagagaaaagagttttttttgggacccattgtcgtttgggggggcggcggggggccccacgtgttggggtttcgcgttaaccacgtgtggcccaaagaggggtgttcccacaggagaagacctccgggcgaacaagagcacaatagcgtggctctgggaggttttcctcacccaaatataaaaaaaaaagccgccgcggggggggaacacccgcgaggcggtttccttgaaaccaaattctcgcaggatggggagatcacagggaaggcacaataaccggggacccatctcacaaaacacggggggcccaaaggcaggaccaccagaaattaaaaaattgcgccgcgccgtgggggggn

SEQ ID NO: 675598 - DNA, 332 bp, Homo sapiens
  misc_feature (11)..(11): n is a, c, g, or t
  misc_feature (61)..(61): n is a, c, g, or t
  misc_feature (72)..(72): n is a, c, g, or t
  misc_feature (74)..(74): n is a, c, g, or t
  misc_feature (82)..(82): n is a, c, g, or t
  misc_feature (87)..(87): n is a, c, g, or t
  misc_feature (123)..(123): n is a, c, g, or t
  misc_feature (191)..(191): n is a, c, g, or t
  misc_feature (208)..(208): n is a, c, g, or t
  misc_feature (211)..(211): n is a, c, g, or t
  misc_feature (215)..(215): n is a, c, g, or t
  misc_feature (233)..(233): n is a, c, g, or t
  misc_feature (238)..(238): n is a, c, g, or t
  misc_feature (249)..(249): n is a, c, g, or t
  misc_feature (251)..(252): n is a, c, g, or t
  misc_feature (290)..(290): n is a, c, g, or t
ttcagaggttntgccctgcagaggctgaaggtggcatcccataggttttatagagcaggtngagaagctccntntttttatnttttnggaggaaactagatttggccgcattgatgttcagcntttttaaatatttttcagttaagcccatgttccgtttggtcatctggtaatcagtgttcagggtgganttgaagatgagcgggtnatntgtnttgagcgagttgttagcntggtnatttttgagcngnntgattgaatgataagtgtaaggattaaaggcacaagtnaggtagctggacaagggcgaagatatagaagtgattgtttta

SEQ ID NO: 675599 - DNA, 266 bp, Homo sapiens
gtgcccgtgacactagaggaccctcgcgcaggtatcatcgaccatgtgaatcagcatttcaatagcaaaaaaggcacatcaactgcgaagtatccttagttatgcaaatgctttttctagattcatgcttattcaatcattagggtactagacacatcagcctaacgtggcatctggacacttgaactggacttacctgactaatgaatcagtcttgacgtctatccctttgttactactgacctttactacggttactgacttga

SEQ ID NO: 675600 - DNA, 131 bp, Homo sapiens
aggtcacgggatagcgagagcttctctaggtcctatgatatataggcatcccagttgatgaaacccagcttggatttaaaattacttccagaaagtgtcaaagttaaacatccccccacagagagagcagt

SEQ ID NO: 675601 - DNA, 227 bp, Homo sapiens
cacgaggccaatgtaggcttgttgcagagggcactcatgaccttcccatatccccatcctgtggtcacctgggatttgggttccctggggcggtcatgcgaaataagaacccacggaaggacatctgaaccacccacagtttaaatagcgactcttcttgattactcagggatgtgctcatgttggaccctacccatgtcagtggtcttttcactctcaactatcgg

SEQ ID NO: 675602 - DNA, 652 bp, Homo sapiens
  misc_feature (6)..(6): n is a, c, g, or t
  misc_feature (92)..(92): n is a, c, g, or t
  misc_feature (114)..(114): n is a, c, g, or t
  misc_feature (117)..(117): n is a, c, g, or t
  misc_feature (127)..(127): n is a, c, g, or t
  misc_feature (138)..(138): n is a, c, g, or t
  misc_feature (144)..(144): n is a, c, g, or t
  misc_feature (146)..(147): n is a, c, g, or t
  misc_feature (150)..(150): n is a, c, g, or t
  misc_feature (154)..(155): n is a, c, g, or t
  misc_feature (158)..(158): n is a, c, g, or t
  misc_feature (160)..(160): n is a, c, g, or t
  misc_feature (166)..(166): n is a, c, g, or t
  misc_feature (170)..(170): n is a, c, g, or t
  misc_feature (179)..(179): n is a, c, g, or t
  misc_feature (183)..(183): n is a, c, g, or t
  misc_feature (196)..(196): n is a, c, g, or t
  misc_feature (198)..(201): n is a, c, g, or t
  misc_feature (203)..(203): n is a, c, g, or t
  misc_feature (209)..(209): n is a, c, g, or t
  misc_feature (219)..(219): n is a, c, g, or t
  misc_feature (224)..(225): n is a, c, g, or t
  misc_feature (244)..(244): n is a, c, g, or t
  misc_feature (247)..(247): n is a, c, g, or t
  misc_feature (251)..(251): n is a, c, g, or t
  misc_feature (253)..(254): n is a, c, g, or t
  misc_feature (258)..(258): n is a, c, g, or t
  misc_feature (264)..(264): n is a, c, g, or t
  misc_feature (266)..(266): n is a, c, g, or t
  misc_feature (268)..(268): n is a, c, g, or t
  misc_feature (272)..(272): n is a, c, g, or t
  misc_feature (277)..(277): n is a, c, g, or t
  misc_feature (360)..(360): n is a, c, g, or t
  misc_feature (395)..(395): n is a, c, g, or t
  misc_feature (528)..(528): n is a, c, g, or t
  misc_feature (547)..(547): n is a, c, g, or t
  misc_feature (552)..(552): n is a, c, g, or t
  misc_feature (571)..(571): n is a, c, g, or t
  misc_feature (575)..(575): n is a, c, g, or t
  misc_feature (583)..(583): n is a, c, g, or t
  misc_feature (643)..(643): n is a, c, g, or t
tcaatntacacacacacaagcacacacaatagcagaatgaaattacatttttcacatctaaaggtttatacctcaaagaaaataggcatgtntccaaaagacaattagaaagcnagncatccctccntttactttgantatggnannccntttnncancnactctntccnggccaaccnatgncgacttccgcctngnnnncncctgcngccttaaggntttannatataactgtattcaccanatngggngnngggngggggngntngggnttttnatgtaattaaaaatcaacttttggccgggtgcgggggctcacgcctattatcccagcactttgggagtgccgaggcgggtggntcacaaggtcaggagtttcgagaccagcctggccnatatgctgaaaccccatctctactaaaatgtatataaaattagctgggtgtggtgggacgcgcctctcgtcccagtcacttgggaggctgaggcaggagaatcgcttgaacccgggaggcggaggttgcagtnagccgagatcacgccactncactncagcctgggcaacagagtnagantccatctnataaaaacaaacaaacaaacaaacaaaaaaacttttgtttaagtggctgagactattgtnccagactta

SEQ ID NO: 675603 - DNA, 132 bp, Homo sapiens
aagatcactgtgtatccacgccttccaggcatcagatgcttccatgctgccttcttaccaacttacaaggtttttcttgctaatgaagcagggacctgcttaaagcacatggggggaaaacacagaccttaa

SEQ ID NO: 675604 - DNA, 490 bp, Homo sapiens
ttgttataaaaacacttgaatgagatacagatctggtcaaggatcatgtatgttactacttactattctggtacatggacattatacccctggcttggttactataaggatgtacatccactctattggttccctttttaccatcatggacagtagagagaggaaagggtaacagtaggaatttattcaaaatagagaggaactcattagtgagtggcctctccattctctctttggtttaccttcttctcattcgctggttagggattcttggattctttatccttgggcaaggaacaactgtctcttggtgcttatctccatagacacttaccagaactaacctggtggtcctcttggcagatttgtatccttgtactaggggagcgaagaagcactggatagattaccagtatgtcccgtatgccaacaaggggaaagagtgggttggctatgaacatgccatcagcttcagttacaaggcatggta

SEQ ID NO: 675605 - DNA, 552 bp, Homo sapiens
  misc_feature (208)..(208): n is a, c, g, or t
  misc_feature (224)..(224): n is a, c, g, or t
cggggggtgtggccctgccaacacctggattttggacttttaacctccagtacagtgagggaataaacttctgtgttttgttgttttgtttgtattgagacggagtctcgcgtgtgtcgcccacggctggagtagcagtggcgccactctcgcgctcacgtgcatgctcctgcctacccggtgttcactgccattcttcgtgcctcangcctccctgagtagcntggggactacatggcgcccaccaccacgctctggctacatttttgtgtatttttttagtagaagctggggtttcacgtgtgttagccaaggatggtctccatctcctgacctagtgatccgcctgcctcggcctcacaaagtgctgggattacaggtgtgagccaccgtgcccggcccaaatctccctcttttaagaggccaggcactggattcgggtccaccctaacccagcaaggcctcatcttaacttgattgcaccttgcaaagaccctaattccaaagaaggtcatgcccatgggtactgggtattaggacttggacatatat

SEQ ID NO: 675606 - DNA, 275 bp, Homo sapiens
  misc_feature (11)..(11): n is a, c, g, or t
  misc_feature (25)..(25): n is a, c, g, or t
  misc_feature (35)..(35): n is a, c, g, or t
  misc_feature (52)..(52): n is a, c, g, or t
  misc_feature (90)..(90): n is a, c, g, or t
  misc_feature (104)..(104): n is a, c, g, or t
  misc_feature (112)..(112): n is a, c, g, or t
  misc_feature (115)..(115): n is a, c, g, or t
  misc_feature (125)..(125): n is a, c, g, or t
  misc_feature (164)..(164): n is a, c, g, or t
  misc_feature (170)..(171): n is a, c, g, or t
  misc_feature (187)..(187): n is a, c, g, or t
  misc_feature (195)..(195): n is a, c, g, or t
  misc_feature (215)..(215): n is a, c, g, or t
  misc_feature (217)..(217): n is a, c, g, or t
  misc_feature (220)..(220): n is a, c, g, or t
  misc_feature (240)..(241): n is a, c, g, or t
  misc_feature (263)..(263): n is a, c, g, or t
  misc_feature (265)..(265): n is a, c, g, or t
acctggtcaantggttcaaggcccntagagggccnggaagtaaaatgctcancgttcatgttgttggatatgggaagtatgaactggaanaggatggtaccccntctagtgnggnttcaaattcntcttgtgaagtgatgcagctgacctacctgccaacctcncctctnntggcagattgtatcanccccattnctgatatcagggctttcacnanaanactcaaccttctcccctacnntaaaatagtcaaataaataaantncagtcacgtt

SEQ ID NO: 675607 - DNA, 561 bp, Homo sapiens
cctaaagtgctgggattacaggcatgagccactgcacctggccggttattctctctttacagataactatgaacagccttcacagagaatgaacaataggacaaatgggatgcacgtctggagggtggtagctacgtctgtaaagcgagagatactaaggctgcggctagagtatgcagccgtcgtcccatcgtcgtctggtgcgcgcgcttattgcgatactaaagagcgagtccgtatccgccagctagtagaacaggaggaacacaggaggcaagcgacgtatgggatacaagtgttacaagacccgacagtcaaaaattagatagttgtatgtgattgagacctgttccccctggacgactgctttgtacgactgcacataggattaagtcacaaagctgcagaggagattgaggccctttaactcccgtctgcaaaccaataaatgcgctaagcacacaactgtcattggaggcgccagcaaaataggctaacacgggacgagaatgtttcctcagattacacaacgcgccaggtacgatttagaagagtacgcac

SEQ ID NO: 675608 - DNA, 150 bp, Homo sapiens
cgatgtggaccctgaatagataggggggagtagagcagcagcagaaactcattctcaaacatcttctatcttcaggcgctcgatggcccggctctggcctttgttggctttctccttctggatttacactctatgagggcagcagatctt

SEQ ID NO: 675609 - DNA, 1438 bp, Homo sapiens
  misc_feature (1127)..(1127): n is a, c, g, or t
tggctgcgtctcctgcgagaaatgcagacttttctcagcaatcagactgtcgacattccagaaatcttgtcgactttactctgagagggacgcacagtttatcgtgaagggccccaaaaggacaccctcgcggagggactctcaatcactatcaatgtaacaactctcagcctatctttggaccacgaacaacaaaaaggaggcctcacgggttgtgcccaaatgtgcgtgtgggcgtatacacacagacaggggacacgtgcgcctaacgcgatatcgagacactattgtgtgtaaagctcaccattgatccaggcaaacattgaactcaaagcgtgagtgaataacacaaccggggggacatccccacggtgaaaaccaacgaaacggagggagcacaccattgcggaataagtaggcactcccacctactgccacccaacgatacaaggagtgcaggcctaacatcatcccagagggagacacaacaaggggaagacaccaatcgatgggtgaacagaaaagaacacgccggaacaacaacactactcataattgcgcgcgcacatagaaacaaaagaaaaaataagttctccgccgccggaacgagggggagcaattcacgagacgacaatgtggaaaagacaacgcacagaggcgtagatggagatccgcgaccgacggtagtagcacacacgaaggaggagacatcttacatctacaagagaaggcgcccaccgccgacgaagaaacacagacgacgaagcatgagacacgaagacttatgtagcgagcaccagccactatgagggaaggacggaggatgagcaaacaatcacgatagcgcacacacaaccgatagctgtacaccgcacacgacgtgaggcagtctacaacccaagcaagaatatcactcaccaagagaccgggcggggccaaatcaataaagaaaacaatacaccacacagagcaacgacgaaggccacaccaatacaacagacgaagcacggcagctcacaacagatcaaaaaccagacgcagaaggaggaaaacaaatacaaacagaggaagagaaaaacaaatcaacaaagtagggaacgaagcttggtggcaatcaaagcatgagnataaagggagcactaaccaatcgaactagaaaaaagaacacacaggagaagcggaaacacaccgcgatggacaaacaagaccgcagcaaaccgagacgccggcacgctagtagcaacaacagcacagaccgaaacacacacagacaccaacagcacacacaaacacaaggagaacagaacgacaaacgccccaccggctggcggcgacactaaacacaacgagacaaaccaaacgtagaaacgcaacagttccccccccacccgacagacgctgggcagaccacaacgcactgataagcaacacaacgccc

SEQ ID NO: 675610 - DNA, 113 bp, Homo sapiens
gtactaaatcaccacgatcaaacgggacaagcatcaagcacgcaaccatgcagctcaaaacgcttagcctagccacaccccctccatctgtgcttgtccacctccatctgtgc

SEQ ID NO: 675611 - DNA, 399 bp, Homo sapiens
aggtctacccagataatggcagagaacccagtggagctgaatgcttgatgtgagcgagatcacatcactgcactccagtctaggcaagcacagcgagactcagtctcaaaaaaaaaaaaaaagggaagcagtatctcgaaatcaatattgtaccttctgttgtaaaaaactaaaaaaaggtgggggcgggcccctttagccccagctacgggggggcctaaaaaaggagaatggtttgcccccagggaggcagagttttgcatgtggcgcatgatcaccccattgcactccagcctgggcaacagaggctgagactccatctcggaaaaaacattaattaacccctaggaaaagccaggacttattatccccaaagaagaagaagggaattaccaaaaa

SEQ ID NO: 675612 - DNA, 280 bp, Homo sapiens
accttaaaaccagagcaacattttaatagtcatgagatcaaggattcctgggaaggagaggagatgggaggctgttgcccgctagctttcaagacattcatctgcctgtggcaaggtcagtacctgggccagtccgaggagcatcttagttggcaaaccacgcagtccctggaccttgcaagccatctctgcccaccccatgcctggagcctttttctttaggtgagtccagcacgcataggtttgtgtggccactggtaggcatctttgttgaaggtat

SEQ ID NO: 675613 - DNA, 339 bp, Homo sapiens
aaaaatttccaacttttattaagttccagggtacatgtgcaggatgtgcaggtttgttacataggtaaacatgtaccatggtgctttgctgcacagatcatctcatcacccaggtatgaagcccagcatccattagctattcttcctgatgctctctctctgccgactccctgccctcaacaggccctagtgtgtgttgttccccatcatgtgtccatgtgttctcatcatttagctcccagaaaattttcaacatagacaaaagtggagagaaaagtataatgaaactccatgtattcattacccaatctaaactttcaacttcccagaactaatttt

SEQ ID NO: 675614 - DNA, 509 bp, Homo sapiens
gtccactgtcacccaggcttgatacagtagtgctatcacgctcactgcagccttgaactcctgggctaaggatactcgctacctgagcctcctgagtcgctaggactggtctccatctgttgtccacggctgaagtgtagtagtgctatcacagctgactgcagactcaaacttccaggctgaagcgatcctcccatctcaacctcccatgtgactgagattacgggtgcgtgcaagtaatgcccaactaatattcgggaattgacgtatacgtggattccagaggggtgacagtgacacgtgggaccattcccaagttgcaggaaaacaagctgaagacgcgcactgattctacattatgctcctatctcccggctgtctctccaggccccagaactttctccaatcagcctctacagagcacgctcatgactcacaatggcctaatttaggccataccctatgtcacggagtctccgcagatgagcctactgcccacaagagcctcc

SEQ ID NO: 675615 - DNA, 455 bp, Homo sapiens
ttttttttttttagtagagacaaggtttcaccatattggtcagactggtcttgaccagtctagaactcctgacctcaggtgatctacccgccttggcctcccaaagtgctggggttacaggcatgagccaccgcgcccggccaaccttcgtattttcaaagtgcccagtacactgcctggcacagggtacatattacaaaagtgtttgttgttattagatacagaaacggcaagctacgttaatgaaaatggcaactttcagctggcaaacggcaaagctcctaagtacaaatgctactgacaggacccatgggaaaagaaactttacctgatgccccctttctggagcatgtgctcattctcagagtgagggcttcccctagtcccggagggatttctaagttgaacctgcctctggcccaggctctgtgatccctacgacttaccctgactcc

SEQ ID NO: 675616 - DNA, 421 bp, Homo sapiens
aaagtctgagcaacagtgctcacatcactgatagtctgtgaacagtcactatgcgccattcatcctgtagtgacagatggactgacttacgtacatagatgcaacatattagtaaagcaatttcttacaaaaaaagtcacacattaaaccacagtattttaccgaatatactacagaaacgccataaaaactgccttcacttacgctctctctccccgtatccggcgagccaactggacgtctttgtacataatggtgactctcttagcgtgaatggaacacaagtagagtatcttcgcaacagacccaccaggtacgctatcgctagcctcctgacagcgcaccgatggctgcgctctgaaacctcaggatcggaaacagaccatcctgcgacgatcatccctcaccaaactctggaaag

SEQ ID NO: 675617 - DNA, 132 bp, Homo sapiens
cggtgaagtctgtaccctcttatactcattagtccccaatctggatcccattctctgaccatactctggctatccttgtgtgtaatctcatttgagagtgatcctcacgggttccccttggtccttatcgag

SEQ ID NO: 675618 - DNA, 220 bp, Homo sapiens
gaacacacaatggtggatgattttcaggttttagaagtagtaaaactaagccagatgtcaattcaggtttctcattctcatattacttttgagtcacaaacgctgcctattactctctggtacaaacacttcacacacacactcacacacacgcgcatacacacacatgacacacacacagacaacatgcacatacactctaaagtgctccccatatgaa

SEQ ID NO: 675619 - DNA, 490 bp, Homo sapiens
ctgccagtgggcttctctttgtctctcccagatacggtagatgggatcacaacatctaatctgagtctgtctttgtccttcattctgtatggcagtctccctttgtgatacaagcttactatgagcatactaatgaagacttcccggagccccgtcttgcttctcttccaggtgctctatcccctcgagatcctctggtgccaggcttgcttcactggccatcttgtgtcgtcactgtggagttcggaggccagtgttccacagtctatactgggaggagctgctgaatggggctctggtctctgggtgttcattaccctcatagaggctgagaataacagcaaggactgattcacacatgttctagaaccccagattgtgccatgttacctgataccaggggttctcaagcttgacaccattgacattttggactgggtaatcctgggttctgccgagctgtcctttgccctgtatgagatttactaat

SEQ ID NO: 675620 - DNA, 431 bp, Homo sapiens
ttcgagcatttgcacatcttttaacgcctgcccattgactgaagtcagggcgccactgcgaactaggtggctgggcacagcacgcgtgtgatgcgcacttgtgggtcacaagagtcctgacccgactcacatcgggccagccataggcattatgccatgaccacacccatggggaacaggacagttgtgactcacccaccaggaagaacgctggccagagatgagagattatgaggatgattttctttgcctgacctgatgagccagagctctgcccactgcgctgtctaccgttaccagctgagagaactccacctccagaggcccagagccttggaatggtagatcgcagcttgcagcggcttctattagggacacagagggtcagacaccaatctgtcctctgcttgctgccattagcgttaacgtct

SEQ ID NO: 675621 - DNA, 204 bp, Homo sapiens
  misc_feature (85)..(85): n is a, c, g, or t
tgtcaaactggccggcgcagtgcacgctgggccgccccggagcgtcgcagagcccgtcggagtcgtagtccgggacggcccgcgnatttgtccgatcggcagctcgggatccgggtcggggtgtcggccgggttgctgccgggcaccgtcgagcgttagcacccagcattgagctgccagcgctgtttctccctaagcaccctc

SEQ ID NO: 675622 - DNA, 435 bp, Homo sapiens
  misc_feature (313)..(313): n is a, c, g, or t
  misc_feature (358)..(358): n is a, c, g, or t
agatgcaagactctaactctgtcttttccctaggagcagcgtttatttacttatttattctttgagatggaattttgctcattgcccaggctggagtgcagtggcacgatctcggctcaccataacttccgcctcccaggttcaagcgattctcctgcctcagcctcccgagtagctgggattacaggcatgcaccaccacgcccagctaatattgtattattagtagagacggggtttctccatgttggtcaggctgttttcgaactctcaacctcaggtgatccacctacccaagcctcccaaagtgctgngattacaggcatgagccactgtgcccagccatcttctgggtattntaaatgtcatcctctaccctagtagagtagaggatagacctgagacaagcccatttgaaggtgtggaggggagaatg

SEQ ID NO: 675623 - DNA, 1145 bp, Homo sapiens
  misc_feature (532)..(532): n is a, c, g, or t
  misc_feature (620)..(620): n is a, c, g, or t
atgatgagggcatgagccacgtgggcacacggccagaagctctttatccgtaggtgtataggtgcccaaaggattttattgctatgtgtgtgatttaaaaagtgtgtgatagggtgttatggtgctagcgtttgagcttatctcagagaggctgagtgtgtccattgagtgagatcggatttcggagtatgaaggatagtgaggggttagtatagtgtgtgaagcggagtgagatgaggatcggggtttgcgtgtttgaccgtggtagggtgttcgcgagtatgtctctctcagcacgcatagtggttgaaaaagaacaatacctccctgctgagctcacagatcctgtgcctttgccagcctgtcgatgcagaaaatccaggctagtccatcttatgtgattggtgctggtgtactgggctgctctacttctgtgtccatatgcatgttaatggtattccatgcctttgcaattacttatggctgatcttgaattactcgctaagtctatgtagatacacaatgatacatnatcgggggtcagaaatgtctccgtactcaccagtgtctcagtgcggtttattacccacaagttgctactgtagcgtgagatcttaaantcgcatggttgcctcttcccatggtaaaactttctagagacactacacactttctgttaatacttctgtcaaaaagttgaacctttgaccccaagaatctcgggactatgacacatttcaatgttttaaccacgtgtaataaggacatccaacagctaaggggcgacacatagaacttatacccaagaacggtatatacctgaactagatttcgaaggtccatagcctagattctccacgggaagttacctacgatctagctacgccttcaaactacttctcaagcttataaataccaagcgcgatcaacccttctgagctacccccttctggcaatgcgcagaccatgtacataaataacggtcgtgcgccagaccccgtaatgggaattccctttctaccaaagtatcccggtaacagcgttctattaacccttaaaggacatcacaggttctaggaacactacggggagttaaagtggaaccacgtgtcgcctttataaattctccagggtgccccaaacag

SEQ ID NO: 675624 - DNA, 170 bp, Homo sapiens
taattctcaaggcgcttgtgtgcttctctgacctctacatggcctccctcagctgcctgctcaactaccgcgtggacttcacgcgttcgacccacgccgtacgccgctgcagcacgaggcacccctctggatggaccagctctgcaccggctgcatgaagacccccttcc

SEQ ID NO: 675625 - DNA, 620 bp, Homo sapiens
  misc_feature (20)..(20): n is a, c, g, or t
  misc_feature (68)..(68): n is a, c, g, or t
  misc_feature (110)..(110): n is a, c, g, or t
  misc_feature (122)..(124): n is a, c, g, or t
  misc_feature (143)..(144): n is a, c, g, or t
  misc_feature (148)..(149): n is a, c, g, or t
  misc_feature (157)..(159): n is a, c, g, or t
  misc_feature (183)..(183): n is a, c, g, or t
  misc_feature (194)..(194): n is a, c, g, or t
  misc_feature (196)..(196): n is a, c, g, or t
  misc_feature (201)..(201): n is a, c, g, or t
  misc_feature (257)..(257): n is a, c, g, or t
  misc_feature (259)..(259): n is a, c, g, or t
  misc_feature (270)..(270): n is a, c, g, or t
  misc_feature (280)..(280): n is a, c, g, or t
  misc_feature (342)..(342): n is a, c, g, or t
  misc_feature (372)..(372): n is a, c, g, or t
  misc_feature (377)..(377): n is a, c, g, or t
  misc_feature (390)..(392): n is a, c, g, or t
  misc_feature (394)..(394): n is a, c, g, or t
  misc_feature (411)..(411): n is a, c, g, or t
  misc_feature (419)..(419): n is a, c, g, or t
  misc_feature (431)..(431): n is a, c, g, or t
  misc_feature (435)..(435): n is a, c, g, or t
  misc_feature (529)..(531): n is a, c, g, or t
  misc_feature (600)..(600): n is a, c, g, or t
ttcatatgatcctatttggngcattttctaccatggtccaagatcattacatggatacagccaaggantgggccccaactttcaggaaaaaaaccacaaagaagaaaatnaaggaggctatnnnaaccccccagtagaaaatnngaannctggaacnnnaaaaaaaaaaagaggaaaaaaaanaatgcaacgantnaaagnacttggaaaaaattggtggaaagtggcacggtatacgagtaaggtcactgggcttngnatggcaaggcngctgcattgncagcccctccccgggcccaggtccttatcatgcctgccggcgtcattccctcaacgccttancctatctgtctgccctactccatccctccntcctntcatccggccgtnnntngcctctgccttcccccngtggcctnccccaccacagngggntacatggtaccatacacattctttgacttttcttgtgttgtgtttgatttgtttgttttcaaggctatccaggctaactcttcccggggatttnnntgggggggggggtggtccgctggggctggtttgctttaacctctcctttatcaagggatgatgactggntttaaagaaaaataaagctg

SEQ ID NO: 675626 - DNA, 109 bp, Homo sapiens
cagccgagacagcaatcccgccccggcctgtcgggagcggtggggcataggctggagagccccagagaggatctgactccgctttcacagtcctccagattattccaag

SEQ ID NO: 675627 - DNA, 151 bp, Homo sapiens
  misc_feature (9)..(9): n is a, c, g, or t
  misc_feature (66)..(66): n is a, c, g, or t
  misc_feature (148)..(149): n is a, c, g, or t
aaaatcaanctattattacaaaggactttaccaagccactgctgtgtcttcccccatcccatctgntggaagtcggcaagagcatgctagcaactttgtgttcgatgtcaaatcgtgcagatcagagcatcctaacgcaaagccgacnnaa

SEQ ID NO: 675628 - DNA, 109 bp, Homo sapiens
ctttctgtccggctgcgagaagccgacagaagggcaggagaaagaagcgagcaggaaggataggagagcgggcaaggagatagatataagtaagggagagagttatgta

SEQ ID NO: 675629 - DNA, 250 bp, Homo sapiens
  misc_feature (53)..(53): n is a, c, g, or t
  misc_feature (72)..(72): n is a, c, g, or t
  misc_feature (97)..(97): n is a, c, g, or t
  misc_feature (169)..(170): n is a, c, g, or t
ggcctggaacactgttaagagagaaaacagatcccaagctggattaggccaantgggcgcaagggaagctgnccctgccctgttatccgtggggctntggcgtcttggggatggcaccaaaggcaggacaaaccagagaaaagcagtgtaggacctggaacccagaganncctggaccccaagcggaaccaggttgggggtaagcagggggtacgccatggcccctctgagtcctgagctccggcgcctt

SEQ ID NO: 675630 - DNA, 299 bp, Homo sapiens
  misc_feature (9)..(9): n is a, c, g, or t
  misc_feature (47)..(47): n is a, c, g, or t
  misc_feature (108)..(108): n is a, c, g, or t
  misc_feature (178)..(178): n is a, c, g, or t
  misc_feature (231)..(231): n is a, c, g, or t
cgacacggntgcgaaaagacgacaaaaggggggcgttactcaccctntatccccagcagggaggctgaggcgagcggatcatctgaggtcaggagttcgagaccagcntggccagtatggtgaaaccccatctctactaaaatacaaaaatcagctgggcatggtggtggggcgcctntagtcccagctactcaggaggctgaggcaggagaattgctcgaactcgggagntggaggttgcagtgagctgagatcgcgccactgcactccagcttggcgacagagcgagactccatctc

SEQ ID NO: 675631 - DNA, 629 bp, Homo sapiens
aaggaaacactttcagttttgctgatatgttttagtttggtttatttcactaagttgggctattattacttccattttcttgagctttattttgcactttttctaacttcttgagttgaacgctcaatttgtcactctttcttgacattttttccattaatgcatatcacctttaactgtccctttgcatttccctttatttgcaacccacacttttgacatgtaattcttcctataattacaattttgatagtacatttattacaaatttggaatttccattttgagttcttctttaactcctgggaaatgcatttttatgttttcatatatttgcctttttttaagctatcctttttgcagctctaattttagaattctaatttgatcacagagaaatgtggccagagaatgggttcttccgggataatctttgaaatttgctgagaatttttttgtgaccctatacaagggcaaattttgtggatgttccacgtttacaccaaaaagaaaaatgtcgctttttatttggtctattcaccaccaagcttattacttgcattggtcaaatctttcattatcctaatcaaattctttgtctaccctgatcctccaaaagcagttcaaaa

SEQ ID NO: 675632 - DNA, 268 bp, Homo sapiens
agcggtcaagacagcctgggcacatggtgagacccttgttctataaaaaacacaaaaattagccaggtgtggtggcgcgcacctgtggtcccagctactcgggaggctgaggcaggaggattgcttgaacacaggggtagaggctgccatgttcgtgccactgcactccagcctgggtgacagagcatgaccctgtctcaaaaaaacaataaataaaataaaacagggatgaactggagaaactgtgaaggtgatcgtggggttgtaa

SEQ ID NO: 675633 - DNA, 196 bp, Homo sapiens
cggttggaaactctctatcgctagcatctgccaatggataggtggaagcctgggaagatctctttggaaacgggaatatcgtcaggtaacaagtacacagaagcattcgtcagaaactccttggtgaggctgggtgtcatcccccagagtataacattgcttttcatagagcagtgttggaacattctttgcgtag

SEQ ID NO: 675634 - DNA, 310 bp, Homo sapiens
aacagttggaaaacatagatggaacggacagtatcctcaagttatgcactgacctaagaagtaataaaaacctgaatagaactttaaccattacagaaattgacacttaaaaagaaacaggccgggcgcagtggctcacacctgtaatcccagctctcagggaggcagaggcgggaggatagcttgagcccaggagttcgagacctgcctgggcaatatagcgagaccccgttctccacaaaaagaaaaaaaaaagagacgaaaaaaaataagtgtaaaagaaacatcaaacccaaatgatttttaagag

SEQ ID NO: 675635 - DNA, 456 bp, Homo sapiens
ctcctctcgactagcgctctcaggtatactggcttgatacatggtacatctattagccacgcatgcgatgtctagattcaatatctgctcgcagcatgccatgggacatatagatgcataccttgtgcttcccacgaaatcatttattatttatttcgtctctcattcagcttctcttctactgagccataattcaagcccacaattatttgccatttgtccagctctctccactatcctgatggatccggttgtctccacatgtcatcttgttcaaaggcctctgctccattctaacctggcaggcgtagagcggtgccatgcaaaaagggagcagagaatgccaggacggcaggagaacaggggcctctgggctgaaccagcccaaaggctcctgtgcagcttcccagtgagaagcggttagactgtcagccaagcagaaagtgaggcagatcc

SEQ ID NO: 675636 - DNA, 410 bp, Homo sapiens
ggccatgtccccagaacctgcgaatattttagcttgcaaggaaaggggggctttggagatggaatttgggttgctaagcactgccctcagagtgggaacgtgatgctggcttttctgaggggccagtggaatcactgaggcccttgagaggggtggagggaagcaggaagtcaggcagagggagaagtgactgcagaggaaaggcaaagagacgcaacatagctggctttgaagatgaaggcaggggcccagaaaagtttctagaagctggaagtggaaaggcaaataattttcccctagagcgtccagtaggaacgcagacctgctgcaccctgaattcagccccagaaggcctttgctggagctctgtcccacagtactgtaggataagacatttgtgttgtttaaaa

SEQ ID NO: 675637 - DNA, 922 bp, Homo sapiens
  misc_feature (922)..(922): n is a, c, g, or t
ggacgcgtgggcggaggcgtgggcgctagcgcccggaggagaaaccgaagttgaaagtgtctcttagcagcgcgcgcgacaagaacggggcagccgagcatcatggcagacagcaggatgtggcataaacgatctttaggcagttacgatgacagaggacacgtagccgcgcaggatccgtcgaggcagagcacggcagtctcccgcctaagcaagagagatcgaagggatcctacggtttccatccgactcgcgtcttggcttctcggggactttcgtgctgaagccggggctcctggcggtgtcgctatcgtgtgacgtgtggcattgtgcagcatcccttctgaggctccagctgtgagtgcgatttccgccaggccgattccttgggcatcggacgatccctttgctgcctacggcacatcgtcccggtgaatggtggcagatgaccaagcggggtcttttctgctcgcgtggagccaatcgacctagctaagcgacgattttgaaggccttggtcgatccctcggatcaatgggctagatcgtgctctcgatagggatctattgttggcccaactaccggagggggggagtctttgggtccctctcccaagtagtcggacacattggggccattcctgaagcgtgcgtctttcgcgatcggttcctcattgcgcgcgaggccggttctggaggggtgggtcttggatgggttacatttgccggcgttggggtcattctcacgcaattcaaagagcagagggccatcggacaggcaaaagttgctgtgggagagagacccgacaacgttggtccccccggatgcttctgtgggaatgggcggtaacccccggtggggcccggttcattccttggagcgcgtccggcggctggcgaccttaagggagttttcagagctn

SEQ ID NO: 675638 - DNA, 425 bp, Homo sapiens
ccgtgttcccagggctgggaggacagctctggccctttttaggcctagcctcgtcccaagctaaatgtaagccagttgggctgtgttaaaggaagcagtgtttttggttcgattctgcctctgtagctcaaggggggcagcccccagagtcctgtgcattttgccaaggctccaaagttttgccaaatgcagggagttttccctttgggggaaaggagggccccttaagaagggtttatctgcgttcgtctcggtgggcttctcctgcatgggagttgtgttcctgtgcaagggggagctttgctccaggacaggatgactgttttccctatttttagggacaagtcccaagatgccagaaaggcagtctcccaaggacccacaaagcagacgtctcaattaaccccaagttttgaaaaaaaaaa

SEQ ID NO: 675639 - DNA, 138 bp, Homo sapiens
ggctaagtaagctcagcttggaccgaggggtgtacttcctgtgtaccagatccaggagatcttcagctccttgcagcccttcagatctcaggtgtacatgcaccccagcctgtcacctgccagcaccatgatcctact

SEQ ID NO: 675640 - DNA, 895 bp, Homo sapiens
gcgagtccgcctgtgggttacccacgtgtgaaccgtgatacttggggggcaccaacacgagtgtttgggcggggaccccacccacagaacggcatgggccagcccagaatactggtcgagggaagcacacccgcccccgcctttgcccgcggaaggacgcccccccgggggagctgtacacccggcgacgagaaaaaactttaatcctggacgaagaccgccacagcgagtgtcccccacaagggggcgtaccacggggtgcgccggccgcacgggagcacgtttgttttgagaggcaccccacggcctgtgagaaaccagttggcgcgcgacccctgaatttcgagccgcccccccgtgctatcgtgtgtcacgcccctctatttcgaggcggtctttttccatcgaggggcctccctgaataggggttgtatagagcccgatctcgcctgggggcccctcagtattgtagcccggttagtgtcaaagaaacacacaaaccactggtttggggtcatgttctttgcgtgaggacaaacttcccgtgtatcacattgcccccgcacatctcgtccggagcggtcacacaaatgtggcggagagaaaatacacatgggtggaggatgtcactgaacttctctgcaatcaaatatggaacaaatctctatggtgggcacaagtgatttcttgtaaatatgtatatctgaggggcatgacccccaactcgtagggttagccacccaggtaatacgcccaccccttaggggagcgcccccaacacgggtgagttccacccacataccccccctcttcgggagcgcccaaccggaggcacccttgcagccccggggttcgagccccccccggcaaaaggaacccgcccccaaaaaaaaca

SEQ ID NO: 675641 - DNA, 231 bp, Homo sapiens
cagccttccgggtcctcctcgccctggtatgatgccagcaccccatatggggggccctcccatgatgccaatgatgggccctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccaga

SEQ ID NO: 675642 - DNA, 103 bp, Homo sapiens
tgcagcagtgaaggaatttcacgcttcgatcctgcatatgcagctccaaagcgcccaggacgaccaggtcgctgctgcgttcggttcactggctcgcctacga

SEQ ID NO: 675643 - DNA, 800 bp, Homo sapiens
gcttcctgactgctgctgtcttctgtctgtgtcgccttcctctcgctgtcctggcacgcgaactcagcgtgcagaaaggcgatcgttgtggacgtataccagtgggagttcctggctgctgctgcgatcggttgcacgcagctgagcagtgagagcctcaagctgctccaaggagctcaacctggtgcttggacgagatcaacgaggggcggttgtcacgaccatgggcacaggcggctgcaaccacggagagacgggcaaatcggacactttggggccgcctacaagagatgagacccccagatttgaatgcctgtggccaagtgcttcaaaccgggcatgtagctgagcgcagatggtgcactctgtacgcttgacgttgacgactcctgaaacatccgctacgatctcctgaagcttgagccctgacacggagactggagggactcggatacatcgttggatgctgactctgccgagacctgaccctcacagtacacctttcgtgcagtgaccacgatgaaccatcaatggccttgttaccccgaaaggagatcccattactgggctccatggacggtcatctcacacataccccgcaattctaagccttgatttactccctgcctaccgagagtcctttgggggaccccagaggagagagtcacggtggaggaccaaaatgaacctcgattactgcttcctccttgaatgtaccgggcaggtccaaaggcttctactccgttggcagctgggggatgcctcgtgggcacagggacaaataactgagacccattgca

SEQ ID NO: 675644 - DNA, 109 bp, Homo sapiens
gagaatcagaacaaaaacaaagatttttatcagatgttatgatgcaaaacaagaaaaagaaaaaaaaaggaagagaaaattcaattttctgggtatgcacaaagaccat

SEQ ID NO: 675645 - DNA, 149 bp, Homo sapiens
cgtacacatatacacagatatgaggctaaaccctgtactaatagtaccacctaaagtaaagaaagctccgaggttaggaccttccaatcagccatctacatcagctcgtgaccggactaaattgatcctaggctttggaatataataag

SEQ ID NO: 675646 - DNA, 611 bp, Homo sapiens
actttctcaccccactgccgtttgaaggggccccttcagtggggcaaagaattcttcctttcgataatttcaaactggaaaaaatgtcctaatgaataggctatgcattgcggaaaagacctattgtatttaaaagggtaatcagttttgcaagagttcgcattggaataaatgaggcacactaaggcagtcgtatccgggttatctatgggattcattttgtggacttgtcatcgcagcacatcaaatgttataggcgcaagtgcctatgaaggtcaagggttcattagagcctatatcctatcgtactgcactttctgcatcgtgtagatctgggcacacgtatcctccgagtgacagacgcgtttctcccagatacttacatcaatccagagcatttgactttttataagtaccccccgatctgatctgccactccgtgggcatgtcacttatgccagtaattctatgtaggtcagtcatagtagagtcctatattcctatggcagaataattaagttcctgtaatgaataaatgtacgtgcagtggatagatgcgcctatgatgtggcatatcactaggtctagagttatacttcagcctactaaac

SEQ ID NO: 675647 - DNA, 510 bp, Homo sapiens
  misc_feature (12)..(12): n is a, c, g, or t
  misc_feature (411)..(411): n is a, c, g, or t
  misc_feature (505)..(505): n is a, c, g, or t
agtgtctctatntcgggtaaaggaaagaccaaaataactttccaagatgaaaagctaagagtgctgatctcatcacagacatagccagctcttcagttcagaccacctggaaaccctccccatgtcttttcagaacaatgtcctaagaaccataggggaagtggccataaaaaccatctttcctttgcagactggggtggggactctggccaatgccattctgttcttccataatatctttcccatcttgactgagcatcaaatgaggcccacacacaagattctcacccacatggccgtggcaaactccttggttcttctttccactggaatcccccacacaatggtgtcttttgtcctatggaaacccttgtccagtcttgagtgtaaactcgtgtttacaggtcttanagtcctgacctggtgatccgcccgcgtggacctcccaaggtgctggaattacaggcgtgagccaccactcctggcctatgccagcattctttanagttg

SEQ ID NO: 675648 - DNA, 150 bp, Homo sapiens
ctactgctgtactgggtactggttcgatgaactctttgtgccagttaccagtgctgccgagaatatgaagggagtatcgtcctgaatatgacgactgaaaatcactggccacgcagagagcccacgcagagagaacactggcacgactcg

SEQ ID NO: 675649 - DNA, 119 bp, Homo sapiens
gaagacttcgtagggttagcgaatttgaggtttcttggtattgcgcgtttctttttcttgctgacactacaaaagttcgctgccctcgggtttttaggcccgcctggggcccgttttcg

SEQ ID NO: 675650 - DNA, 359 bp, Homo sapiens
aggacaaaacaaatagtgtacgagtacctggataatacagccgtattagcaatgaggtagcaactttataagtacatattgttagactgtccatagtccacgcagagattacaactccacactatcagcaacaacatgctagacagttcctaagaaaactactattagaaacggcataaccacagagtataccttcatttgaccaactccatctcagtttagatgtgcagaaaggcagagatatatccagagtacgccacatgcgacatgttacttgatcgaattttctaaactcaggttacagcgacactgacagtaagataagggaagaaaacatggaggaatgacgtcctagttac

SEQ ID NO: 675651 - DNA, 295 bp, Homo sapiens
cataggagcaccacacgtatgaagcttctgtaaatcgtcacccgattgggatattcacgccagttaatttgactgaacaatgtcacccgaagagacaggttaaaagtcctctcccgttgggtgagaatgttgtgcacccactctggataccgggatccaatttctacaggcttcccgagattccctgtacattctcttagtgatgatggagttgtctatagaaacttcatctttctggaaatgtccatagagctgtgtttaacctcccagaacagaaggtcgacgcgggtaccga

SEQ ID NO: 675652 - DNA, 308 bp, Homo sapiens
atgctacctgatcctggtccctgtgctcatgcccgtcttagtggtcatctgcttgtgttctgtggtgtccaagtctgtattcacgtgtccttaggtaccatttcatgcttctccctttcgtactctttctcgtttctaaactgtgttcaacaacatcatttaaatcatgacggcattttcaagtagaagctgttgataactgaggtgaaaggacaggtgcctacttaggattctaagtactctcaattttgccacattctcctataattatgataggattgacttaaatccattagtctgtccttcac

SEQ ID NO: 675653 - DNA, 252 bp, Homo sapiens
tagattttttccatttataaattaattgaagcacagagaaaagggggaaaatgattaaagaaatttatgttttttaaacagaggattttgggttttacaccaacgaaaaagaaaaaccagatgaataagtttttaattttaattttttttcttttattctacatggtaggtctcgaagatgtctttaaatgtgattttataagctctaaggacagtcttgatcttgacagacaaacaattttttttttaccc

SEQ ID NO: 675654 - DNA, 745 bp, Homo sapiens
ggctccaggccgcacacctgagggtgggacccccgtgaggccgagccggtgtcggatcaaactcgtgagacctgagcagggcccaaacctgggaccggagtggggacgggcggaggaagccaagaggctcgagacctgaggctcgcccacccctctggctgcctgcctggaccctgctgccacttgggggaatttccttccctgacttccctgctgctggccacagccccagctccgtccagcccctggctccctggccccctgggcgggagagtgagccccgagacatccgaccacagacgcccggagggtcccgggcacccgttaggaccaacagaggacacacatccccggacgcagttgagtcaggaacccggctgacatacgagggagacgcgggagtcagcacggagcactgataacacacagaggatggtccaggaagcccgggggaccgccggggacggggggagcccccaggaaatggccaagtaggatcagcccccgacggaagggcacggcaggcaacagagaagacacagcacgggacagcttggaacatgcaccaacggcgcaagccgggggccgaagagaagcggcgggagacggaacaagaaaaggcgacttggggcgccggacgtgcgatgggccaacagggcaacagacgggaagacagggagatcaacagagaagccacacggaacaggagaagaggaaaggaacaaggacgcagagagaggaaaca

SEQ ID NO: 675655 - DNA, 195 bp, Homo sapiens
atacaatattctcatttaaacattacacagcatcattgtttataatcagaaactctgatccttctgtctggtggcacttagagtcttttacaccataatgcagcagtatagagggaggattttatagagaaatagggatagtcttcatgaccacaaataaataaaggaaaactaaactgcattgtggggttttga

SEQ ID NO: 675656 - DNA, 103 bp, Homo sapiens
  misc_feature (55)..(55): n is a, c, g, or t
caagccgccccctggcttctctggccttctgcctagggccctcccggcctgtgtncccagccccgccaccaccaccaccacaaaagcaccaggtgtgtgcccc

SEQ ID NO: 675657 - DNA, 778 bp, Homo sapiens
  misc_feature (259)..(259): n is a, c, g, or t
  misc_feature (632)..(632): n is a, c, g, or t
caatatctgggaagataccacatatgaagatggggcgaggtgttcaaggtaagaccgcagtcagcagggcaatggcctgtgaggagtttctcattataaaacacaaatgtgggattatggatctggttgtttctcttcgactcataacatcttcttcagaatgactctccccaccccgtgctatgtctttgaaagttttcgccatcgtttgaatttggcataccttacacgattgacatgataccttcttttcatcatnttaacgaacaaagcttatttttttggcccaagtgtcttcctgaagccaaagtttaagaaacacgattaagaacggttttgagtcacgccacaagacatgaaattagctaataaaaaacccttttccccccattgcctcataactcatttctcagaaaacaatcctggatgcaccctgtttaccagcaaggttaaaagtgcaagacccgaaagacctcacaatttttacactcaggcgaattactgttcatctaccctggctgaccctgcaatttgggagcgggcccttgtctgcctgtaaagggagaagaagagtgtttgtctggctggcctatatttgctcctgtagctcactctctgccaccagatttganttttgttgtaggccggttcgttaattggttttttcagaactgcgcatacctttttctaaataggctgggttttttgaattttattttatggatccctaggcccctccaagtttatttgatagaccaccttcaccttttggactttc

SEQ ID NO: 675658 - DNA, 513 bp, Homo sapiens
accccgatgcgaaagcacgggcagcatcttcactgtgctgggggagcttttaccactgctcctcccagtagaggaggacggaggcttatgagttgaataacttgccctgggtcacagccaataaataacagcctggatttgaacctggtcagttagttcaaaatccatcatctttcactagacctcattgccagtttagaggtactagagaagtttgcttcaagggaacaagagttctcttccttaggcccatatctctcaggatcctgcctccctaaacagaagagcttgcaacacaggacttgtgtaagctctcagcaatcagtaatgtggaaactaatcttgtcaaggagatgaccagttacaggatccttagtttaagaaaatctaaatggccttgggcttactcttacccaaatctagtcttttctacttcttccatcctgcctgtctagacccttaagttagacccccagaacctcattggactctttccaccgtgcttatctcaat

SEQ ID NO: 675659 - DNA, 586 bp, Homo sapiens
agacgctcttttcgcccagtggcgcccctctctccgcacgcgtccgttatcgcgggtgtagccgttccccgggctcggccctcgcccctttccgtgtggctgccttgcccctttatgccccctgtctggggtgtcttccccctcaggtcccctccgccccagtgtggtctcccccctcggggcgcccgaatctcgccgggcagcatgacttcttgcgtggggctctggggaccccatcgtcgccaggtggggcccccacaagaggcgccacccccgaggggtgggccccccatcctccaacctcggggaccacggagcgggcccccgcgggcccaccccgggccccacctgggcccacccgccaccccatgcctcttgcgaccacatggagaggaaccgacaactagcgcattaacaacatataaacacggtgataccacgacccactccaatttttatcccggggagaaatcttcttttcatataaatatactataatatcgctccccgacacccccctggagacataacttccgaccgcgccatccaacagctcttatattttctgtcacacaaataacaaaaa

SEQ ID NO: 675660 - DNA, 834 bp, Homo sapiens
  misc_feature (126)..(126): n is a, c, g, or t
  misc_feature (148)..(148): n is a, c, g, or t
  misc_feature (210)..(211): n is a, c, g, or t
  misc_feature (247)..(248): n is a, c, g, or t
  misc_feature (251)..(251): n is a, c, g, or t
  misc_feature (267)..(267): n is a, c, g, or t
  misc_feature (272)..(272): n is a, c, g, or t
  misc_feature (283)..(283): n is a, c, g, or t
  misc_feature (285)..(285): n is a, c, g, or t
  misc_feature (300)..(300): n is a, c, g, or t
  misc_feature (304)..(304): n is a, c, g, or t
  misc_feature (321)..(321): n is a, c, g, or t
  misc_feature (323)..(323): n is a, c, g, or t
  misc_feature (336)..(337): n is a, c, g, or t
  misc_feature (343)..(343): n is a, c, g, or t
  misc_feature (345)..(347): n is a, c, g, or t
  misc_feature (358)..(358): n is a, c, g, or t
gaaaagtttggtcgaggagtgatagcgggactcgttgacattggggaaactttgcaatgccccgaagacttaactcccgatgaggttgtggaactagaaaatcaagctgcactgaccaacctgaancagaagtacctgactgtgattncaaaccccaggtggttactggagcccatacctaggaaaggaggcaaggatgtattccaggtnnacatcccagagcacctgatccctttggggcatgaanngtnacaagtgtgggctccngaaangaatgttccananaaaccagctaaatcntggnaccttcaatttgccatngngacgcagacctgnntaaatnannntaaagatgaanttcccctgttcttgcaaagtcccaccccctatcactgtgctttaaaacaggtttcttttctctaataacgaagtagtgggtggtacttttttgggtgatgcctccctaggacacagcaatgtcctaagtcctttaccatagagaaaaggcagaactgcctgaacagatagcccttactgttatatttacccttattattttttattgttccatcaatagggatgccgtcccccactttttacgacggctattctaagactctactacctctatcgtgagattattaattctctctaatttatctttaattttttgttattatctgatgtgtgttatcttcaaatatatattagtttcgtcatattttatcaacgatgacctatcagtgcacagatactagaagagcggggaagttgtaagagtacttaatgcagacccacttaccgattacgaaacctgggttatattgagagggt

SEQ ID NO: 675661 - DNA, 524 bp, Homo sapiens
tggggtcaggaatccgagtggtgcagccgctattaaaggttcgtttgttcaacgattaaagtcctacgtgatctgagttcacgaccggcagttaatccaggtcgtagcttatctctgttgtgatacctccctgtacgaaaggacaagagaaataaggcctacttcacaaagcgccttcccccgtaaatgatatcatctcaacttagtattatacccatacccacccaagaacagggtttgttaagatggcagagcccggtaatcgcataaaacttaaaactttacagtcagaggttcaattcctcttcttaacaacatacccatggccaacctcctactcctcattgtacccattctaatcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccc

SEQ ID NO: 675662 - DNA, 510 bp, Homo sapiens
  misc_feature (126)..(126): n is a, c, g, or t
  misc_feature (148)..(148): n is a, c, g, or t
  misc_feature (210)..(211): n is a, c, g, or t
  misc_feature (247)..(248): n is a, c, g, or t
  misc_feature (251)..(251): n is a, c, g, or t
  misc_feature (267)..(267): n is a, c, g, or t
  misc_feature (272)..(272): n is a, c, g, or t
  misc_feature (283)..(283): n is a, c, g, or t
  misc_feature (285)..(285): n is a, c, g, or t
  misc_feature (300)..(300): n is a, c, g, or t
  misc_feature (304)..(304): n is a, c, g, or t
  misc_feature (321)..(321): n is a, c, g, or t
  misc_feature (323)..(323): n is a, c, g, or t
  misc_feature (336)..(337): n is a, c, g, or t
  misc_feature (343)..(343): n is a, c, g, or t
  misc_feature (345)..(347): n is a, c, g, or t
  misc_feature (358)..(358): n is a, c, g, or t
gaaaagtttggtcgaggagtgatagcgggactcgttgacattggggaaactttgcaatgccccgaagacttaactcccgatgaggttgtggaactagaaaatcaagctgcactgaccaacctgaancagaagtacctgactgtgattncaaaccccaggtggttactggagcccatacctaggaaaggaggcaaggatgtattccaggtnnacatcccagagcacctgatccctttggggcatgaanngtnacaagtgtgggctccngaaangaatgttccananaaaccagctaaatcntggnaccttcaatttgccatngngacgcagacctgnntaaatnannntaaagatgaanttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatg

SEQ ID NO: 675663 - DNA, 403 bp, Homo sapiens
cgttacacagtgtcccctacaacgtgacagcaccgtacgtgtcttgttttgtgctcatcaagtgtgcacacaggggctgtgcagtagttgtcgcacctgcctctcaggaacagctcctgacgggtaggacaaatagactccgctccctcgccccgggctgcgtgggcacagtggtcacctttctccagacctcatttcatttcattttttcctcttgatgaaacctgtccctctaccttgtaaaccattctgtattcccctactctccctaccggattttcacttgcctcctggtcaacataccactccatagtctccgtgcattgccgtctggatacagctgtggctcccacataggtttttttttcgagtcaaattaattcaattaagctttaaaacaaac

SEQ ID NO: 675664 - DNA, 450 bp, Homo sapiens
gaatgagggattgagcccaggagtttgagaccagcctgggcaacacagcgagatcctgtctctataaaaataaattaaggtatttttaaaaatttaaacgatcccttcttagccaggcacggtggctcacatatgtaatttcagcactctgggaggccaaggcaggtggatcacgaggtcaggagttcaagaccagcctggccaacatggggaaaccctgtctctactaaaaatacaaaaaaagctagctgggtgtggtgtcaggtgcctgtaatcccagctactccggagatccagccaggagaattgcttgaacccaagaggtggaggttgcagtgagccgagattacgcccctgcactccagcctgggcgacagagtgagactctgtctccaaaacaaaacaaaaacaaaacaaaaaatcgaaaaaaccccaacagtttcagagatg

SEQ ID NO: 675665 - DNA, 204 bp, Homo sapiens
  misc_feature (88)..(88): n is a, c, g, or t
ttttaaaaaaaaaaaagaccccggggccccaaagggtttgtttgtttggggccccaaacggccccccggtttttggggggtttagttnccacaagaacccttccattattttttttttgaaaaaaaggggaaacggggttttgggggttttttttccccggccccaaatttccaatcttttaaaaaaagggtgtttttccccca

SEQ ID NO: 675666 - DNA, 1247 bp, Homo sapiens
ggggccatggatgacactgcgtgccagtacggcggcgcctctgtctgaagaaggggaagtgacctccgtgcctccaggctctggccgtggaggataccggaggccccttctgcctcggccggtaaggccgaggacgagggggaaggaggccgagaggagaccgagcgtgaggggtccgggggcgagaaggcgcaggcagaagtccccagcgctgggggagaagagccttgccgaggaggactccgaggactgtgttgctgtgccctgcatgggacggaggaggtggagcttgccttgcggattgggcagccctggattgcccccggcccttccgaaattccagcggctctatgaactgcttggctgcccacggtactctggagcttgcaagccgagatcctgccccgccgggcctcccaggccgggagggccccaagagcgaagaggagagatccgatgaaggagccggaggccaaagacgaggaagagggaaaaaccacatattgcccaacggaatttcggatttggatgatgagccagttgacaccaaaggacttcctttgatttgaccgggagaacgcaccccaggaaggctcagaccgtgagccagaaaccggtgaggcccgcctttgacaaggtgctgtcgggacatttgagaggcccaggaagctgggaggacgcagatccttcggaccggggggcgaccctttttaggctgtgactcgggggtggccccaggcccgggatagcccccagattccgagttctccggggggggacgctctttccctagagagggggggattttgggtccccagttggtcctgcgcctaaagcggggcagaggcccggaccgtggtgggagcatggggcctctttttccagggcagagtttttgacaccttttgtgaagagagagagaaaagcccttaaggcccccaaaaggcgggtgctgggaagaacaggaaacaaggtgtgcagcagtggcggggcatgcaatattgagccccgtggcaggggggtggtggggttacttagaggcccacacaagaggaggggtggggcaacaagcctaacatcaagcgggggggggggggtgtgtagagcacaccaaacaccagagaggttgtcgagttaaagagacgtctctttacaacaaaaaccgagcttgggggtggtgctactgggggtctgatctttcttattctctttttttttttcttatattctattaagagcttaatagc

SEQ ID NO: 675667 - DNA, 123 bp, Homo sapiens
agacagctaagctttgacagctgactagtagtgggtcagagtgcgggcagaagggtcagggcattgatccacttgggcatccagtaatggctcagccagtcagaccggactgggtaagtggcg

SEQ ID NO: 675668 - DNA, 835 bp, Homo sapiens
attagctgttgagtccgccccggttcgtggcccaagcctttgtgatctcaggtgaccggggacaggacggacgcggggtccgtgaacgtgcttgattccaggccagatggaagagacgcggccggcgtttggccgcgtgctgctagcagtcttgaaccccagggttcggtgaccgatgtctggcttggtgctgctggcaggctaaggagggccgcatgcccgatgcttgctggcacgaggccccggtggtcagggcgtgatcctccgcgtcgagtcgcccggcctctcgccaccgccggaggctcccagggagctagcaggcgactggatacccgaggcacaggaacgacgcgtcgactgtcaaccggaagcgtcatgtcacacacagcccgggccacgaacgacacgtgagatcgcgaaaggcaggcgaaacagtcagaggggtccagacaggacggtcgtggacacgggagctcagccacacattcactcccaaaactttcctcggttcgctggagacaatatcagactcgtagggcacggtcgaacccgccagaggcaggccacccaaacccttggaagacagcaagaaagcagagccttgggcccacatcgtcttctaaccaccgagatggatggctccgccacaacgccagcgcccattagttgcccccaaaagtccaacgcgcaggatgggggaacacgaacccaggaagaaaccagggcagcacaaacctcccagaaggaacaaccattgaataacggcgaggaagtgacacgggctacgacgggccccatgagcgagcacaagcgatctgggaccacgtacgaacgg

SEQ ID NO: 675669 - DNA, 314 bp, Homo sapiens
agcgggcttctcggctccgttgctcccgcggcgcgaggcgctctcgctctcctcctcctccgccgtcgcccctcccgcagtcgcagaaccacggcacgatgaaaggacgcaatcaataaagagctcgacgggaccatcatctgtcaccaacgtagcagcagggccatcgatcgagcggtcgccggttccatggtgcgtgccgaaagggaaccaagcgcgccactgatcgccaccactgcatgagacgggaccgaccgacaagatgtacaacacatggctggctcaatcagcagcaccgacgcaaatgaaacccg

SEQ ID NO: 675670 - DNA, 510 bp, Homo sapiens
gtcgctaactaggattaggacggatcagaatctgacacatgtgggttaatcgaacagatgaggcggattgcgtgtgtgctgatgctccgagatgattccgacgaactgcacgggtagctcccagccggcgaaatccaccagacgaccgcctaattccttgtgcagctcgtgcaacgcagtggttgatagtgacatgaggaccccttcctgccgacgcgcgacgttgctgggtggtgcggcccacccggagccccctctgtcactgctgcctgagatcgtttcatccttcggcggaccccggcggggtctttctccagagtaatagtttatgctgtaatagtttatgctgtatagtttatgctgtaatagtttatgctgtaatagtttatgctgtaatagtttatgctgtaatagtttatgctgtaatagtttatgctgtaatagtttatgctgtaatagtttatgctgtaatagtttatgctgtaatagtttatgctgtaatagtttatg

SEQ ID NO: 675671 - DNA, 252 bp, Homo sapiens
ggggggggggttgcccccccccccccccggggggggccttttttttttttccgggtttttttttggggggggggcgcccccccccccccccgggtttttttttttccggggggggggttgggggggcccccttttttttttttcccccccccccgccttgggtttttgcccccccccccccccctggggcaagtttaaaaaaatttccacaggccccccgcatggaaataaagccccccccccaacccttga

SEQ ID NO: 675672 - DNA, 180 bp, Homo sapiens
aaacagatccacaagcagattttatcctcaccatcatcataataaattttgagatgtttatctcaccattgttatcatcatcaccctctccatcaccctctgcatcatattcaccaacaccctctccatcaacctctccatcatcatctccatcaccctctctatcatcctcaccatcat

SEQ ID NO: 675673 - DNA, 1278 bp, Homo sapiens
cgcatgggcgcgcgcagcggtgacgcgcgttcttagctgttgacgcgccggagccgcgaaagttcgaagctggaaactgcaggtgcacgagggaggaacgcgtggagcatgaaaaggcaggggggactccgtctgagacgaaaacgagcgcggataccagtccgggaaggccggagcatgcaaagtggatgtatcttcactggaagctttgtgtatgattcagggcgaagtcatctgatggaatgccacgagaagagttgatgtgctgagtcgcgagttgagtgtatgttctgggtttatcatatggggggaactacatccagtactggcgtgtccgttcatgtatgtcgaacgcagacgtgtctcgagatcccaggtcttcttgttgattgattccggccacgtgggacggttgatttcctcgggtcatctcaggattcgtgaacccttgcaggttgattagacgcgcgtgaccattccgtcttctgcccaagcttttatggtcgctgatgccgttgtaggcttgtaccggggggggcagtatggacttggatccgattgcgaccatcactttggacctgaacggaggcgtgtagttcctgtttcccctttactgccctaacttctagctgctctccttgctggccccattgtccaacctattgcgcaacccgtgatgctctattggtaccactgggtgttcattgcattcccagactggtgccattgctcttgtggcactgaacgcctcatttataccctttgtgcgaactttcttgaaacaggcgactgcttggaccctaagtagcgcattggttgagcatggattccaccgtcacttttcatcacacttgcgcttagcgccttgtaaatcttaagatgctgaccttcagtctggactccatttgcaccgattgttcttctttaacccatgcaacagagcataacttcctaccgtagatgggaatctcctgctgctagccgggcttctccaatgggctggcatgaaccccgaaaatttcccccaccgtggatcctccttgccccctggggaccttaccttaagaatgaacgttccgggcgggaaaacctgtcaacatgctttgcctgcaccccacttcccttctaggcttggctccccatggtggtgcacgctccctccgacacttgtgccttgggctctcagcccaatatgactttcccgtccgaacaccgcgcctcacctcggcatgtcctgcacccccagaccctgtctccgggacctctggccacgtcgtc

SEQ ID NO: 675674 - DNA, 775 bp, Homo sapiens
taggctacccaacaatttccctggatatcctcctgcaggtcaggagtcatctatttcccccttctggtcagatatccttatcactagatggctttccatccaatgggaggaggtgccataccacacaagtgccaagtagtggctacccagtgagctggaggctacccatgcgaccatgggaggttatccagcccctggaggctatccatggatgcacccacagaccaggggcgagcaccatccatatcccggagatccatccagagacaaggaattaggagatcccacacaggatggagagcagagcttaatcatggagttatccaccagacacacttcacaggacattatggccaggtggaccagcaacagagctaccaactaccatggaggctatacctggaggacagatgccataactcagatatcctggaggacacaaccctccttcaccatagtcagccctgccacagagacatcagagtcacacaaaggaacatatcacgaaccagcgtgccaaacatacgcagactactaagagatcgcacgaaaacttcctaacgacaaaggccacaacgaacgggtcccagcgagaccagactgcgacacacgcaacaggcacctgtaggcaggccaacccggaccccaccgatcacgaccgccagacccacatacacgccagccatcacaagcccacccagtgaccaggatcctaccaaactctcaatcacagccacgcggaactagaccacctgcacccgccaatccgccccac

SEQ ID NO: 675675 - DNA, 260 bp, Homo sapiens
actgtgaaaagagtaacatcttacagtgccatgcactttgcgacgtatcgtacgaagttgatgcttatgtccagaaatgacgcggccactcagcatatagaatgcacaaaacaacttgcagcagctatttcatgaggaatatgtagtgagagaggattcactgggcctggcaataggaacacatggtagtaacatccagcaagctaggaaggttcctggagttaccgccattgagctagataaagatactggaacataca

SEQ ID NO: 675676 - DNA, 907 bp, Homo sapiens
  misc_feature (256)..(256): n is a, c, g, or t
cctgaagttatatcttatcctaccaggcttcgggataatatcccatatggtaacttactactccggaaaaaaaagacccattggatacataggtatggtctgagctatgatatcaatggcttcctagggttatcgtgtgagcacaccatatatttacagtaggaatagacgtagacacaccgagcatatttcacctccgggtaccataatcatcggtatccccacgcgggtcaaagtatttagctgacttcgccanactccaggaagcaatatgaaatgatctgctgcagtgtcccgagccctaggattcattctttcttttcaccgtaggtggcctgatggcaatggtatagcaaaacctcatcattaggactatcgtacttaacacgacacgtaactacgtggtgtagctcatttccactaatgtcctatcaaagaggggctgtatggccatcataggaggtttccatcatgttttcccctatttctacaggttaaaccttaggaaccaaactacgcaaaaaatccatttcactatcatattcatcggggtaaatctaaactttcttccccaacaacattttcctcggcctaatccggaatgcccgaggttatcggatacccgatggatacaccagatgaaaatccatagtggaggcatccattctcaacaggagaatataaaaattcacgaggggagcctcgtgaagcgaaagctaaagtaggaggactccaaaccggggtaatatgaggcccggcacaaatgagacggtataaatgacaaagggggacccaggtgtgacccggccgcttaaaaaaaaaaaagggggggggaaaagggcgggaaaactaccgtcggtcacgcggcccggaagacaccgcgcccaccaccgggaggagggggggc

SEQ ID NO: 675677 - DNA, 263 bp, Homo sapiens
aggagtaatactggctgcctaccgagcctagaaaatcctatttacaactgcagtgtcctgcctttcatcgactattatatcatatggactcctctatactgccattagaagtatggaaaatgatatagctactgtatgtacacatgcacataatatttaaatttgctcttcattgataacaaccaaatatatactttatcaaatcacaatacaaatgctttatagtgttgaggacacatcttatgggggaaagggatggatcg

SEQ ID NO: 675678 - DNA, 786 bp, Homo sapiens
atttttctcattttgctttttaaaattcctttaaaaaagtgtgctgttaagccagtattaggtatctttattttgtaagtgaacattccagctgtttttttctggcagatctgatgctgatttgatgctgtatgaatctttttttttttttttttagttataaatttcatttaggtgaagtggttcgtattattttatacatacacattaagtactcagctaagataagtggcactagtaaggaattttattattttctttccgtggtcagcagcagttcgtggtgaagtgcattctttaggatactaaaaagtgcacaaatacagaatctatataatattttgagggtgggtggacacagtggccctccactagtggggacaatataccccagggatcacttgagcgaaggcacacaacagtggttaacctatccaacgttggctactaagcaaatggatttcccaaaaggtggtcctacccgatgaagacaaaaagagtgggggttacaaaatcacgggtgggtagtttcactcattggggggccgataactaaattaaacagtgggggcatcaaagcaagagtcttttgcagactacccaatactgcgggaagtaatcaattgcagccgctctgggtgtccgcaattatgtgacacccagggcttctttagtgggggacaaaaacaacggcgtctgcgtgaaccacctgtgtcgtcgtcacaagctgagttacaccagaatcaattagtgaacactcctcttaaatatttgccttctgtgaca

SEQ ID NO: 675679 - DNA, 144 bp, Homo sapiens
tctactaataatacaaagacattagccgggcgtggtggcaggcgcctgtagtcccagctgctctggagagctgaggcaatgagaatggaagtgaaccctcgtgtaggcggtagcttgcagatgaggccatagatacgccgccta

SEQ ID NO: 675680 - DNA, 125 bp, Homo sapiens
tggggcacacacacatattcaattatgcaacagtagactctaccgtgccaacctccgactcggatgcacgcctcggcacatagtccacattctcatcgtctatagtcgacgcggccgcgaattta

SEQ ID NO: 675681 - DNA, 87 bp, Homo sapiens
agaatctattttagaaaccttgagtttcctcaatgtggtcaaagcttcagtcatcattaaacttctctggaccaaagaaaaaaaaaa

SEQ ID NO: 675682 - DNA, 903 bp, Homo sapiens
  misc_feature (670)..(671): n is a, c, g, or t
  misc_feature (843)..(844): n is a, c, g, or t
  misc_feature (846)..(846): n is a, c, g, or t
  misc_feature (860)..(861): n is a, c, g, or t
tttgtcaatgtttggaatgcaatcaaaacagtagtcttcctggtttcaaggaaaggcaactgccatccccgagtcagaggggattgaagaattaccgccagcactctcatatgggcagcaagatccacagacgggtactgcccctatacttggccatatttaatccactttttcagggcgaagcccatattttccttaagagcaagccagccagcctcaatgtcgcaatagagttcctcctctgtggttttcccggaactggcaccatatccagaataatcatatgagaatatattacaattaatccgtgatcctagtcctatgtaaaagctgctcatttgaccaagatcaacagcatttccatgtgagaagagtaaagtgtatttcgcattgggtgaacaacgtacaaacatacaagcaattctgttgcctttactggttctagtcatgaacactcaatagcatctttttctctagaagaatactgccagtctgctcgttcagacagatgtaaagtccaacgcgtccggctttcatcacacatcagtgtgtaagttggatcaggtggcaaaaacgctaattttgaagcaatctcccctgacaaaggtgcacagcagaagaggcaacatagctcactaaatgaaagattattcatgctctgcacctgagnncgccgggccgaagcgccgggcagaaggggtcgagagagaaccgcagccgacgcgctgtcctccacaaggcgagaatcccgctccgggcgccgtccgactctctccgcctgcagactggcccgacagaggagcggggaaccagctacatgcccggcgccggggcgaagaaggnnanccgtcccaggggcnncctcacgctcccgagtctcgcctcgcgccggccctgctcctc

SEQ ID NO: 675683 - DNA, 214 bp, Homo sapiens
tcagcggaccttatgtgtggtgtatgatggaggtttgagaactgaagggagactggttgtccctgatgatttgcagcttcggagagagttgatttctgaggcacatcgtaccaggtatactgttcaccctggtaccaccaagatgtataaggacctgaagagaaatttttggtggaagcgcatgcgacgcgacattgcataacaccacacaatt

SEQ ID NO: 675684 - DNA, 466 bp, Homo sapiens
tgaaccaaatgtgacctgcacctcactgtcatcatcactgaggcctttttgaccgtctttgaacagcccaagaccattcttaccctggtagacctgatgactgagaagaaaaagcatgagacgaagcgctccatcaacgacgagatccacacacagctcctggcccacattctgacaggcatcgaagacatctgtggtcactactgtcaccaccactggagggactagcacaaccagcttaagaagaaacatgtgaagaaacgtcctatagctgtcgagcgctccaagtagccccagctcattgccttctaccacaagacggagatgaatcaggccatcgagctgatggagagcgtgtgcagtgacaagatcccctctgccgtctccaccgtatccatgcagaacatccaccccaagtccctgccttccgagcgcatcctgccagcactgtccaaggacaaggagg

SEQ ID NO: 675685 - DNA, 355 bp, Homo sapiens
gcgcagcttgagatatataaggacactcttctctcacactctactgtgacacacagtgccacacgcgattcacagccttaaccacaaaccaaagagagggctctttaaaaaatgcgccacaagccatggtggcacaaggaaaggggatacccggcttgcaaagaaaccggaaggaccaaggggaacaccctgtgcaggaaccaagggggaaacacactgagaggacaccccggaggttccagatctcttctctgtggacacagttccttaaccacagccatcggggtgggaacccttttcacacgagaccttatcacaagggacagccagggaaggtctgtcacatctcagggcc

SEQ ID NO: 675686 - DNA, 445 bp, Homo sapiens
  misc_feature (1)..(1): n is a, c, g, or t
  misc_feature (113)..(113): n is a, c, g, or t
  misc_feature (120)..(120): n is a, c, g, or t
  misc_feature (146)..(146): n is a, c, g, or t
  misc_feature (160)..(160): n is a, c, g, or t
  misc_feature (162)..(162): n is a, c, g, or t
  misc_feature (165)..(165): n is a, c, g, or t
  misc_feature (191)..(191): n is a, c, g, or t
  misc_feature (198)..(198): n is a, c, g, or t
  misc_feature (210)..(210): n is a, c, g, or t
  misc_feature (220)..(220): n is a, c, g, or t
  misc_feature (227)..(227): n is a, c, g, or t
  misc_feature (234)..(234): n is a, c, g, or t
  misc_feature (243)..(243): n is a, c, g, or t
  misc_feature (249)..(249): n is a, c, g, or t
  misc_feature (254)..(254): n is a, c, g, or t
  misc_feature (303)..(303): n is a, c, g, or t
  misc_feature (307)..(307): n is a, c, g, or t
  misc_feature (351)..(352): n is a, c, g, or t
  misc_feature (359)..(359): n is a, c, g, or t
  misc_feature (417)..(417): n is a, c, g, or t
  misc_feature (445)..(445): n is a, c, g, or t
nttttgtctctcatattttaggtatcttctcctttaattaacttatcaacctctcatggcaagaatttgagaaagtaaatttatactaaggttctaattttaatagggaaggnagaagtnacagctcagtgcaccatgaagttganacagatatggagananctnagccccacctctgtggaacaggaaanatgattngggagggagcanaggtgagcgngggaagngggtganggtggacangggggnggggnggtctccccacctcctcacattatgcctacacgaacacagacacatgcnggtncctttgcagaaacaaagttagggttcttcaagtcacaaagggannggcaggnacaacttttgcctcttagtcccacacaagggagctgtttcacactttacaagctgtgngggacacatcagagccctgggcactgtn

SEQ ID NO: 675687 - DNA, 370 bp, Homo sapiens
tcttcaaaaaatacaagaagaatgttaaacattttgttcctacaggttaaaatatctgctgcctattaggttcttctgtgacatgtgcctcccagcagtgaactaaatttgtcgacataaactggattgataaactatgctaaatataagatgttcacatatttttattatggtaaaaaaattttctaaatatgttagtacatgtttctatatttattgtgcctactgaagagaaggtgtggccctgaaggaaactgaaaagaaccgtcattagttttgacaaagacagagcccaaagacatggtaatagctttttgtgaccagtatggagatgttatagtgaaatagaattattttataaaataacccc

SEQ ID NO: 675688 - DNA, 250 bp, Homo sapiens
gcccgagttgaatatttaataaaagggcctttttgaaaagaaatcagatgaaggcataaaatttagtttttagttcttgaacaaaagcttaaaattcttggttttttcagggtttccccttcaaggtttttggagaagggaaggttttccaggttccatgggtgccaccttgagttctgtcccttcaccgggttgggcggggtatgtccctcccaatgccaatgtgtaaataaaggggtgttccccccca

SEQ ID NO: 675689 - DNA, 115 bp, Homo sapiens
tacgccgcgttctcgtatcaagacccgaccccactgggtgctgctacgcggcaaggaggaggctcggttctcctgacttccaggaggaagctccccagtgcgacactaaccagac

SEQ ID NO: 675690 - DNA, 114 bp, Homo sapiens
cacgagggctgaggaaaaagcgcgggcggcgccttcgggaggcgagcaggcatcagttggccgtgccgtaacatcgtcccgcgcgcggtgggtagcggcccagtaggcgcgtgg

SEQ ID NO: 675691 - DNA, 231 bp, Homo sapiens
ccccccgggtgggggggcccccgaatcattggggggggggaaaaacccttttttataagggggggggcccaaaaaattgggaaaaaaccaaaaggggaacccccttttaacccccccggttttggggggacttctttttgggaaaaacccgtggtttgtttaatttcccccccctgggggcccccccccaccctttgggattttggggggcaaaggggggccccctttcca

SEQ ID NO: 675692 - DNA, 233 bp, Homo sapiens
tggtcatgatcatgtgacgtggagctggcctcattgaatagaaaatggcaagcgaggatcagcttgctggcatctgtgaataagtcaatggctttctggagtcaccatcatttagggcttcaatagcagccacttttttatcctttgcctgatccatcatctcctccgttatctccgcattttcatctcccatttcttgaggcagcatcagggtctggttcaatcccaccttc

SEQ ID NO: 675693 - DNA, 670 bp, Homo sapiens
gcccctgtatggattgccacacggctcacattgcatgcaagtttgctagagctgaaggaaactattgatcgaccgctctggtaaaaagctggaaagatggccctacagattcttgaaatctggctgccatgctgccattgttgatatggttcctggacaatgcccatgtgtgttcgcagagctatctacacgactatccacctttggttcgcttcgctgtctcgtgaatattgagacaggacgagttgcggtgggtgtcatcaaagcagtggacaagaaggtcctgctgcgagctggtcacaggtcaccatatctctgcccacgactaggctcagaatggctagcctgaatattatccctaatacctgtcagcccactcttaatcagtggctggaagaacggtctcagaactgtgggtcctcaattggccatttagagtttacgtcgtaaaacgactggttaagtgactaaacaatgcagtcgataccacaccttcagacggacaaggatgaatgtcctgtggaccactttgcgtcgtcttccttgcgtgtggcagtcttcaacgttattagtctcttaaaatcagtacttggttaatggaaacaacttgaccaaaaatttgtcacagaattcttgagacccattaacaaaagttacattgaaaaacgta

SEQ ID NO: 675694 - DNA, 190 bp, Homo sapiens
ctctcaacaccttgagctagggattatgccccacctaagctcctgccatgggggcagatataaaaacttttcagaagacttcaggccaggagcagtgactcacacctataattccagcactttggcaggctgaggcgaacggatcacttgaggccaggagtttgagactagtctgcccttcatggcgaaa

SEQ ID NO: 675695 - DNA, 203 bp, Homo sapiens
ccctgccggtttgcgctcggtgatctgagccgcggtgtcgcggcggcccaggagctcaggtcctcgttcagggcgatgtactctttgccgtcgtaggcgtactggttatgcccgcgttggaggcgcccgtccggccccacgtcgcagccatacatcgtctgccaggtgtgagacccggactcgctctggttgtacgtagcgga

SEQ ID NO: 675696 - DNA, 285 bp, Homo sapiens
tcggcacctctggatgcaaagtgtcgagattatgggcgtgagccacacacccagccataacttcttagcatgacttttcccatttgttatgagttcaattgtgcctccccacaaaagatatgctgaaggcctaaccctcggcgcctcctaacgtgaccttatttggaaatagggctgttgcagatataactggtgaagatgaggtcatactggagtaggatgggccctgaatccaataggaccggtgtccttataagagaggagatggacactttgcatccagag

SEQ ID NO: 675697 - DNA, 103 bp, Homo sapiens
tggccagcattaacaactcttttatttgaaaacgtgggtggctctgaaaagagccttttgagttcacaggtgccccttctgtcgtcttctaaacagccgtata

SEQ ID NO: 675698 - DNA, 510 bp, Homo sapiens
  misc_feature (449)..(449): n is a, c, g, or t
tggccagcattaacaactcttttatttgaaaacgtgggtggctctgaaaagagccttttgagttcacaggtgccccttcgagacgcgggccgggctgggcaccttggcgtgacgtcagcctcacttgccctttgccttgtggtgactctccgtcttcttagggagcagtacggcctggatgttaggcaagacgccgccctgggtcatggtgactttgcccagcagcttgttcagttcctcgtcgttgcggatggccagctggaggtgacgagggatgatgcgcgtattattgttgtaccgagcagcgttggcgggcaggtgaaggtatatcgggggtcagatactcgaggaccgcagccatgtagacgggagcgcaggcaccactcgctccggtgagttgcctttgcgcacaggcggatgcactcgccctaccgggaactgaaggccancgcgggacgagcgcgacttggccttggcgcgggcgttgcgtccttgcgttccacggaccag

SEQ ID NO: 675699 - DNA, 887 bp, Homo sapiens
  misc_feature (374)..(374): n is a, c, g, or t
gattctcgacgagttggagtctatgcctctgaaaatggcgaactcaatgttggacttcgaacacaaggatactgcagcgatccgttagctcatcgtttcccattgcatggctcagtatgacttagtattggctgcgtcgagatgcatcggataggggggcagcggccaatgtctcaggatcggctcagatccgatcgcttttaactatagaaattcatcctaggtcgatgccacgggtgcagcgcaagagggtatcctagtcgtggaatctgagtatcgagcaatcgtctctacatggtgaacgacattactgaaggagtactctgcccggtgcaaggtctctgatgtttggattgtccctcaatcacttaganaaacggaaaggggagctctttcgaggcatcgagttttggcagtccatggaatttgcgtatacgcaatagttagctcgaatcgcatggcactaggcttagtcgggaatggatcacttgaattacgagacctttatcgggctctgcgcgacgtgtaggaaggatgaaccatctgttgagaagggaagatttctgaccccaaggagagctacacgaaactgggatgggccagatatatgcatatatacgccattgcttattacaagggggtatgcacttagaaacctcgccaccagtgaaccataacgtagggagaacagggaagggacctgggttagtctacaatcccaaaaaagggtgccttacctcgccgtaaattccaagaggtggaaaagcagttttgcaaccttatgacacccaccaaggcaacctttgtcggattgccgaataggggaaaattcggccggccaaaatgaagcccaccccgattgggaaacatgttttcccctttttccg

SEQ ID NO: 675700 - DNA, 606 bp, Homo sapiens
gctgttcaacaggattccgggcttgccacgccttccggtaagtttcaagcgaaagcctgtttgcggggtctctgttgcccgtcttagcctcgttcggtcgtgtgtcgcaacagcttgctgttgcgtccaccggagctatgtacgcaggcgcgttgcagcgatgccgtaaccgtgttgtgcgccctcatgggtgcctgtcaagcgctgattcgctcgtgagtcaatcgtgccgggtttccgccatatgctctgcccgtcttgttgacattggtttgcgccgttttccggactggtggagcagtcgcgtcaggtcattgcggcgcaggccccggaactggatgtgttcgatctacagtccgaccgttgttgggaaacggtgcgtagtggtggtgtaaatgtcgtcacctgggccgctttggcggtgcgcaaatacggaaggtcgtcgggcgcaaaccaacggcgataacggtatgtccctggatgtattgcttgcgtaggcacgtgaagagggcgtccgaattgagtgtgtggtgaatgagggctcaccatacggcgctttctggccatcaagcgcgtctctttatcaagtctgtactggcgccagat

SEQ ID NO: 675701 - DNA, 1501 bp, Homo sapiens
atttttttgagacagagtctcactggagtgcggttgtacaatattggctcactgcagcctctgccttctgtgcccaggcaattctcttgcctccaggagaattgcttgaacctgggaggcagaggttgcagtgtgccaagatcgtgcccctgcactccagcctgggtaacaaagcgagactctgtctcagaaaaaaaaaaagaaagttatctctaaaaataaggaattgcttaaaagcattattgtttttgattgagttactcttattaaaactaaaattttgtagttattctatttaattttaattgaatgtaatatcaaataatctaaccagtgatctgttggtgtgatggcctaatggcattattgtttttgattgagttactccttattaaaactaaaattttgtagttattctatttaattttaattgaatgtaatatcaaataatctaaccagtgatctgttggtgtgatggcctaatggcaaataaagtctttgcatacaagtttataatgatttgaaaatctcatgttaggaagagtcctttgagtacaactgtagagtaatagtagagtagagattgcatatgaaatgcatggcctctaatttttttccctttatttaaaccttcccctcctttgttatgtagtgtagcatattatttcccaaaagtgccactttatttcactgcatacaagttgagttttccttaaaattttttaggtgagtacccagaacatgaagatgggtgggctgccgcgtacaacacctccaactcagaagccccctagtccccctatgtcagggaaagggacacttgggtgagtatataagtagtaattgaaaaccatttcatgtagtattgtttaaaaatgaagcacaacatatttaaattattttttgaatatttgaagagagaacattttctttgtaggattgttgtttgtgtgtataacttcctcttctcttgggaaacacatttttatacttcagaaagatttgtttagaaattgtttttctagtgaattttaaatttgaggtaaaatcctagcccaagttcatagtttattgtaaattgcagtctaattttaattccttttctttcagaaaatgtatatagtcttttatattacagtttaactccaactatcctttttaagctgtgtagattataaaattctataaaacttataagaatattgagcttcaggccaggtgtgttggctcatgcctgtaattcccaaagtggggattttgagagaccaaagcgggcagatcacttgagcccaggagtttgagaccagcctgggcaacatggtgaagccctgtctctacgaaaaatacaaaaataagctgggtgtggtggcatgcacctgtagtcccagctacttgcgaggctgagacaggaggatcacctgagcccaggaggttgaggctgcagtgagccgtgatcatgccactgtgctgcagcctcagtggcagagtgagcccctgtctc

SEQ ID NO: 675702 - DNA, 87 bp, Homo sapiens
gtaacaaggaatcccccccttcccccccccgggtgaatttcatggaaaaggttttgataattttttttactttttaaggaacaaatg

SEQ ID NO: 675703 - DNA, 903 bp, Homo sapiens
ggggtcatgccctctccggtcagtgctgcttagaggtgctcgcgccgtctgctgctgctgctgccgccccgagtcttaggcccgaccctcgctcctgtgtccgtcggtccctcagcgcggtctcctgcgcaccgatctccttgcccgacgcggctcccggattgcagtatgggacggcgcggggcgctgatggacggtgctggatacctcgtgaggctagcagtgcgccagtctagggagatcttgtgcgaaaactcaaagaagataaagcaccccaagtagagcgtagacaaagcagtggctgaggctcaaaagcccgaaaagagggttctggaagcaaaggacactggcgttacagcccaaagatgatattgtagaccgagcaaaagatggaacgataccctgaagaggaggtttctctactgatcagagcttatgctattttatggaaagttgtgaagtggtctgtctagacttgaggtcaaatcgcttgtgctgtgaatagcagccatgaattcagaccgggatgaagccttctatccaacaagcgacactcgatccatggagatccgagtgcaacatgcatcatgccctgagcacaggaatacaagagctctgggcgagggagagaaaattcgctggaccttcatggttgaaagacgtagaaaatgggagcaaaggttttcggggctgacgcatactatgagaagctcatctaaggacattgatgtctgctaacaagtgtcctgcgaagcacaaccgcaacggcagggtttcgggccattgaaacaaggacagcgaactgggaaccttgaagcatacgtaatccccatggaaagacatccccaggaataaaaggccaatcatgggccgagcaacacggaatgaaaaaagcaggcagta

SEQ ID NO: 675704 - DNA, 301 bp, Homo sapiens
  misc_feature (104)..(104): n is a, c, g, or t
  misc_feature (151)..(151): n is a, c, g, or t
  misc_feature (199)..(199): n is a, c, g, or t
  misc_feature (276)..(276): n is a, c, g, or t
  misc_feature (284)..(284): n is a, c, g, or t
gcttcctcccaggcctcgcagggctcccttctcctctgcctggttagactcgggcacccaggaaagcctggccagggctcctttgggcctgggcccttgcactncctggtcagaaggggtggtgctgtccgtggccagcaacccgggcccngaggggtgggctactagagtcagagcgggtttggggctgaccagtttnggagaggagaaaagatctgagaatgtccttcttggtttgtcagtcatctcttccaaaagttgtgatggtggtgtccntatgtttngcctcttttggcttggt

SEQ ID NO: 675705 - DNA, 271 bp, Homo sapiens
aacgggtgatgcggttgcagtgagctgaggtcacctgcattccagcctgctgacagcgagactccatctcaaacagaaaatcatgtgcacaatcggactcacaattgattgcggatttacttgtatctatgcgctttcatgagctctgtttagccacccttcagaaaccatcaccctaacctgacggttctatttctgtggtaccagttctttcctcagaacacgaaacacctgaagtctccttaatctgctaatggctccagattgcaga

SEQ ID NO: 675706 - DNA, 1791 bp, Homo sapiens
ttcatcatgttaccgttggcttgtcgcggtgccactgttaacagcgttggtttgccgcctcccagtattactcgtgcttttagtggtcgtcgtccttgggtaatcatcagggcacggctcatttctgcactctggtcgggttcttgtgggttgcgctcccctccctctctttgttcctccctccctccctccgctttctgtcgttttcgccacacatgcacagtgtgtgcggcgcgcgtatttgtttgcgcccccagatcgcccccctgcaacggtttttatgttgtgcggtgtttacataatcactgcgcccgttcgtccggaacaacaacagggggggggtggcccacctgtcgtgctatatggtgtgttggtgaccacagaggattgttccctgtggtaggagtcatcctctattggccccccgtttctggcacccatcttggggggttggtcctcctttagagtgaagtgagggatatctcatctcccgccctgtcgccccaatttgttgggcgaaaaaattcagcggcaccgagagcagcacacaacacaaatgggaggaaatagattacaagagacacgaaggctggtgtgcgcgacccgcagccaagtgtgtcagcacagcaagaaccacaaatttttcggggaaggagtagtctctgtgggagaaagaagttcatagtcgccgtttgagactctttgtggaagggctccccaccccccccatatgggtgcccaagcaccacagcgattcctatatttggtggggcctttggtcctatatatccaccgaagggggaaatatgtggtggagggagaaatagtggtgcggcccctcctttccctgtggagagatggaacccacaatatgggggaggagtgcaccaaacaccaccgttggggcccaccgaaattttcgtacccacatggggatccccggagataaagttgggggagatatttcgttaaggcaccacatggccccccagagccccactgtaatatggttcgctgacacacgggtgtggccacaccgttatatatgggtcccccccacctcggggagatatacaatacgcttatggtatggagagcctgtgtggagagaaaagagagggggtcccacccccacgtccccctcccacagagacctctcccacgagaattgggtggggagaaaatacacatacacgcgcacggtcgttgtccacacgcacacagtgggccctcccgtgtgagataaaaagcctcggcgcacacagtgagacacacagagacccttgggcacacacagggtgatattccccctcatcacacattctataaaatatacaaaagtgtgtgagaaaaaaaaatgggagaacttttagagatgggttataagaatgtcaccgtgagataccacacaaactctataatttttgggttctccctcacactgttaaaccccaatatggaggtgcttctctataaataattgatattggttttcttagtgaaagatttacccaagagggctcttgagatgtgttaatattctcgcacaaggtgtgtgcctctaacacgccactttctgagattaccacactaatgtcctcatttctgccacacatcctctgctgaggagactcgttctagtcctcggtttgggatttattcttaaaggttctagaaaggccacattttacttcagccaaacttgattctatattgttgtttttcttaaagtgtccaaattgttttgttactagggtttcctatgttgttattaaaagtattcccctggtc

SEQ ID NO: 675707 - DNA, 397 bp, Homo sapiens
ggctgtatgagtgaccattctggagagccatctacttcacaggcagaagctctggggccacacagactcgggtttgaagctcgactctgttatttattaactgtgcatcttgggggaagtcatttaatctctcagaggctttttcctcctctaaaaaaggaagttaggctgggtgccgtggctcacacctatcatcccagcactttgggaagcgaacaggggcacatcacttgaggccaggagttcaagaccagcctggccaacatggcgaaccctgtctctattacaaatgcaaaaaaattagccaggcgtggtggctcacgcctgtagttcagctactcagaaggctgaggcagaactacttgaacccaggaggtggaggttgcagtgagccaag

SEQ ID NO: 675708 - DNA, 453 bp, Homo sapiens
tagtatagatttttttttttaattcccatcgattttaaggattatcctggggtcaaatttcaacattccaattcaatttctcaaaaatatttattgcatgaaaaagaattaaataatggcatttgcagttacctggatggaattggagaccattattctaagtaaagtaactcaggaatggaaaatcaaacattgtatgctctcactcataagtgggagctaagctacaaggatgcaaagtcgtaagaatgatgcaatggactttggaaactcggtgggaaagggtgggaggggggtgagggataaaggactacaaactgggtacagtgtatactactcaggtgatggatgcaccaaaatctaagaaatcaacactaaagaatttattcatgtaatcaaacaccacctgttccccaaaaacctatgggaataaaaaataaaaattaaaaaacc

SEQ ID NO: 675709 - DNA, 144 bp, Homo sapiens
  misc_feature (75)..(75): n is a, c, g, or t
  misc_feature (122)..(122): n is a, c, g, or t
cggggtccccaaaggggggaaaaagggcttccctggtcaaaaagttgggctttgacccaagggccatcatccctnaatgccccccatgggcccccccctgggttgatgatgataaaaaaaantccggcccttgggccctctcca

SEQ ID NO: 675710 - DNA, 102 bp, Homo sapiens
aggtggtcttcctgcagctgcccacccacccacacacactttttggtggcccttctttcccagtgccgtcggctacattttccggggtaccggagctcgaaa

SEQ ID NO: 675711 - DNA, 334 bp, Homo sapiens
cagaatcgagctcggtaccgttttgggctgtcggctgcagctgtcactttcagatatgcctgcgtatatgcaaaaccatctgtgaaccgggccctagtcttctcttcctctgtcaactgatcatgtcaactgatcatgatcatagggaactccccatgaggccactggtgcaggctagggcaaagaaggcagggtggcacgagcggagaccatgagcatttgagccacttcctcatgtaacttattcctcaggtgccttcaggacctgctagagcccaatcatgcatataacacttccacttgatgatggaatactgctgtgcacgacccaaaa

SEQ ID NO: 675712 - DNA, 699 bp, Homo sapiens
  misc_feature (8)..(8): n is a, c, g, or t
  misc_feature (10)..(10): n is a, c, g, or t
  misc_feature (82)..(82): n is a, c, g, or t
cggggatntnatttgatacattattgtttgagttatacaatgtctgtaggttttttatgtagttgctgagagacaacttganattgtggacatggtttaccctaggtgatgaggctgacttttttttgggcggggaatattagccggccttccagcttttgtgtgcctcattctagctttttcacagtctaccctttgtcatcctcgctgtcccccaaatggtcttttggtttccttgcttgacgggtttgtgttcctccctttccagcggccttactctccatgtgctttttatgtttactgttctttgtggatacctgtttttttttattgcgttttttgtctctttctgttggtttgcttcttgggttgcctgggtctctttagtcgttcttggtcgtcttctcttctcctctcgtgccttcctcttcttttcccgcttctgcctttcctttctttgttttttttccccttttttttttttttcttgccctgtgtttcttttctgcgggtttttttctttttgtttcttttccttttgtgctctgcctttcttttctcctccctgcttgctgctttgtgctcgcctttttctttttttttcttgtcttccccatgtcctcgttccttttattgtctgtctttttccctcttgtttggttgtttttttttgcctgttcgttaaaaacctaaaaataa

SEQ ID NO: 675713 - DNA, 109 bp, Homo sapiens
atcaccaagacctggaactctacacaacatattttgtcaccaagtaccctacttctaacctccctgtcttatgaattcgacacagggaggttagaagcaggatcttgga

SEQ ID NO: 675714 - DNA, 177 bp, Homo sapiens
tgattacgtgtgactgtgaggaacagaaagactgaacggatgatgcctacgtttctgacttaggcatctagatgattagaatgtgcttcaccaacgtacaaaaatatgggacagagtccgtttgtttacgtcagaggtaagtgacaattacccctgctcaaaacgtcgcgatcctct

SEQ ID NO: 675715 - DNA, 1143 bp, Homo sapiens
cagttcacctgaggtcaggagttcgagaccagcctaggcaacattgtgaaaccccatctctactaaaaaaaaaaaaaaaaaaaaaaaaaaaaaaatttttgggccgcttgggccctagaaaaatttttataaaaaccaatccggtagggagagcgcaaggggcgcccaagaagggcgacagggagaacaagtgggagcaaaaacgagggtaacgccaacagaggggagaaccccgggggagacaaagacagcaagaggcgcatggagatcactcccgcacactatacaagaaaacgcgcccaggggagagaacaccggacgagagagtatggaggaaaacacaaagatatacagagagggtggagagatacacgagagagggccccaactacaagcgggggggagctactctaaaccaaacgacgggggagagataccaaacaaagaggaagagcccagcgagaagaacacaagaaataaggaagccacacggaacgagggggggaaacagacgacagacagaggcacgaaacagagaggaaaggaaaagaaggaagaaggcaggaagaagaagaaaaaacaacaagaaaacgaagaaaagaaaagagagaaaaggagagagagaaaaagagagaagaggaaggaaagaggacaaagcagacgagagacgaagcgcagaagacagagggacagaagaagaaagagaccgacaagaggagacagaggaacgaaaggacggaggagagaacgagaaagaaaagcagaaaggagagaggaggcgaacagagaagaggcaagagagggagcagcaaggagaaaagaaggaagcgaaagagagaaggaagagagagagagaagaaagcaagaaggagaagagaaggagcgacgggaagcgcaagagagagacaaaacagagcaacaaaaaagcgacgaaacagagcgaagagaagagagcaggaaaggaaaaaacagaaggaaaaagagggagggaagagagagaaagcgagcaagacgaaagagaggagcacaaaacaaagaaacaaaacaaaaagagaagaaaagagacacaaggagaaaaaagacaacgagacagcagaaaaaaacaaacagaagagtccaacaagaagaaacagaaacaagaag

SEQ ID NO: 675716 - DNA, 1314 bp, Homo sapiens
ccccataacgatgaatagagcacctctcaatacatatggagttatttttaatgtcggcgttctctccgtgtgctgtgtgaacatgttgcgtgtctatgtggtgcctctgcctaagtttccttctgttgggacgactcttctgtatctgtattttcatcttcttttggggagataacttttggtgggtaatggtaaccgcttgtaaatgggtctttttcacgcgccatatgttggggcacccaatattctcggggattgtgtccacatatggcctttaaggggactacagttaacttaaaccctgtgccccctatagcgcacttctgataggccttaaaaaagggccccctgtgctaaaagtgtttaaagaggaaatctatagtgttctataagggaaggattcccaggccctattcccgggaaggggaactccccctgttttgcttgcagaaaatgctccagaaaattattttgggaatgctccgcattaaggaggttcctattttgcccccccagttgaaatgtccaaactgtttggtcttggcgcgtgtgttatttggggaactgtgctgggctttctcgttaagcgaccttcctgggccaccaataaggtggcacttgggaaatatttaacctttggttaaaaagctttctcccacccacactttgagccacaatattaataatgccaccagtggttgtaaaaaccccaaatgccccctgaaaaagctttagaaccacatctaatggagcctgggcaataaaatagggtaaattttatattataagggcagtcaccacaccggggtaaaaacactggaggatatatacctctataggaacatttctagacatctgtagagtgtttgtgtggtaaattggccccacaatataataatttttgtgcgctgcgctggaataataatcaggaattaaattgtgttaaaatggtgcacttccttgacaaataggaaaaataatggtaattttaaggcacctctaccgccacaacgggtataaatgccaacaccggtgtttaaaatggtgttggtggttgtgctaaattcttttccacataagaaattgtgaaacacttgagaactgacacaattatcctataatggagtttggttaatgaacttatgagcaaaggctggtttggccacgacacgtataacccacaaacttttataataaataatacagacaggcgtatcaacacttgtggaattttcttgtctaatctgaaatttgcattccactggtggtaacataggtatatgtattgttattaaagtaagtgacccatgtcca

SEQ ID NO: 675717 - DNA, 248 bp, Homo sapiens
acagatttcgtgaacaaggaaccttcacagattttgttatcaagtgtgatgacggcacagaatttcactgtcataaagtcgtcgtctgcgctcaggtcgacgcaatcaacgcaggaatgaagaatggcttcaaggtatgagctttttcagtcacgagaacgttcccgtcatgcacaattgtggctgaccgcaacaaggaggcacagacaggagaatacttgctgccggaaaaaaagtcatcgattgtc

SEQ ID NO: 675718 - DNA, 258 bp, Homo sapiens
ttgcaggaatttttttttaaaaggctttgccccttcctctcccggccttttaaagccaaaaaaaatgtctctttgccccccctttgttggggttttaaattggaaccccctttttttttgaaactattggatttaaagtaaggtttcatattatggcagcaaggaattaacttatgtttaaaagggggcccaatcatggacccaaagttgctgaagttttttttttagctgggaaagtaggggtttgcctggcttcca

SEQ ID NO: 675719 - DNA, 148 bp, Homo sapiens
acgggggttttttgggggccggggtaaccttccaccccccttgggggagggggggggttttccccccccccctttttttttggggaaaaaaaaattttttttaaaaggggggggttttttttggggaaaggaaaaaacccccttttta

SEQ ID NO: 675720 - DNA, 785 bp, Homo sapiens
ggttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtggcattcttggaattccaacaaattgaaaaaccttcacatgggtcgctctttggagacacagcacacaaacaggatagtgtatcctctccgtgcctcacagccggaccacctccaggacccccaagaacccttttcctccttccggaccatcatgtcccccaactggtggtccttatccagccccaactgtgccgggcctggccccacagggccatatcctacaccaaatatgccctttccagagctacccagacccatatggtgcacccacagatccagctgcagctggtcctttaggtccatggggatccatgtcttctggaccttgggcgcaaggaatgggagggcagtatcctattccctaatatgccatatccatctccaggcccatatccagcatctccatcctcccaaaagcacatgaggacagcaccaacctgttccatggaggcaccagttccacaggagcctggggaccacacagaccatatcttgccctacaggatcgtatcccaaacag

SEQ ID NO: 675721 - DNA, 1277 bp, Homo sapiens
  misc_feature (1256)..(1256): n is a, c, g, or t
taaggttagagggggaatgctggaaattggtaatggggtatgggaaactattgtcatataaggtaatggctagggtagagtgggtaggaagtttttcacataagaggtgtatagagttgggtcgtagcggaatcggggtgtatgctgtccagaattcataaaaacagggaaggtataaaagtctagggctctggggtgacaaaactatgttgggtgttaaagttctcaggggaaaggtgcgtcactagtgttggttcccataggaagaatcggtaggtggctgaggggtgtaccattctatacaatcacatgtgttcaggtggtatataccggctaataggaacaaatcaggcgcaaacgggtgccttgcggccgtaatacccgaatagttcgaaacacctgacaactcagtttccgggaactacccccttagcggacaaagggctcccacaagggggggatacccgggaagagggcccctcgtgccgaacggtgcgtggaacattacaccatcacatataaaggggcccaagggcgccccccccgactgccgcagagagataaacccaacacaggtagcaacacaagggcggcaccggcgcaccacgggggcatgcacgcacgggcccaacaagcgaaccccccactacaatacaccacaatggccgcgacaacacaatacaaacgggacaccggcacaacgggagtcagaactcccccccacgcacgaccatgcgacaccagaggacaccagcgcaggccccccaccacgacgcccacactcaccaggggccccaaagagaggaaccacggacgggcccacccccagacacaccagaagagatcggaagcaacaaccgccaactggatcacacgggggcccaccaacatcaacaacgggcagcgccaccagctcgagccgcgcaacgaggcacaccacagacctccaccaacgagccaccgccgagccacatcccgcaacaacctcacaatacccccaagaagggaccgcaccaaacccaggagggccccggagaaaccccagtgaagggaggacgcaccaccgacggcacacagcagccgtgggggagcaaaacgcgcgcgcgatacacacggtcgcacacagcacgtatgcgagcgaaagaaccgtaacaaagacacggcaccagccgccgcaccagccaggggacgcccccacccgtcagagagcgagcaccaagaggcacacgcgacgacgggccgtcccaagacgctanggtccacaatcaccgcagcct

SEQ ID NO: 675722 - DNA, 166 bp, Homo sapiens
  misc_feature (8)..(8): n is a, c, g, or t
agctcggnaccccctttacaggcccaaggccgcgacctcgtcgtttttgaaccccagttcgcgcagcaccgccgaatcggcgcgctcgcccgacatcttcccggcacggtggtgctgaccgatagcgcggcgccggggccggctgggtcacgccgcctgcggggga

SEQ ID NO: 675723 - DNA, 289 bp, Homo sapiens
tgggcccccctccaggattccgccaggtgtccctttcctccccctggggcccagagttatattatatataaagtctttaaatttggtgtgtcttggggtggggaggggcaccatcgcctgcccctggggtccttttttttattttatgaaaatcactatcgggactgccgtcctcgttgctgggggcatatgccccagcccctgttccaccccttctgttgcctgggcagggggaagggggggcccggtgcctgttattattaaacatgaattccattaaaaaaaaaaa

SEQ ID NO: 675724 - DNA, 229 bp, Homo sapiens
ccccctaaacttcctgtactgataaggaacatagaaaacgctctgcagaatgtgcatagccttggagttgttacacgagctgtacgtaagagtgatagacgaatgccattacactgtgcttggagatgcttttaaggaactgctttgtgagtagaccacatcccacgccaaagcagttttctcgttttgagatcagagccaagatctgctgtgcccgacagaactgcag

SEQ ID NO: 675725 - DNA, 649 bp, Homo sapiens
ctttaaggtctttgagatattctgatggcagagtacaaagttaaaggttaccaatagaattcaaattgtgtagtttttctcaataaaaatctattctctctttcttcaaaatatcattagaaaatgtcacctggagggaaggtcttggactattagagagaacttcaaattctaggctttatactatgaattccttccctagtttactatcttcaggcaccaacccattcccgcttcttcaacttcctccaactctctagaaagactttctcatgaaattattccataaggcctcaatcattttattcactttttattttaaatagaaatacctctgtaaagagtgagactttaggtgaatgactttccagcataatttttttctcagctgcattaaaaggtaaaaggaaatcttttctggaattgtaactaggagaagcagatcagatgagaactgtttggggagatgcaggagggaggagggagatgtcaggtcacttgctgtctacctcacatcacacagccccagggaagggcctgctaacccagattaaatcctaaagtctgcagagatgaaaataacattggctcaaatccttttgtttgtaatagaaatccttctttccaatcattctgggaattgcttcag

SEQ ID NO: 675726 - DNA, 599 bp, Homo sapiens
gggcttgaggccgggtgctgtagtctcttcgtccagagccttatgtaagagcttttctcgggaaacaggaagtcctgcttgccaagttggcagcacagggagtagtgcacggccttattccaacgacaccacggctccgaggccttaatcccgcagaactcaggccagttttctgtgcttccggtgcccctggttctcgctccaccatcgagccgcaccgcctctctttcccaccttcaggtcaccgcctagtgaactggcccagacgatctctgctgtgcttgagcccgagggtcttccaaccctcgaacctgaacctggacacatgcccagctagggacccaccatcgctgcatcctggcgacgaatgacctctagccagccaacacattacctcaccaccaaggaccatggggaccgacaccagaggattccctgcgcacaggcgcatgtgacctcacagggatgtcaccatggaagcgccgtgatcactaatcctagaacgggacatgggaagccctacatttgatacctgaggctagacgggatgggtggacgagaccacaaaggcaagaagcaggaaccaaaagaaggagatg

SEQ ID NO: 675727 - DNA, 786 bp, Homo sapiens
cactcacactacactcatccactcacaagctaatctagcggcgtgctcacttcagtccagtcggcattgcggctccgaggggcgcggcactggtgctggcgatggtgctcgcggcgatgctggtggcgccgccggcgacggtgcacgccatatcctgctccacggtgtacagcacgctgatgccgtgcctgcagtacgtgcagcagggcgggtcgccggcccggggctgctgcaccggcatccagaacctgctggccgaggccaacaacagccccgaccgccgcaccatctgcggctgcctgaagaacgtcgccaacggcgcctccggcgggccctacatcacccgcgccgccgcgctcccctccaagtgcaacgtcgccctcccctacaagatcagccccagcgtcgactgcaactcgatccactgaacgaactgaagcgccctggcccgtgtgtctgtcgacgtacgtctgccgtgtgaggagtcccatgtctggagaataaattgctgctactagtactgaagcttaggctaggccttggcggccagatccgtgtcgttctacctagtcgttgtgtgtggttaagggtcgatcgagttaattatccgcatgcagttcatggtgttgtggccctgggttgccggtaggttccacgagcagagcagagtggtgaactgatattgtgtgcgtcgtactacgtacgtgtctagtgtaactgtgcgtgctttagtctattaaattatcctcgttaaaacagaatataaccaaactaaacatcaaatta

SEQ ID NO: 675728 - DNA, 212 bp, Homo sapiens
ggaaaaaaaaaaaaccaagggcaatctatgaaactactagaaaaaagggaagaggtgggccaaggtattaagaaaggaggcaagggtttactacgacaatggatgaaaccactaaactctctttcactggcaaccaaaccatgaaaggggaacatgagacccattgagacaggcatatcaggggtaccgaggctcagaatccggtaatcatg

SEQ ID NO: 675729 - DNA, 403 bp, Homo sapiens
gatccccgacgagttgtccgagttacttcttgtttaaaaatactgacgtatatttgaaaactgtaggtgtgtttctattttatggtaggggctgcccttcctggaggcagtgggttccacaagccaactgattgtccccctgccaagtcaccaagggaagctgctaagctgcttattcccctcggtcctgattgtagggtcttcctgattgtcaacagctgtctgggatgcttcagtctcctaaaactggaaacgcagggtgcgagcagcacacactgcctcccgccactgccagccggagtgagcggcccgagagtatctgcaggttcccctgggggctgggggccgatgaagcctaatatcaagagccaagaatgtcatgtacatggaagtgcctacggac

SEQ ID NO: 675730 - DNA, 456 bp, Homo sapiens
ggggctgccctgggccttggccatgcctggccagccgccgagcagtccccacgccgcgctggctgtcgtcctcgcctccctcgccgcgcccccgtgcgcgtgcgggccttgccccccatggtgtcccggccagagcccgaggtgcgaggccatggactgcctgatgctggcgtgtagctgccagcgggctgctcgcacctgggcaggcttcaagtgtggacaactggaaggcagaacctgcggtgccatctaccagtgcttcgtgtggagcggcacggctgaggcccgcaagcgcaaggccaagtcctgtatctgccatgtcttgtggcggtaccacactcaacaggactgcattcctgcctctactgtgtcttcttacggctgttatcacgaacagcaagcatattcacgagcatgcgaaggcgaagcggaacaacctggccattgatctgatgt

SEQ ID NO: 675731 - DNA, 229 bp, Homo sapiens
tcttttttgagtcaactggtgtctccttcttctctggagatgctttgcttcattggggagggggtgttctaaaacactctttacgccggcttctattgtcttgggttaatcgtgtgaccgcggtggctggctcgatattgtcctaccctggggtttgtatagcttagttaaactttcgtttattgctataggttatcactgctgtttcccgcgggggtgtggcttggct

SEQ ID NO: 675732 - DNA, 1064 bp, Homo sapiens
  misc_feature (821)..(821): n is a, c, g, or t
ggtacctgtgggttatgaggccgaacaggcgccgtcggttcccaccgctggattaacgcctgctgacacagaagcaccgtccactgctgtgtggacgaagtggtgtcaaagggcatcaagtacacctgctgggtaggtgtggcgagacgaatgtgaagtgcgagtgcaagtcatgctggaatccctggttgtgagaagatgtatgagaagatcgaccttgatgtcgtgctccaatcaggcctgcctgcgcctgtcacgcgtggaccacaacgaatagccgatatatggtgaacagaccaaagcagagcaatcgctcgatcattcaatcgtagtcaggagcgtgaaccaatacggaatcttcatatgggaatcacgcatgtagtgcctggcaggtttgcctcaattcatcgttgcatgtaattatgggcctggtgaatggatttggttgtgttggtagttgcaccggagttcaagtgagaattgggtggcgatccctatcggtaatggcacacagatgactttctcaagtgatccactggaaccatatgccttctggaagtgggtgatcgaccaccaataccggtgatctatctgcaagaatacattgactccggtatccatatagttttcaagagttcacaggcagaatgaggctcgggaacctgattccacgttacctgaaagagaaaccctgaccccaataatgaaaacaatcgttggctataactaacacgaagtgctggccccgcagatgcccgcatgcgcctcatgaaaacatgatgttaactaggcggcggtatctgggacatcaagaacgctgnccggtcagggactacagtcacgggagacagctacgggtctgggtacaggcaagacacccaactgtgtcacagtgtgtcagggcgatctgacaaatgcgacatttagggtccaagagggcttgcacgcgataggtcacggcacccggtccggtggcaaatagagtcacacgggatcatgcggccctcacgcgcatgagctcgtcacattggggaaacttggtgacacaataacagctcatatgg

SEQ ID NO: 675733 - DNA, 855 bp, Homo sapiens
ggggcttacccccatggaaacctcaaggaaaactccagattccagaccttccttggaagaaaccttgaaatgacaatgaatgaaagtgaccatgatgctagagacatctatgtcagaccacagcaggtgactccagtcaggtggtcctggtcccacttgtcccagtgtaggtaagtatccctttcacatcctctccagtggtttaagaatgtcccacttcctaaggtgatccaaatgcatctctacatttaggaacagagacccgccttaagagatggatcgcacaccttgtgcaacagatgtgtctgattctctgaacctacaaaatagttatacatagtggaataaagaagggtaaccccaattcaaaaaaaaaaacaaagaaagacacaaaaagaaaaacggtacagaaagaaaaaaaaaagaggaagaaacaaaacatggagagagaaacagaaaaagcaacagacacacatataagacagaggaggagagacagcatcgagaccgcacagaagtgagcagtatgacaccacacgatgacgtgtgggacgtgaggcaacgagagcagctaagagcaaggtcggctgggaggggaaccgcaagcattgaagagcgacgacccaaccaggagagcagacaggagcagagagaaaaacaaaaaacagacgaggaagcgaagtacaacacgcagacggcgtcaacacagaaacgcagcagacaacaagacaccgggcagaaacgaagaaagagaaaggaacgaagcagacagagcggcgaaagaagcaagacggagcgcagcaagaaagaccaacacgacgtcaaacgagcaacgaaccagggcgacacaaaaca

SEQ ID NO: 675734 - DNA, 219 bp, Homo sapiens
ttatctggtctggttctgcctgacctggcttgtctggatcctctctggtatctgctttctccctggcctgccttgtctggcctgtccctggccagcttgacctgaccctggcctgaaatccccaggtctgacactggcatgcttggcctggcccctccttttggccctgccctggccctgccttagccctgtgctatcttagtccaaaggcaggacaag

SEQ ID NO: 675735 - DNA, 209 bp, Homo sapiens
ctacgaggatatttagtttaggtaaaaactaaagtctggtcttaatactgtagtattaaactactagtactaatttgagtaggataagtttggtatttttcaaacattggcaccctcggaaaggagaaacttacatactttaggcgacatttataggaaatccatctacataggtatttaaaaaacaaagcaagttctaattcccaggc

SEQ ID NO: 675736 - DNA, 193 bp, Homo sapiens
ctccggcgtcagtatttggctgactcgccacactccccggaagccctatgaagatgatctgctgctagatgcgtctggaggccctcggattcatcttatcttgttcaccgtcggtcgcctgactggccttcttttaacaaagtcatcactagacatcgtactacacgacacgtactacgttgtaactcacatc

SEQ ID NO: 675737 - DNA, 185 bp, Homo sapiens
  misc_feature (96)..(96): n is a, c, g, or t
cgcgcaaagtgaacccacatcggtattcgaattcatcggtaagtgctttcaacggagtacctcgattgctgtgacatttcttcattcatgataatntcaccacctcttacaggcaattcattatactcaacagccaacgataactatcgtaatacctcttgaaaagtcgcatgatcatgtatctg

SEQ ID NO: 675738 - DNA, 544 bp, Homo sapiens
atcccagtacttggggaggccaaggtgggcggatcatgaggtcaggaggttcaaagatcagcctgaccgaagcatggtgagaacctcgtccctactgaagaaatgacagaagagaattagccaggtatggtggcgtgcgacctgtatatcccagcatactcggtgaggttgagggcgggagaatcgacttgaacctggcacagctggatggttgcgaggtgagccagagatcacgccagtgccctccagccgtgggcgacagaggtgagactctttctcaaaaaaaaaaaacaaacgagacagcagaacacaaacagggaacaagaaagatcaacgccgggcgccatgggtgggcggggccgccacataggtccccaagtttactaccaaggagggccgggacgggcgggagaacaatgcggcttggaccttcctgggcgaggcacgacgggttggcttgggaagcccagatgatccaggccagctgggcacatcacaagcccggggtgctgaccacagggggaagactctggtgtccacacag

SEQ ID NO: 675739 - DNA, 170 bp, Homo sapiens
tcagcctcaagcagggctgcggccacgaccacgggccgtctttggcggaagaacacctccacaaagaccgcaatctcgattcggctctgcttcacgtactgagcgacgccgtgaacagcctcgccgtgatcgtgggcggcgtgttgatgtatttctcccactactactgg

SEQ ID NO: 675740 - DNA, 480 bp, Homo sapiens
cagggaaccactatcacgaaacagaaattctacctctctatactaatctccctacaaatctccttaatcataacatacatagcatagtaactaatcatatacatatattctttcgtaaacaaaacttatccccatcattggataatcatcacaccgatgtgaaggccaaccagtgcagaacgccttgtaacgcagtgtcactattattgtcccttatatctaatacctcgtagtaggcctgcccgttacccgtagatcaatcgcaatgattccacatctcacaatacccataggcctcacttaacatatttcatacattactgcactcatcaactgacccaaagaactatccaaatctcccttgtagaccatacaaaaattaaattatggtacatagactttacacaaatagactggtaatagatcaaggataccttcatatataggtacttcctacattatgtacttcccttgacagcc

SEQ ID NO: 675741 - DNA, 117 bp, Homo sapiens
gcacacctgccacgcgctcaccgcaacccaccctcacgctcgcgcactctcccacacacgcacactctcacgcgcacacccgacgcgaccacaccccctcgcactcgcactcgcgct

SEQ ID NO: 675742 - DNA, 386 bp, Homo sapiens
tttttttccccccgggtcccccctttaaaacccccgttaaaacagcctttttctcccaaagtgaaagggaaaccccaacagatttggcccagggattttccccttggtttaaaaggggcccccttcaggggtgggggatttttagggtaacggggctttttccccttttccccccccctttcccccaaattgcccccttttaaataacccctttttttgggtggaaccccggcagttttgcccccctcctaggatttgcccccgccttggagcctgcttaacggggcccttttcccttttccaaagggttcccttttaggggggggggtgagtttttttgtaaaaaaattaacccaaagcccaaaaaatttacccaaaacaattat

SEQ ID NO: 675743 - DNA, 629 bp, Homo sapiens
attgtgaagtatcccccaccacctttttggtatgggacgctgctttccgggccaatctactccctaatggaacacgggaagtatcaaagtgtctagccaggcagttgagggctgttggaactgtgactcaaatggagggtgagcccaccccagttaacctcacagagcctgccaggctggagtttagtttgtcctggtcttgtccttcggcaccgtactgattcctggccaccgtctatgagaactatgccctcgtttattcctgtacctgcatcatccaactttttcacgtggattttgcttggatcttggctagtaaccctaatctccctccggaaaccgtgggctctctaatttatatcctgagttctgataacattgatgtcaagaaggtgacggtcaccggcctggtgagctgccccaagctttcgtaaccaggttgttcaggggggctgctcccactccatgttactttctgttgctttcccctgccccaccgccccccattagggcaaacttatagaccacgcctatggaagctccccttaacatgtgcccttgccggtaccctggtgccatgtcgcatgcaaaataaacttgttgaaggacctatagaaaaaaagaaaaaa

SEQ ID NO: 675744 - DNA, 287 bp, Homo sapiens
gcagaatgggtggcaattttgatttgcattttcagaagagggccatcagttgaaactaagtagggggttttttttttggcaagacttggactctttcccctggcctgtttcatttatttgtattatctgcctgggccctgaggggtttgggtctctcctctcccctgcaggtttgggttttaaactgaggaactacaaagttgatgattttttttttttttttatgcctgcaatttttcctagctccccctagggggatagtaaatttatacttttgtttcccccca

SEQ ID NO: 675745 - DNA, 339 bp, Homo sapiens
cagcgtttggaaaacaggttttgtgggaccccccgccccgccccccgcaatcctttatagcagcagtagtggcttttccctcctgttttttgcaaccttttatacaaaactgtgctgtgaccctgcggtaggcctgggtctggcaaaaagaatacaaatgaaaccccttctttctctttccgtcccacaactctgtagagctctttgcccccttacccctttcccccttttgtatttaattttaaagtcagtgtactgcaaggaagctggatgccagataaatactatatttaactgggctgttatttaagatgtaataaagccgtttgccctgaggga

SEQ ID NO: 675746 - DNA, 868 bp, Homo sapiens
  misc_feature (152)..(152): n is a, c, g, or t
  misc_feature (507)..(507): n is a, c, g, or t
tctataagaaacaggctcccaccagacactgagtctgctggatgccttgcatcttgtagatttccctaagcctccagtaacattgtggccaccagcacctttctctgtgttgctatccgtctcctagtgacctagcaggaagctcaatcgcnatcccgaaggccagtgctattccattcagtggagtgaggccgtcaagagatgttttgaaagggttcttgcttctatcaatgtgatgccatcatcgtgtccttccctcaggaccagtccagcttccacggggcccatggctttcgtttcttacttgtgcatgcgatggtgaggggtataagccaatcaccaaggatcacatcctttgggtcgatcacgggctgggtagctcggccagggccagcctttgagggtggatgacttcacggggaatccctgaggtacgccttggggaccgccactagtgtctttaccttccttctggtattgccctatcggattgtccggctgatatantagatctcgtggtgggtcttcctagttaaaggggagggcgtatactagcagtggctgtggacacctatactagagacggtcatctgggacctgcagtcgcttgaaggttcacacgatactggtccatctgtgaacccttgggccctgttatggccaacggtgcttttctacaccctttcccaagcccaaggacagagcattctgcacgcgacacactctgtttcaacggaaagctcacgccccctggacgacttcacattgaccgcgtgggggcggcgaaccaccgggctgacagtagcggctggccgtgccgactacctggtttcgccatgggccgcctctttgttggcacccggggggc

SEQ ID NO: 675747 - DNA, 554 bp, Homo sapiens
tccctagatattctggctcatgccaactctgctctaagcagagacatctttcaaaactccacattactccctacttccacatttcccatagtacccaagacatccacctagacccctgtggtacttctaactttcttctactcctccaacctcccaccttaaaacatgcaacttttccttatcccccatctgtagtcaaccccgctgtttaggcgcaaaacaccacaccaccgtctgcattacccttaaagagcccacccagtttctatcacagaagcagtatcccatcccccaagcagctcttgtaggcctaaagcctatcgtttctcacctccttgctagtcacctactctgcccaacaaaatccccttttaacacaccagttctatctgttaaaaaagccaggaacttatcgcttagttcaggacctcaggctcattaaccaagctgtctagtagttcctgacccatatacttcactttcatggcaagccaacgccacttatccagtgaaccactatcacgagaaaaactctacctctctatactaatctc

SEQ ID NO: 675748 - DNA, 90 bp, Homo sapiens
gcggccgcctactactactactactgctcgaattcaagcttctaacgatgtacggggacatggaagcaataaattccctttaagagatct

SEQ ID NO: 675749 - DNA, 143 bp, Homo sapiens
  misc_feature (61)..(61): n is a, c, g, or t
atagatgtctataatcgttctttatattagattagcgtactaaaaaatcgactatcccatngtcagttagcattacattgtctgagcaccagaaaataaaatccatatattaataaaaacctatcttgaaaaactagtggagt

SEQ ID NO: 675750 - DNA, 458 bp, Homo sapiens
atttgggccttattggccggccggtttattaggattcaagggtggtttaaaattgggaaaacggcctttggattattccttagaatttggcggttaaggcaaggagggcccattgttatttccaactttttaaaggaattgggagcacccccaaaggggttaaattacccattttaattggccccagtccttaggccacccccttggtggttgttataacttttaacttcctttaaccccttaatttgaggttgagtttaatgacagtttgtatttgagggaaggttggaagttttaagcttaaatcctggttaagggttccatggaattagggaattcaattaatttaagccattagaaaaggtttagattaccgaaggtttaactgttggggtttaaggaccagtttttttaaggatcagccttggaactgtttcttttaaagcctggtggaagtt

SEQ ID NO: 675751 - DNA, 492 bp, Homo sapiens
  misc_feature (331)..(331): n is a, c, g, or t
tcgagatagcaattcctcaatcatcaaggctacggcattggggatgatgaatactcctgtgcgtattatgtctcgccggaatgcgatttgggtacaatgccagaagtaagcctcaatacacccatgctggacagaaggagatacagtaggatttctgttagacttgaatgaaaagcaaatgatcttctttttaaatggcaaccagctgcctcctgaaaagcaagtcatttcatctactgtatctggattttttgctgcagctagtttcatgtcatatcaacaatgtgagttcaattttggagcaagaccattcaaatacccaccatctatnaaatttagcacttttaatgactacgccttcctaacagctgaagaaaaaaatcattttgccaaggcacaggcgtcttgctctgttgaagcaagtcagtatccgagaaaactgctgttccctttgttgtgatgaggtagcagacacacaattgaagccatgtg

SEQ ID NO: 675752 - DNA, 478 bp, Homo sapiens
caccttataacagtgatactgtgcttgtccaccgagttcagcagttatttagagcgtcatggtcttatcaacttcggcatctataagaggataagagaccccgtaccaactaaaaagacaggaaaggtaattattataggctctggggtctcaggcgtggcagcagcgtcgacagttacaaagtgtttggaagtggagtgtcacacgtttgggaagccaggggatcgtagtggagtggaccgacgttgaccacaatttcgacaaaaggacaacctaatgtacgctgactcttggcagccaatggatggttaaacagggatcttggacgggacatcctactgggctgtgggtcagcaagacaagtaaatatggaactggccaagatcaagcagaaaatgcccactttatgaagccaacggacaagctgttcctaaagagaaagatgaaatggtagagcaagagtttaaccggttgctag

SEQ ID NO: 675753 - DNA, 964 bp, Homo sapiens
tcgggctggcggtaaggagtggcagcggcaaggcagcccgttgtttcgcgaaggctgtcggcgcgccgtggccctgtagggcacccggcacagcggccgttccccgaggcacccggcatgcgtcattcccacgcgtcacgatagcccaagaggaaggtcagctccgccgagtgcgccgtcaagatgaagaccccaaggagggagatcgcgcgcggggtaggtacgcgtaaacctccctgcaaacagttggaagcgacagcccgaaaaacgggcacgcggcggagagggataacgttcttcagcaccaacacagttttgccaaaccaggcacggcgaacacggggggccccccacagggccaacacgcaccagcggcccgaaaggtttgggctataggccaaaaggagaattaaaccatgaaatgaactttaacgcgtgctcgcgacacagagaggcgggcggcacacccggaaagaaccttggaggcgaggaggtctcccaagcctttctgtgcatttgaaacgccagcgagcacgaaaagaggaccgccaacgtttcgtgcactttaaagtgtaccccaagttatttcccagagtgttcctgtacttcccagctgggttccccgtagatcttccccctttgcgtgtgtgacaaacttccccaggaagggcaaacttatcttttgtctagttccaaaccataattgcggggctacacacgtgccaaacggatttatgataaacgatacggcttcaaaagaagccagcttttttctctcacaggaaccgggaggcggtatatttccccaatcttttgaattccccaagttttgtatcgaacccgtttgatacagacttgcctttgtatgttacaacacgaggcggtggacccctcgtattttggggcgtgggcttaggctcacactttccgccggggacaaccacctcgaggacaaacacaacgg

SEQ ID NO: 675754 - DNA, 410 bp, Homo sapiens
  misc_feature (18)..(18): n is a, c, g, or t
  misc_feature (86)..(86): n is a, c, g, or t
  misc_feature (89)..(89): n is a, c, g, or t
  misc_feature (98)..(98): n is a, c, g, or t
  misc_feature (103)..(104): n is a, c, g, or t
  misc_feature (107)..(107): n is a, c, g, or t
  misc_feature (112)..(113): n is a, c, g, or t
  misc_feature (115)..(115): n is a, c, g, or t
  misc_feature (117)..(121): n is a, c, g, or t
  misc_feature (131)..(132): n is a, c, g, or t
  misc_feature (135)..(135): n is a, c, g, or t
tgcatacaacgcgttggnagctctccatattgtcgacctgcaggcggcgcgaattcactagtgattgtgagctgagatcgcaccantgnactccagcntgggnnacngaganngncnnnnnctcaaaaaannaanaaaaaaaaaggtccgggcacagtgtctcaggcttgtattcccagcatttcggaaggctaagggggttggatcccctgaggtcgggagatcgagaccagcttgacacaaattggagaaaccccgtttttactgaaattacaaaattagccgacctgtgtgacgcatgctttaaatcccagatactcggaaggctgaggcaggagaatcgtttgaccccgcgagacagagtttgtgctgagctgagatcatgcggttgcactcccagctttggggac

SEQ ID NO: 675755 - DNA, 289 bp, Homo sapiens
gatcaagtcagattaaattaatatttattcaagagctgcccaggcgggagtgcagtggtgtgatctcagttcaccccaaccctctcctcccgggttcaaggcttcttctgcctcagcctcctgagtagccggaacaacaggtgcatgccaccacgctcagcatgcatatatgtgtgtgtgtgtgtgtgtgtgtgtatgtatatgtatatgtgtgtgtatttttagtagagatggagtttcgccattttggccaggctggtctcaaacttctgacgtcctttccacctag

SEQ ID NO: 675756 - DNA, 380 bp, Homo sapiens
  misc_feature (51)..(51): n is a, c, g, or t
  misc_feature (70)..(70): n is a, c, g, or t
  misc_feature (99)..(99): n is a, c, g, or t
  misc_feature (132)..(132): n is a, c, g, or t
  misc_feature (146)..(146): n is a, c, g, or t
  misc_feature (195)..(195): n is a, c, g, or t
  misc_feature (263)..(263): n is a, c, g, or t
  misc_feature (348)..(348): n is a, c, g, or t
cacagccagtataaataggtacttgattgatgaccttggggaaggaatganttgtgcccagtatgctaanctagctattctgccttatgggtgaaaaantctactgtttttggcccaggcacagtggctcanacctgtaatcccancacttcaggaatgtgaggcggacggatcacctgaggttgggagttcaanaccagcctgaccaacatggagaaaccccgtctttagtaaaaatacaaaattagccgggtgtggtgcanatgcctgtaatcccagctactcggaggctgagacaggagaactgcttgaacccaggaggcggaggttgcagtgagctgagatcgnaccattgtactccagcctaggcaacaagagcg

SEQ ID NO: 675757 - DNA, 501 bp, Homo sapiens
agcccctctagatactcaaggaagatagtaagagaggacggagaacaaagagtctataaaacaaccaaatggcagtagtaagttcttacctatcaataataaccttggaagtaaagggtttaaattctccaatcaaaagacatagagtgcgtgaatgggttaaaaaaaaaaaccgatctcaatagtatgctgtctacaagagactcacctcacctgcaaggacatgcctagactgaaagtgaagggatggaaaaagatactccatgctaatggaaatctaaagagtggcaggagtagctatacttatgtcagataaaatagactttaagttcaaaacttttaatggagacaacaaacatcattttataatgataaagggatcaattcatcaagaggtcttaacaattataaatatatatgcacccagcattggaatgcctgaatatataaagcaaatattaatggatctgaatggacagattgactgcaatgcattcatag

SEQ ID NO: 675758 - DNA, 411 bp, Homo sapiens
ggtcacagcttcctgtataggtcctcgtccaggttattttgctgcactgcatggcagaggctcgagcattcacagcctgtgctaaggctatcagttctgctgcattctcctcattgcggggccgtaggtggccggacatgctgatcacagaaactggtgcagggcctgataagccaatgtgcagctggcgcagcggtcgagaaaacttggcgaagttcgtcaccacaaagtcgtgatttgccagatcgtggccgcaaggatttaaagctaatcttcttaggtactttgacctgactgacgatgcctccacggatgtagtcggagaagttggaggtgtcacagatgctaaaggtataaggacccaggactttgatctccatgggctgatttccgttgagttcaaccatgccc

SEQ ID NO: 675759 - DNA, 371 bp, Homo sapiens
gcctgtaatcccaggacttgggaggccgagccgagatcacgccatgcactccagcctgggcaacaaaaaaaaaaaaaaaaaaaaaccaaaaaaactagtggctcgggcgggcctgtgggcctaccgaaagaagctttctagaaaacccactccggtggggcccgcggggcgccaagtagtagggtataccagcggacatggtggaccaaacgggtcgctcccaaaggagacactccggggcgccagagacccaaggggcggaggggagtctttcaccccaaatataaaacaccgccggggggggcacccggagcgtgttcgtggaagcacacttccaaaaggggcggttcgggagggcacacaagcggggg

SEQ ID NO: 675760 - DNA, 816 bp, Homo sapiens
aagaacacagcttattagtgaaagagacctgtggattgaaatggctgcagatagatcccgctcatgcccttctgagaggaactgtgtagccactagggacctacactttggcaaaaagtgaacactattcatgtacgaatgaaggacagaacgctcagatgggacgaatggcgattgtgctacggccatcccagagagacgggacagcaggtgcgatactaagcctcagtccaagaattattcagagagttcaaactgttcactctttctcttctccatctaatcccctaatcaggtagaactagcacggccagtagccgaaagcagtgtgtagcttacagatgcgataagtgggtaaggtacaaatggattcagtgggagggatcaaggtgtccgtcgttggaaagtgtggctcgaaggaaactctcggccttgatccatgtgctcctgcagaagcaaatcatgcaattcaaccacttcgagttacaatgaaatacatggaaaaactggattgttcgatgaccaatgacgaagatgaggaaacggggaaaccccgtagcacaacgtgctcgttcaatcctgtcaggactttgtggagccagtgaatgcttgtcactataagcacaataagcatctataccccgttataagtgtgtccacggtgtagacctataaaccaacgattgacttcttagcgttactcaggtgtcccacttggtcacattggatgaaactctgcggttgtaggcacaggtggtgaagactaaaagggagagttggctgcatgctctcgacaagttgccaacaaagacaaca

SEQ ID NO: 675761 - DNA, 210 bp, Homo sapiens
tagcagaagaagaaaagatgcttctctccttggagatgcggcagaaccagactgaaccaaggcacccagcaacactggagggaaacaagtcggagccagccaacaactccatcttcgtgcttcctaccagcaaacagcatgcatccagggcctcccaggtataggtgacactctgcctataccctacatgccctttgagatgctgtgaaa

SEQ ID NO: 675762 - DNA, 133 bp, Homo sapiens
atacagaccatttgaattctctaaagggaaagggcaaaagcatctaatcacaatagagttgaagagagctagatctctctctctagtgctgagcctcactctgtcagctgagactaatgtacctgcttctcaa

SEQ ID NO: 675763 - DNA, 643 bp, Homo sapiens
cccagggcacacccattccgtggtagcccaattggattttccgaccacacggcccccatgctgccactgtgtgtcccctgttgtgtcgtctgtgcgctccccccgttgagtgtgccctcttgtccgcatgggctgatgtacacttggtcggccttggagagaagggcgttttgcccccggatggcacgttcctcacagaggggagccagactcttatctgcccgcccgagctgggggcggtcagtaggcctgggccaagccccctaacctgcctcgacagccaggctcctccaggcctactgggttgagcggagcacccctgagccgccaggccacggtgtgtagtagcccccagtggatcgcctgaactttcagggcaatccacgggggtcctgctctaagagagccagtcaccagcacctctccctgcagaccctggaagggggtcgtgcacgtgcctgtgtgtgtgtggctcgagtgtattctgcgcgtgtgtttgacggcgagcggagggaggggagcatggtgtctcccgctccccccccctttggtgagccccctcagctgcccccctttactttgcattggacggcctgtcccaagatcctctctgtagggcagcagagagctttttgcaccttta

SEQ ID NO: 675764 - DNA, 394 bp, Homo sapiens
  misc_feature (68)..(68): n is a, c, g, or t
tagatttgtaattagtcagtatttaatatattttacccattgagctaaagcaaaaaagactcattatntatgatgcacaggattcaaagatgcctaaaattctgtattaaaaactatgtacactggtaatttaaatgttaaagttctaatatgcacatgttttccatgagctttttgtgcctatttgttttctgaatttatttttcaggaccaacatccttaacttggaagggaaaacatctctgatttgaacttgtatttatgtaccattcaattgtttccaaatggtccaatgggtataccatattttactactcttatattttacggaaaacatgaaaaagactgagaaactagccatttttgaatacagcaagggatagatgaggaaagg

SEQ ID NO: 675765 - DNA, 408 bp, Homo sapiens
  misc_feature (60)..(60): n is a, c, g, or t
catagtcaaatcatatcattccaaccctggcccctccaaaatctcaaatcctcacatttnagaaccagtcatgcttttccaatagtactgcaatgtcttaactcattcaagcattaactcaatagtccaaagtctgagattttatctgagacaaggcaagttttttctgcctatgagcctgcaaaaattaaagcgagttagttacatcctagatataatgggggtactggcattgggaaaatgcagatattccaaatatgagaaactgaccagaataaagggattacaggccctaagtacatctgtctgatgaggcactatttaaggctccaggatgatcttctttaacttaatgtctcatatccaggtcatgctgatgcgaggtgggtttccatggtcttgagcagc

SEQ ID NO: 675766 - DNA, 184 bp, Homo sapiens
  misc_feature (15)..(15): n is a, c, g, or t
ctgccattactcttntgccgtcatcatttcattaaaaaaagaatatttcaacaacaacaaaaagatatggtatcaaataaagggcggtggggactcttacccatgggtaagattattgctgtattgaccacaggtgttcctgatgctcttccatgcaagtagagtagttcagagtgaacggatc

SEQ ID NO: 675767 - DNA, 216 bp, Homo sapiens
  misc_feature (47)..(47): n is a, c, g, or t
cgtctggtgcatgggggtggctgctcggtggatggactcgtctcagnctccagcgagacgctgcttggtctccatgtcagcacgctgctccaggtccagccgtgtctgctctctgcccatgggaccgtccagcaaggcactgaaacccatctgttcacaggtcgaactcccgctttgaggggacaatgaagttaaggtacgcttcttcctccccac

SEQ ID NO: 675768 - DNA, 248 bp, Homo sapiens
  misc_feature (22)..(22): n is a, c, g, or t
gagagggggtctcacggtccantaggaacatgtagaaggtaaccacggggtgacagggaagtcggcggtatttactacctagcccccatcttcacttggttattccacttatttaaaatggtccagaaataagcaaatctccatatagcaggaagtagataagtgggtggcttcggggatgggaggaatggggaagcatggaggtctttcgtttggcaggggataaaattggtcctaaaaagtggact

SEQ ID NO: 675769 - DNA, 534 bp, Homo sapiens
  misc_feature (3)..(3): n is a, c, g, or t
  misc_feature (5)..(5): n is a, c, g, or t
  misc_feature (17)..(17): n is a, c, g, or t
tcngnccaaccccactncccccaccgggcccaaaagggggaaaagggggtttaataggggaaaatccggccctattttaaagatttttaggggaattaattgtaggacgaattgcatgaaactgtggtttgctccaaagatttccaagaattgtccgtattatacccccagtcatgtaacggctaaagtggttttgtttaacccaccgggaaatgcatccatttttaagcctaatggggggacagcttatgatcgcaaaacgacttgggatgttaaattaatccaatgggggcttaatcgcgaggactacttgatgttaatgcaaagagtccaaggtccctctgtttagaactattggggaagaattttgcattcaagatacatccccttctccgagtaaccattgttcacaaaccatgtgccccattttattctttggaccggagggcaacagtcccgtgctttctctatatgccacctagggcgtcgttgccctcttcccattaatttcgccgcaccctttactttctctct

SEQ ID NO: 675770 - DNA, 425 bp, Homo sapiens
  misc_feature (78)..(78): n is a, c, g, or t
ccaactcggttcaggctcatcaaagctttcaccttatgaagctggggctttgtgcatccttgaccctgtaaacatttnccctacccctgcccatcattaagacattcctcactcaaatttgacccatattaaaatttaaaatttcccatcccataaaatgaagactgggcttgtaatcccagcactttgggaagccccaggtgggtggatcacctgagctcaagagttcaagaccaccctgggcaacatggtgaaaccccgtctctactaaaatacaaaaaattatccaggtgtggtggcgtgcacctgtagacccagctactcaggatactgaggcaccagaatcgcttgagcctgggaggcagaggttgcagtgagccgagatcgctccactgcactccagcttgggctacagagtgagactc

SEQ ID NO: 675771 - DNA, 217 bp, Homo sapiens
gtggtggtggaattccacgtgcaaccaagcccggctaatttttgtgtttttagtagagactaggtttcaacatgttaggctgatctcaaactcctgacctcgtgatctgcccgcctcggccttccaaagtgctggggttacagacttgagccactgcacctggccatggggtggtttcttaattagatatagctgaaaagaacgctagaccaaatag

SEQ ID NO: 675772 - DNA, 156 bp, Homo sapiens
ccacaaaaaaacatatgtgtgtggggggggatcacctcaagcagctcagccaagatcatcaacatgtccctctctgtcttgctccccaacatgaatactttgtgtatgtgactgtatgtgaaccagattattttggtcagagctaaaacaatcata

SEQ ID NO: 675773 - DNA, 285 bp, Homo sapiens
  misc_feature (209)..(209): n is a, c, g, or t
tctagaggatcctctggctcagtgatcctcctgaatagctgggacacaggtgcgtacaccacacctggtaatttaaaaaaatttttttttttggtagagagagtgctcttcttggtggcaaggtggatctcagactctgggcttgagcagtcctcccaccttgtgctaccaaagttgtaggattacaggtgtgagcggccatgctgggntggcttctcttttggtattctaaaattcaaaggcctaagttatcaaatccctaaatctccaaatacggtcacagat

SEQ ID NO: 675774 - DNA, 881 bp, Homo sapiens
gcttcatttcctgttcctggcatctggggattccgagaatgatcccaggacctagatccgtatagattccgtgccagtcatcgttcctggcaaacgagcaatgcccttgttagtgtgccatgagtccttgactctccggcctggagacatccatctgcccactctcctaggaactgctgattaccaggaagtcaccatcggctctgcatgcccttccctcctggtcgagagatggcatcaagtgaccacattattgttctcttccagcttcacgttacagcagtggaagcgtgttgccgagttggatttcactgtcgttcaggtgaggatgaactgagactttcacactggaagatagttgaggaacgagtccttaagtaaccaagaaggagtggtgtctaaggcggagctttgggaagccagggaacggatatcgtgcccatagaatttcatagacatccagtgttcccagatggtttcacgaagggcctctctcgactccaggcagacgaacttagtcatgggcaaggagggtgggcgttcttcatcactccgggaccagccagagctccccaggcgacttctccatctctgtcaggcatgaggagtgacgttcaaacagcttcaaggtcatgcgagacagtccagggtacttactttctgtggacggagaagtttccatccctaattaaggcgggtagactactacgtggaccaagttccagctgccagactgtcagctgatcttgccttagagactgaacccgagaaagaaccagggttcaccgggccaaaggctggaccggaggtcccagggaggcccactcttagaggggtgtggaaaaggattcgaccttcgatgaccggaagcgtcggttccc

SEQ ID NO: 675775 - DNA, 200 bp, Homo sapiens
atccaccgaattccgttatctcctgacgtttctgatttttccactatgcacaccttttcagcatggttataactaggtattcttcccctctcacgccccatgggtgagtgagtccttgttggtgttgccttttagtttattcaatgcgatatctgtatcctaaccatgccacgactataagaggggataagtttacagac

SEQ ID NO: 675776 - DNA, 318 bp, Homo sapiens
tgcgcgcagaggtatacccgggtatgcatgcttacatgcccgcacctctctctagctcgtagtaccatgccctatctgaggccacccattgctcaccagtcagatcaatcttagcctggtacatcataaatgtatgcaccaaatgtgatacttcacttagtacactaaattattaattcacttgcctccaaaattgttctctctgaggctgagcattataacacaatgatctctgttccttttcattactgaaaatcgcctggagcttatttcagaacaacttccacttattatccattgacccccaaactccctaag

SEQ ID NO: 675777 - DNA, 795 bp, Homo sapiens
attcggaacgaggaaaaccgttcagttgggccgggcgcagtggctcacacctgtaaccccagcactttgggaggccgaggcgggcggatcacgaggtcaggagatcgagaccatcctggctaacatggtgaaacccatctctactaaaaaaaaaaaaaaaaaaaaaaaagaaaatattgtaaacctagtggcttataaacaacagaaatcagtttcagttttggaggctggaagcccaagatgaaagcaccagtagatgcaacctcttttgtaagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 675778 - DNA, 1119 bp, Homo sapiens
  misc_feature (77)..(77): n is a, c, g, or t
  misc_feature (302)..(302): n is a, c, g, or t
  misc_feature (403)..(403): n is a, c, g, or t
tccacctcctgggttcaagcgactatcctgcctcagcctcccgagtagctgggattacaggcacccgccatcatgcncagctaactgttttatttttgtagagatgggatttcaccatgttggccaggctggtctggaactcctgacctcaggtgatccgcccgcctcagcctcccacagtgttaggatgcaggcgtgagccactgcgcccggcgtaatttttgtttttagtagagatggggtttcatcatgttggccaggctggtcttgaactcctgacctcaggtgatccatcttcctcngcctcccaaagtgctgggattacaggcgtgagccgccacgtccggctaacaagtacttttttatttttattttattttttggatggagtctcactctgtcncccaggcggaggttgcagtgagctgacatcgtgccactgcactctagtctgggtgacagagcaagactccatctcaaaaaaaaaaaaaaagaaaatattgtaaacctagtggcttataaacaacagaaatcagtttcagttttggaggctggaagcccaagatgaaagcaccagtagatgcaacctcttttgtaagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 675779 - DNA, 186 bp, Homo sapiens
gacgctttgtgtgtcatgcactacggggattaagtacagtcccccaagatgagctgagcccccagagagagtctgacgtacaagtaacaggcccagtctcaggccccaattcgccagcctctccccgctctggatcctgactctaacactcgattctagtgctcatgggaagaacagaattgctcc

SEQ ID NO: 675780 - DNA, 1076 bp, Homo sapiens
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttactccagcctggccaacatgatgaaaccccatctctactaaaaacaaaaattacgccgggcgcagtggctcagccaactgaacgttttttttttttgagatggagtctcactctattgcccaggctggaacacagtgagctgacatcgtgccactgcactctagtctgggtgacagagcaagactccatctcaaaaaaaaaaaaaagagaaattttggtaaccctaggggtttataaccaacagcagaaatcagtttcagttttggaggctggaagcccaagatgaaagcaccagtagatgcaacctcttttgtaagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 675781 - DNA, 831 bp, Homo sapiens
  misc_feature (63)..(63): n is a, c, g, or t
  misc_feature (65)..(66): n is a, c, g, or t
  misc_feature (77)..(78): n is a, c, g, or t
  misc_feature (87)..(87): n is a, c, g, or t
  misc_feature (93)..(93): n is a, c, g, or t
  misc_feature (97)..(97): n is a, c, g, or t
  misc_feature (111)..(112): n is a, c, g, or t
ttgatctagcaggatcctatcccggctctgggtatgcggaaattggtcgggcgcgtggtgggngnntgtagtcccanntgcttgggnggctgnggcnggagaatcgcttgnncccgggaggcggaggttgcagtgagctgacatcgtgccactgcactctagtctgggtgacagagcaagactccatctcaaaaaaaaaaaaaaagaaaatattgtaaacctagtggcttataaacaacagaaatcagtttcagttttggaggctggaagcccaagatgaaagcaccagtagatgcaacctcttttgtaagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 675782 - DNA, 230 bp, Homo sapiens
agaaaaccccccagttggagggaggggggcttaaaaagccccttccaatgtatcttttcccaaatgaatttagcagttgtccttggtgagatgggatattggcgatttatgccttgtagcctttcccctgtggggcatttgtggtttggtaaaagtacaacaccaacctgtcccttctgggcatgttttggtggcatgtataatgcaataaactctggaaatgggttcca

SEQ ID NO: 675783 - DNA, 834 bp, Homo sapiens
  misc_feature (77)..(77): n is a, c, g, or t
tccacctcctgggttcaagcgactatcctgcctcagcctcccgagtagctgggattacaggcacccgccatcatgcncagctaactgttttatttttgtagagatgggatttcaccatgttggccaggctggtctggaactcctgacctcaggtgatccgcccgcctcagcctcccacagtgccgggattacaggcatgagccactgagcccagccagaaacatattaatactataaacaacagaaatcagtttcagttttggaggctggaagcccaagatgaaagcaccagtagatgcaacctcttttgtaagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 675784 - DNA, 499 bp, Homo sapiens
  misc_feature (317)..(317): n is a, c, g, or t
  misc_feature (376)..(376): n is a, c, g, or t
  misc_feature (399)..(399): n is a, c, g, or t
  misc_feature (454)..(454): n is a, c, g, or t
  misc_feature (479)..(480): n is a, c, g, or t
agccttcctcgtaaaagtagcacaagcccacttatgaatcactgagaaaaagtgaaaaacttgagttggcaaagatgcagagcatgcagtgcagatggcacatgaactctcctgaattcctctttttaccttaaatttagacagaatggcacgagctaacagggaccttttttccccttgtgggtttcctgcaggaacttcttttccaaaaccgcgcggcattttgaaacgcgggaacggaaaccatgaaaaaccaccctttaactttccccaaacgggtttgggcccttcccttaattctcgcgtaatttaacccngagattgactggaagcttcaagacgacaggcaggcaagtatacaagcccaaggcaaggncccaagctttcctgggggttaantaaaacacaacgacatttcgaacaggggaacaatggcgacaggggtccttttccntttttccaacccaactccccttacnncttctatgtgatcggaaag

SEQ ID NO: 675785 - DNA, 1051 bp, Homo sapiens
  misc_feature (261)..(261): n is a, c, g, or t
  misc_feature (263)..(264): n is a, c, g, or t
  misc_feature (275)..(276): n is a, c, g, or t
  misc_feature (285)..(285): n is a, c, g, or t
  misc_feature (291)..(291): n is a, c, g, or t
  misc_feature (295)..(295): n is a, c, g, or t
  misc_feature (309)..(310): n is a, c, g, or t
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcactttgggaggccaaggtgggtggatcatctgaagtcgggagtttgggaaaagcctggctaacatggtgaaaccccatctctactaaaaaacaaaaatacaaaaagttagcctggcatggtggtgggngnntgtagtcccanntgcttgggnggctgnggcnggagaatcgcttgnncccgggaggcggaggttgcagtgagctgacatcgtgccactgcactctagtctgggtgacagagcaagactccatctcaagaaaaagcaaaaacagcgaaatcttttcgtgaaccctaggggcggctttctgaaagcagctgaacatcggttccagtgtggaagagctgggagtcccatcgttgagagccgcgcgagaaaatgcacccgcctttggtcgaggctgagtgtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 675786 - DNA, 418 bp, Homo sapiens
caaatgcagctggtagccttgcgcacgggcttccacctcaacgtaatagcgcgaatccaccagaatgtgcgcactttcacggctaatcaccacataacctgatccggtggagatccccagatgcggctgtttgttctgccgtgaggagagaagcactgcatccagttgttgcgccttaagccagctgcgcagcgaagcgagtaatgtcatctggattttccttcttacaggctatcgattaacaatttgcctttacggaacatcatcagacgcaggaacaccaccatcagcgcagttatgactgcccccagcgcgatccccgccatatagacgcccaggttagtgaccagcgccatgcccagatagcggactccgggaaccattgcactgcgcccagccagacagcggcggttgagcc

SEQ ID NO: 675787 - DNA, 1287 bp, Homo sapiens
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgctgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccaccgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtgtcactgttgactagacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagca

SEQ ID NO: 675788 - DNA, 1454 bp, Homo sapiens
  misc_feature (77)..(77): n is a, c, g, or t
  misc_feature (302)..(302): n is a, c, g, or t
  misc_feature (403)..(403): n is a, c, g, or t
tccacctcctgggttcaagcgactatcctgcctcagcctcccgagtagctgggattacaggcacccgccatcatgcncagctaactgttttatttttgtagagatgggatttcaccatgttggccaggctggtctggaactcctgacctcaggtgatccgcccgcctcagcctcccacagtgttaggatgcaggcgtgagccactgcgcccggcgtaatttttgtttttagtagagatggggtttcatcatgttggccaggctggtcttgaactcctgacctcaggtgatccatcttcctcngcctcccaaagtgctgggattacaggcgtgagccgccacgtccggctaacaagtacttttttatttttattttattttttggatggagtctcactctgtcncccaggcggaggttgcagtgagctgacatcgtgccactgcactctagtctgggtgacagagcaagactccatctcaaaaaaaaaaaaaaagaaaatattgtaaacctagtggcttataaacaacagaaatcagtttcagttttggaggctggaagcccaagatgaaagcaccagtagatgcaacctcttttgtaagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgcaaatggtgtcctggtgttcgcagcagaactgctcatggtaatggataagttgttttcatacagtgggttgtcaatatgtttaataattgttggtatctattaataagggcaatatattcatatggtggattatttggctattaaaatggaatgaagttattttaaaaaaaatggtgatggctggtgagtggatttacagtgagtaggtcggagctttgatgctatggtctacactcgttcgaaaaggggcacctgcggtgggaaaccgcgtggaaccgcggggattaaggggaagggaagagcgaattgtcaagaattggacaaaaaggggt

SEQ ID NO: 675789 - DNA, 728 bp, Homo sapiens
gcttacatggtgataagagtttaactctgatagccaaggatgactgcctgggaacttcttcctctcatcaaggcttagcttagccttgggtgtgggtatatcacaggtggtctccatggctagcccgagtgactcttatcgttcatgctaggctaaatgtatcttttaactgattcgttcatgcgataggatttagagaagagtttattatgctacaaattgtgatgttgtgtgtgtgtgtgtgtgtgtgtgtgtctctgcatgttggtaggagtttatcatctcaggtgccttactcatgtgtaataaaagttatgctagccagtttcaagactcaaaaaaaaaaaaacaacacaaaaaaaaaaaaaaaaaaaaaagagaacaaaaaaataaaaaaataggggggggggcgccaaaagatactccccgggggggggaccacatccatcgtcctaatccgcaccgttttgtcgtacaacacagggggcgctacaaatagagggcgccgccttattacatactgttggagcaaccgcgggcgcgcgccttcctaacacacccgtcctccccgccgctgggacgatcccgcgctgcacagggcacactcccgtgggacgacaccccccaccaacgatgggggggggcgcacacaagtgccggcccacctcaccccccacgagattaccgcccccgtggggacaaccacaacgttgccgcgagcaaagcgg

SEQ ID NO: 675790 - DNA, 234 bp, Homo sapiens
agtgagcgagatcgtgcactgtacccagcctgggggacaagagcgagacttcatctcaaaaaaaaaaaaaaataagtggggctttgttggtgcacattcatatagccccagctatgtgggaggctgaaacaggaagattgtttaaccccaggagttcaaagtaacaggaagtaaggatcccacaactgcccctcacccttgggttacagaattgagaccactgtctaaaaaaaa

SEQ ID NO: 675791 - DNA, 173 bp, Homo sapiens
gtactctctatcatctgctttctttgcctagccaatgtaacatgccaattattgcccagatgacaacacagacaccgataagcgctatagcagtaagcagaacaatattactatggtgtaagataccgttgggaactaccaaacttcgcagggaccttagtgcagggtatagg

SEQ ID NO: 675792 - DNA, 1373 bp, Homo sapiens
  misc_feature (1139)..(1139): n is a, c, g, or t
  misc_feature (1187)..(1187): n is a, c, g, or t
ggcagacccagcgccgagcccgagccatggcgtcgagcggctccctaacaggcccgcctgtctgctcgtggccagcggcgccgccgaaggtgtgtcggcccagtccttcctccactgtttcacgatggccagcaccgccttcaacctgcaggtggccacccctggggggaaagccatggaatttgtggatgtgactgagagcaatgcacgctgggtgcaagacttccgcctcaaggcttacgccagccccgccaagctcgagtccatcgatggtgcccggtaccatgccctcctgatccccagctgtcctggggccctgaccgacctggccagcagtggctccctggcccgtatcctgcagcacttccactctgagagcaaacccatctgcgccgtcggccacggtgtcgctgccctgtgctgtgccaccaacgaggacagatcctgggtgttcgacagctacagcctgacagggccctctgtgtgtgagctcgtcagggcccccggcttcgcccgcctgccgctcgtggtggaggacttcgtgaaggattcgggcgcctgcttcagtgcaagcgagcctgacgctgtccacgtcgtgctggaccgccacctggtcacaggccagaatgccagctccaccgtcccggccgtgcagaacctgctcttcctctgtggcagccggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtgtcactgttgactagacagagtcggctcgggggtcctctgtgtgggtttgccctgctgtggcctgtctgccacccaccacctctttcactgttggtgggggccttgaggggagggcccagccggngggagctggctcagaactttggccaaaggtgaacggaattttttaggngcagcagcctcctgccccaaggccgaccggcactggcagcactttcctgttgaagaaatcttcctggcgtgtggtttcaaagtgtaagcacctcagtgatgcaccctgtcctaagcattgagaggcacgtttacttgtgaatatgagaccatgagattctcaatgataggaaagtgctgtcccccc

SEQ ID NO: 675793 - DNA, 120 bp, Homo sapiens
cttgtaatgtcgggcggagttgcgtatcgatgggcagtgcggaggcgcatatgatctaggctatatatccggagtatacgtagcggtaaggtaaaacggtactctagactatagtagcat

SEQ ID NO: 675794 - DNA, 1278 bp, Homo sapiens
  misc_feature (77)..(77): n is a, c, g, or t
  misc_feature (302)..(302): n is a, c, g, or t
  misc_feature (403)..(403): n is a, c, g, or t
tccacctcctgggttcaagcgactatcctgcctcagcctcccgagtagctgggattacaggcacccgccatcatgcncagctaactgttttatttttgtagagatgggatttcaccatgttggccaggctggtctggaactcctgacctcaggtgatccgcccgcctcagcctcccacagtgttaggatgcaggcgtgagccactgcgcccggcgtaatttttgtttttagtagagatggggtttcatcatgttggccaggctggtcttgaactcctgacctcaggtgatccatcttcctcngcctcccaaagtgctgggattacaggcgtgagccgccacgtccggctaacaagtacttttttatttttattttattttttggatggagtctcactctgtcncccaggcggaggttgcagtgagctgacatcgtgccactgcactctagtctgggtgacagagcaagactccatctcaaaaaaaaaaaaaaagaaaatattgtaaacctagtggcttataaacaacagaaatcagtttcagttttggaggctggaagcccaagatgaaagcaccagtagatgcaacctcttttgtaagggtgatggtcccatgatgaggctgtgcccctgccctgtgaccggatgacctcccaaatgccccacctaataccatccccttgcaggtgaggacttaagcaggtgggttttggggggacgtgctcaggccacagcagggtgcatgaagagccagtgagcctcattgagcccctctggtcagccagatctgacattgagcccagcattgaagatcaaagcaggtggggctttgggatgtgaagtgggttctgacgcggggccccacagacctgtctccgcgtgagctgcctgcaggcccctgcgtcattcctcagctgcgtgcgaggcctctggcttggagagcctccccgctgtgcacagttctctctttgccagggcagggcttggggcagcaccaggctggggcagaggaggaaagcaagaggacagacctccagaagagcagcggagggcgggtgaggatttccccatataccagtgtgtgttcatctacccatgaggaataaaaccatgcagcagcatgcaaatggtgtcctggtgttcgcagcagaactgctcatggtaatggataagttgttttcatacagtgggttgtcaatatgtttaataattgttggtatctattaataagggcaatatattcatatggtggattatttggctattaaaatggaatgaag

SEQ ID NO: 675795 - DNA, 917 bp, Homo sapiens
gacctagcatcagttcctccatcttccttcaaaattggtgcacattgacagaatggggagaaagatagcagggtggggggtggggcatgtgcccataggtctacatcctaaggtcaccttctgctctttgatggggattgaggcaaagagtgaaaaatttgtgttctgttgaatccaaaaggaagaagcaaaatgtgtcccaagacttctgttccatggaggaatttttttaactataaaaatatcatatatatatgaaaaaagagaatgctataagaaacaccaccaagattaagaaataaactattacaaagaaaaactgtgattgtagatttcttcctaatagcatcacctttcttcaaaccacaaccctgaaatttgggtgttagtaactcccagggcatgttcctcatatttttaatactatacttctatattatttcctaagcagacatttctggtattaatttgtggccattgtttcttaaaaattttggtagaaccccttggtttttgggtaacctggtggggtattccttttcctgccaggcattggggtctgggtaataaggcatccgaacacggtttgaattgggtacattgggcgcgggaaatttttcaatttccccattaatcgtgggtttgaacctctggtgtagagagttcccccccaaattgggggagttctccccctcgtttgtttttgtacaaagagttggcgcctaaatacatttagggaaggggttcttccacagcattctcacattagatgtgggaaaaaagcagttctaacacaatttccacagagtgttgagaagacaccataagtgatggcgcgtgcgccgtgtagaatttggggaagattagacgcaccaccctcttgttccgaggaaagttggagcgatctcaccaagaga

SEQ ID NO: 675796 - DNA, 486 bp, Homo sapiens
  misc_feature (465)..(465): n is a, c, g, or t
gttagtattggtggtaacatatgcaactatagcctcaaagtccaatgcatgtatatttgctctcaggtgaactttaatgccagagaaaacatcctgaattgacccattttcccactcttgtggtcctttgactacatactgtatttagtagaaactatattaaacataaagaattaaaattttcatttggtcagtattctatagaacgtggaaatgtccacattgcttaggtaggtcacttacagcagccaatgggaagatgtcttcagacaatgttgctttgctgcctgtttggatccttgtacattttactttacaagagagattccatagattcaaacaaatgcctgaactccctatgttcttctagcacagtgtttataagtaggctggagcttcaataatgaagatctcctgccaattccactaagtctaagaactgacaactctcaaaatgctttttcntccttgtgacttaatggttct

SEQ ID NO: 675797 - DNA, 161 bp, Homo sapiens
aacaggacaggcataacgaaagttaactaagctatactaaccccaggttggtatagcttagttaaacttatcgtttctggctaaaggttaatcactgctgtatcccgtgggggtgtggctaggctaagcgttttgagctgcattgccggaagcttgatcca

SEQ ID NO: 675798 - DNA, 356 bp, Homo sapiens
cgcgatcgcttcctctggtgctccaccacctacaactttgagaaggatggccacgtacggcttctgtccccatgaagccctgttcaccatgggcggcaacgctcaaggacagccctgcaattttccattccgcttccagggcacatcctattacagctgcaccactgaggaccgcacggattgctaccgctggtgcggcaccactgaggactactaccgcgacaagaagtatggcttctgccctgagaccgccatgtccactgttggtgggaacccatagggtgccccctgtgacttccccttcactttcctgggccacatatatgagagctgcaccagcgccagccgcatcgtgc

SEQ ID NO: 675799 - DNA, 200 bp, Homo sapiens
ctcatataggagtagtaacattttggctcatgaaagtcaatagccctttcatctccttagaataattgtcccatctccactgatggtgactaccatgggaacataacccacgagattaagcagagaacttccttgcatcgccttggaagggctattcccgttcaggagacttgtggcccggcagcctatcggggcaatat

SEQ ID NO: 675800 - DNA, 374 bp, Homo sapiens
  misc_feature (7)..(7): n is a, c, g, or t
  misc_feature (20)..(20): n is a, c, g, or t
aggccgntgcggttttgtgntggtacgcctcatccctgcccccaggggcactggcatggtttccgcccctgtgcctaaaaagctgctcatgatggctggtatcgatgattgttacccctcagcccgggggtgcactgcccccctgggcaattttgccaaggccccctttgatgccatttttaagacctacagctccctgccccccgccctttggaaggagactgtattccccaagtttccctatcaggggttcattgaccccctggtcaagaccccccccagagtttccgtgcaggggactcaggctccagctgtggctccaacatagggtttttatccaaaaaaaataaagtgaattaagggtgttcctgtta

SEQ ID NO: 675801 - DNA, 131 bp, Homo sapiens
tacctgctacttgtcaccttctactggctctactacaatctgccatttgtcctctggttaacagtcccttcctgtacaggtctaaaagtcttaattctaaatccacagtttaattcacaagctagtacttg

SEQ ID NO: 675802 - DNA, 898 bp, Homo sapiens
  misc_feature (13)..(13): n is a, c, g, or t
  misc_feature (17)..(17): n is a, c, g, or t
  misc_feature (22)..(22): n is a, c, g, or t
  misc_feature (30)..(30): n is a, c, g, or t
  misc_feature (36)..(36): n is a, c, g, or t
  misc_feature (38)..(38): n is a, c, g, or t
  misc_feature (84)..(84): n is a, c, g, or t
  misc_feature (563)..(563): n is a, c, g, or t
ccttggcgggctntttnacttncactgtgnataagnanaacagcttgctattacttcaagtttttttggaaaaaacacctgggnaaattcatcgcaagaagatcatcacctaggcacatcgccgtcaggttatccaaagttaagatgaaggaaagaatcttaagagctgtgagacagaaacaccacgtaacctataaaggaaaacctatcatattaacagcagatttctcagcagaaaccctacatgccagaagggattggagccctatcttcagcctccgtaaacaaaacaattatcagccaagaattttgtatccagcaaaactaaacctcatatatggtgcttagctatttattttgttatctattgttgttgctcaaactgttcaagctttggccattgggagctctttcacattggctcttgtgtacttttggcatgccctcatccactttgtttggagcacttcctctttctggcaccacaggatgctccaggctcatcttgtgttttcttctctgcattggccctagacttagtcatttctcctaggagccctggntcttttcttttttttttttttgatgaatggccttagaaacccagatcttggtgatgggggtgctcattgctactgtgatgacactgcttctcccatttctaatgaacagaactaggaatttttgtttgggtcccaccccatgtctctacctatcctcattctggtgccttcctgctcattccttagactcaacgttacttccctgtgctttacaatggttgagggtattgttggcaaaaatacaatccggccctctcttccccaccctcccaaatcggtccacaggcaagcgaactcagttgcgtgtcttttaaacccaacagtgcatattttgc

SEQ ID NO: 675803 - DNA, 267 bp, Homo sapiens
gttcccttccccaagaaacctattagatattatagtatccaatcatttatgacatggtcttcatagtacaatcccagctaggctagatattcccagtacatcatgaactcttctgttgctgcctccatgatggtcagcaacattcttaagaggtttgcagagtttaatcctccacgactaggtacatgaccagttcacaattttttattgcatatatattatcaaagttcttttgagagacacccctttctccgcgatctaagtgtg

SEQ ID NO: 675804 - DNA, 362 bp, Homo sapiens
ggcacgcgagggaagtgtagacatatggagagacacaaacacagttgtgcgatatagtgtattttcaaagacaccaagatgtgggaaatgagaaattattggtcactttcctgtttcatgaaactttggcttaagaaggtgctggatttcaagggttgtgaaggcatattggtaaagactggtttttgagatgcgtatgaatttgcgattaacttgactgaggtgattctgaccagacttgaggggtttaaggcggaaccggttaattttaggggaaatggaaaggcactgtgttccttatagcgcaacacaagtatctttcacatatattataagtgggctctcttagattaagtctcttc

SEQ ID NO: 675805 - DNA, 465 bp, Homo sapiens
tctcgatgcgagtgtcacaagaaatagttagtaggccgggcgcagggcttacacctgtaatcccagcacttgggaggccgaggcgggcggatcatgaggtcaggagatcgaggtttcagtgagctgaggtcgtgccattgcactccagcctgggcaacagtgtgagactccattaaaaaaaaaaaacaaacaagtgttttatttaattactgcaaatttgtgaatttggcagttttacttatgtctatttatttctattttttatcccatggtactcagagaagatacttggtatgacatctactttttcaaatctattgacccttatttagtttatgggcttatacatgttctatcctggaacatgtcccatgtgcacatgagaagaaggtgtatccaatggttgttcaagtcctctatttcctgacttacctatggtagggctgttctatccactgtcaaaag

SEQ ID NO: 675806 - DNA, 187 bp, Homo sapiens
  misc_feature (2)..(2): n is a, c, g, or t
  misc_feature (23)..(23): n is a, c, g, or t
  misc_feature (64)..(64): n is a, c, g, or t
  misc_feature (93)..(93): n is a, c, g, or t
  misc_feature (162)..(162): n is a, c, g, or t
gntaggacactggtgtggtcctntggatggggcccattctgccctgtgtcggaggcgcccttgntggctggggctgccctgggcccacaggtncaagttctgggtggaacagaaccgactgaataaacccactgccctacagccgcgtggtgcacacctacngcctccccagctgtggctgccaccc

SEQ ID NO: 675807 - DNA, 361 bp, Homo sapiens
cccgaccttgtcctcaggaatgtgctgactttttttaaggtcgcgtccctgtaataaagtattgggggaaagcatgtaactgacaaaggcctcttcaactttaaaatgtgacctgacctgtaaggagaggcgtgtcctctgatccagaggagagagactctgatttccctgccccgggcccttttcagcactccctgggcgctttgaacccctcctttcacccaatgaaaggaactcccctcattacccctctgcttattatgttattgtatgattttgttaaacttactggaaacaactcccaagcgtttttgtagttgctgtatttttttaaagaccaactaaaaaggctggagaaaga

SEQ ID NO: 675808 - DNA, 743 bp, Homo sapiens
gaagcgtccgcgccgcgaggagtgaggccctgctggattctgtgcggtgctcttgtcaagatggtgaagctgttcatcgaaagacctgtccccgtggaggctactagagcagcgagattcgctcactcttcgagcagtatgggaaggtgctggaatgtgacatcattaagaattacagggtttgtgcatcatagaagacaagacggcagctgaggatgctcatactgcaacctgcagccattacaagcttcatggggtgaacatcaagcgtggaagtccagcaatgaataatgagcaagaacctctaacaaagttgcatgttggcaacatcagtcccacctgcaccaataaggagcttcgagccaagtttgaggaggtatggtcctggtcatccaatgtgacatcgtgaaagattatgccttcgtacacatggatcgggcagaggatgcagtggaggccatcaggggccttgataacacagatgtttcaagtgcaacaccgagatgcaccgtgcatgtatgtccagccagtccggcgttatcactgcgcccgggatgggagcaccagcagcggctgctatcggtgcggtgaaacgcaggggcactggtccaaagagtgtccgatagatcgttcaggccgctgtaggcacgacttgtaccgacgcaatataatgagcaatacggagcattgcgtacgccttacaccatgagctatggattcattgtattacaactaacgcgtac

SEQ ID NO: 675809 - DNA, 1276 bp, Homo sapiens
gtagcctgtctgccttcggagcgaagggtacctgaccctggcagaagctcgtgagctctcgtgtggtatcgatgtgatagtgcatgtgccctgctgtgtgctgcactggtgctgatgctgtgtgcctggtgatgcctgtgatgctgtgctgtgatgtgatgcctgtgcatgcatgcttgtgcttgcttgtgctgtgtgcctcccatgtgcttgatgtgactgtgttctgaagcttgtcattcccttttgaacacagaccgtatagacctggctggctggcttgactttcctgtctaggcctcatacctttggtctaccccccttggtggaatgtctcggaacttcggaaaacgtgtgaaactttcagggggttccccagggacttaagccgcccgccctttggcctgacccactggccccaggctggctctaccgtataaacccctgtctgccgaaataagccgatctgggcctcttttggcgtgttaggcccgttactttgggtttggccccctttcggacgccccaaacagctttggtgttttcaccccaagtggctctgaaacacccgcacatgggagcgcggcccataaaaaccgttccccagaaaatagtttttccgtgcccgatttatgggcagcacggcgattattccccagtgagatggcagcactggcgtattttcccctttggcggcgcgccgtttaacatattttcccttttgggccacattttttccccacatattttccggaaaacaagcttgttgtgccccatttgggaccttggcacggaacattaacacccttttgcggcgatagcttgtgggccacgccttcattccttatcataaacatttacctgggacacaggcacatttggggcgcccgacttccctttggttggcacccacttgtgggtaaaacttttgcccccctgtagggcccacaaattttacccaaaggtccattagcacactttttaacaatatgcaccgcttttacttacatatgaatattgcgctacatacaatcgcgacccactattttattcacccccatttttttggcggacacagtaaatagtcgcccacatttttgtggcgcgcttgcaaccgtgtgagtaaaaaaaagacgctctccgccgcgcggacgcaacaatgtgggcagcacaaaacatactcccatgctacttttagcgtttccaatctggggcgaaaaaacgggcgcccgctctttttacaattccccgaaagagacattatgggggcacgagc

SEQ ID NO: 675810 - DNA, 178 bp, Homo sapiens
gttaggggctctgaagtatcttctacgaaggccgacagctccaataccctaacctgcaggatgctcagtccactgtcacaatcccttaaagaaaacattagtggccgtgacccagatacagagacggacgaaatgctttcactccattagctttgccaactccagcgtgctgatacaa

SEQ ID NO: 675811 - DNA, 843 bp, Homo sapiens
  misc_feature (578)..(578): n is a, c, g, or t
  misc_feature (798)..(798): n is a, c, g, or t
ctggaggaggcggagagcaatgtgttacagatgcagtgcaagctgttttgtcttttgacaagacctctacagtcctgggtggagagaggccgtggggctgctcagactctatgacatcggcgtccacctgatgacgcgcacacgtacagtccgcgacgtagtgattgcggaccccaggcggagcctgcagatctgatccgtgcaaccacgcaagcctgtgggccctagatgctagatccgacaatggccagccgagaagtagcattcgcatgcacagcgcatggacacgcgaggaccacgggtcgtgaagcgtcttccctgatctctggccggctccataggacagcaggtcaagttgtaatgcaggcccatgcagccaccggcatcctgcgcccgtgcgcagaccgcgtgcgagacaggagcgaggaggaccaagagtgcccgcgccactgaagcactgagggcagcccccatgccatacagaggagagagcgactagcgacgaatgacagatgtcctaggctcctgtcaggggccacacgcagctgagtgctgcgatgacgaaaggggtacgggcnagacagaccgtggagcacactagcaggcctgggagccacggcatgcacaccaggctgcatgcatttgtccagtctatccacccgcccacccgcccgccaccccaccggcagcgtccaggtgcggggccgggaaccacacaccccactgggccggccacagtctggacccgcacgtcctgtctcaaaagcagactcgggaactgcctgaatgtggtttggnacacgagacctcatcatattgatgagcgtaaaccaaggcattcct

SEQ ID NO: 675812 - DNA, 100 bp, Homo sapiens
atgatttttgtttgtcctgatatggtattttatatctttgtttctttttttttactaccatgttccttctcatctcttttcccccttctgtcgtcttctc

SEQ ID NO: 675813 - DNA, 175 bp, Homo sapiens
cgaaagattaatatggtacactaagaatgactgggaagcaaagttcagtcaaagagatttgattattctgggtgtcagaaacatgttgtgacacaagtgtgtactaacactggacagataataattggatgtgttatctccctcctggctttggtgtgtaccccatgtatgctat

SEQ ID NO: 675814 - DNA, 696 bp, Homo sapiens
acatcagactccgtgtccaaagaatgccagataggagaggcagaaggaaggaaaacatcccgtgaaaagccgtgacgatagggcatcgtaaggagcctctgatagacagctgctcgtaggcatcacgcacgtttgaatgctggtggcttagcaggtgatggagcaggctgtccccctgcctgttggcgtggttgccactgcgcactctaagttatttcatttgtgtagttttgctacttgcagagtttttaaacgtcaaaagcagcatacgtgtaagccttttgcctcctattttgagtatcagggcattgacattttctttagcctggggattgccatgaacagtgtgatgttggaggaacattaatactggaggaagccttgagttctacgccatgttcagttaaagggatgcaatctgtccccggcacacattcatagagcctttcttccccgggcctcaggtttctcctttgataaggtggaagaaaaggactagatccttcttgtaagggccctatctggaacttaacaacattcctgaatggcccacccttgttcccattgatcctccgtgacctcctttctctggctctagcagttgtccagccatacaagcaggtgtccctgagactcaagactgatagcaggtttgcacaggcagggccggaatgaaatgttcaacactttgtttac

SEQ ID NO: 675815 - DNA, 683 bp, Homo sapiens
atgcttcatttgtatgtcaaagctttgactctataagcaaacttgcttttttccaaaacaaaaagatgtctcaggtctgtctctgtgaatttctctaaccatgcttctcagtgtcctcagaactgtagtcctctctacctgctgaagatgttactacagaccttaatattttcctagatagtatctatacttagatcaaatagttgcgtagcagtatatgttacactttgtgtgttctatatgctgtgacacaactgtgtgattaacaggtatactttagtagacatttataactcaaggataccttcttatttaatctttgtcttatttttggtacttgtatcatgagatgctttcaggtgagtgcataatagctacagtgccatagttgtatgacccacagtacattctggggaaacaacgatttagtattgtacgcctttactgtttgatataccaaattcccgaatagattgtactctcattgacttatactgggacaccattaccaaatataatacatgtcactttcatacattaggcttaaaaaccagatgcagttccccggacgtctaaaccaaaccacttacaccgttttcagggaccgggggctctactaaaggtctatgctctgaaactctgtggagccagggcacagtttcatggcccatcggttcgtagac

SEQ ID NO: 675816 - DNA, 355 bp, Homo sapiens
agatgaaaacacatttagaggctgccgctctgctgtatgaaagaaacgcagatgggcgcgttgatggaagaaggctggagactccttagcgcatcttaactgtagctagtcgttaccaccccactcccctgctgctgacttcgctggactctgtggccccttcaaggccgattgtgcgtctactgtcagtacaaagagcactctgaggctacgctacacataactgcgggagatgagaggtggcatcaacctcaggctgcttgacacctgactcagaaattatcaggttttgctcagatcgaagtcatcctaaactgctgacgagcggaggtgggagacatctcctctacgtatt

SEQ ID NO: 675817 - DNA, 134 bp, Homo sapiens
aacgtcactgtcatttaaattattccacattcacccagacttttatgccacgatctccaatagagatgccggggtttgtggatttgatctaggggcggaattctgaacagaacaggaagaatccagacggtggc

SEQ ID NO: 675818 - DNA, 226 bp, Homo sapiens
ttgatattgctagggaggcgcttccaattatgtgcttttgcaggtggcctgcattaatgtgagcggttaggcggacggtcaatgctattgactgaatgacccagctgatggtttctataataactaagatggggataaggggtgtatgtgtgccttgtggttagaaacggactatggcatttttaatcttatagcgaaagcctatattgactgcgccctttcataa

SEQ ID NO: 675819 - DNA, 333 bp, Homo sapiens
  misc_feature (23)..(23): n is a, c, g, or t
  misc_feature (76)..(76): n is a, c, g, or t
  misc_feature (139)..(139): n is a, c, g, or t
gggatcactttaaccctattacnccttacccaagctttttttttttggaaacagtctcaaagctgggagtgcaatnggtgccatcaataactcactgtagcctcccatctccctgggttcaaagcagtcctcctacttnagcctcccaagtagggactacaggcgtccaccaccacacctgattttttgaatttttagtagagacgaggtctcactatgttactaggctggtcttgaacccctgagctcaagtgatctcctgccttgggctcccaaagtactgggattatatgcataagccacagcgcccagcctgtcgctttcttttctttc

SEQ ID NO: 675820 - DNA, 430 bp, Homo sapiens
ttggctcagatgacaaacctaagagatcatgagcaatcttctcctccatgtaccccgtaagccactgacatagacccatcaagcccaagtcgtagtaaggtatcgttgtcaggaaggcagatcgggatgaggttgggacccatcgatgacactattttccacgctccatcaggccgattgctccccctcaaaattgtaggactctatcctgacggtagtccgggttgactgctgaccctgcggatggggtgatttcctagcttcatgacctcttccacctttgtgtggcccaggaacatcatcccatgtggcgttgttttgcgcttcgtgttccttgggattcagggtgtgggctgttgtgaggatccagcggtcgcccagcagggactcgcccccgcgcccgtggatgttggtgaacacctgccatgtg

SEQ ID NO: 675821 - DNA, 196 bp, Homo sapiens
aggcggactttagagaaccccctgttggcggcctgctgagcatacagcacacacacaaacgcacggtacacacacgcacacacatgcgcacacagcacacaaacgcacggcacacacacgcacacacatgcacacacagcacacacgcaaacgcacagcacacacaaacgcacagcacacacgcacacacagcaca

SEQ ID NO: 675822 - DNA, 219 bp, Homo sapiens
atggatcccctgctcttccgacggggtggttgatggccatgtagcacctatcaatgtatttgtttgtttgagatggagttttgctcttgcttgctcaggctggagtgcagtggtgccatcttggctaactataaccttcacctcctgggttcaagcgattctcctgcctcagcctcctgaatagctgggactacaggcgcccgccaccccgtcgggtgg

SEQ ID NO: 675823 - DNA, 324 bp, Homo sapiens
cccccggggggggggggggggggggggggggttttccccccccgggaaaaaaaaaaaggggggggtttttttccccccggggtggggccccttttttttttcgggggaacaatttttttgggggtttttttttttttccaaaacgcggtgggggggggggggaaaaaaaaatcttttgcggcgcgggggggggtttttttatttttttggggggggggttttaaagccctttggggggggggcaaaactccccccggggggggtttttttttttttcccccccccctttgggggggggaatttttttttccccggggtttttta

SEQ ID NO: 675824 - DNA, 258 bp, Homo sapiens
tgagattgcaacaatgcactccagcctgtgcgacagagacagactgtttcaacaaacaaaacacggctaccacctaattaggaggctcactaattaccagtgccccgcaccggcagtaccgtgcagtatcaagtcagacaggagaatacctctatcgagcctctgagagaatagtgcgtcgagaaaacgttccctgttttgcagactaaggaagaacgaaggggtccagaaaaggttcgaaaaggttctttgaggcaa

SEQ ID NO: 675825 - DNA, 564 bp, Homo sapiens
tatgatttgttgttccaaaaattaacccgtctagttatttttagttcagtggtttaatctggcctaaagcggcggggaaaggtatcaacacccctagccgacaaatcacccgatctaggctgagggatagaatggtccaattgggtgtgaggagttaaattatatgttgggctttttttagggaatgttttttttgcattgacccttatttacatggtggcagaactcttgcccaaaaatggcgagttaaccatctacaccaaattaaagggggtattttacaaaaaagagggccttaccggcccttcaaacagaaccaaaccttcgtacccgggaacaaacgcgcggtccgggggcacaccacactttcttttccagaaacccgaccttggttggcaaaaaacccactactttgtgggccccccacacaattccttcccccgggaggaacccaaccccttcggggctgtcaactttctctccaacgggaaaaacactccacaacctaaaaatctttggctccccaaacctcttccgccatttttccccacattttcctttttc

SEQ ID NO: 675826 - DNA, 331 bp, Homo sapiens
  misc_feature (70)..(70): n is a, c, g, or t
aagtagtcgacgagcaggtagtagatgataaacatgacagcatggtcttatttcacaggactagtccggngcttcgtatcactagctgttgccttttacacctgttcagcacctgtcctgtcattggcctggacttcctctctgtgcccgtgtgtcctcctggactggggagccctctccttccatagtcactttctctctgccaaaatcatttcttcttggtggcccaagactcttttcctgagcccctgtggaaacttcaggaaggattgaatcgtctttgtgcttcggtcgaacggtacgagccgatcgtatcatgctactgttctgt

SEQ ID NO: 675827 - DNA, 978 bp, Homo sapiens
cccccgaggcccgagtggagaggtggaagagcgccgggcccgggtctgctggaggcgtggcgcctgtcggaacgctgagagcgcggggctactgctgggcaggcgcgagttctgctgcagcatccgcccccggcgtgacctgctggtcgcttcctggctgcggggaggagaatgtggccgccgttgctgggactgctccgtgagccctggccttggcgcggtcgcgggggagcccctgggcctgcagctggggatgggggcgtttcctacacgcagtggccagagtccggagccgcgtgacccgcgagtatttctactacgtggaccaccatgggccatgcttttcctggaatgattccgaaacattgacagaatttcatcaccgtgcttcaaagacccgcagttcctggtcaccttcttcatccgcgcctgagaacccaaaccgcagagcgggcgcatacggagggccggctttcccctttcctctcggcccttgctggcagagagcggcaacttcctgcgctgcgaagaccggccggtggtcttcccaggcaccttgcttgacccggggaccaacgggccctccgcagcctctcctacttgcggcgtgtggcggaggcccttgtccctgggttggccctttcggaggccgtgtggtccgccatgggatgtcccgctttggcgcggcgcaatagtggtgccggccccttggttacccataccctggggcggtcctggtatgcggttcgcggcgccgggcgttggcgcgccgttggtttgcggccctccgggggccagtgtggccatttccgagggcgtcacggttggcacgtttgatattcggacgataacgggggtcgccgggtggtgccgcccatgtggcagtgttcgcccttcggcgacggtgttgcggcctttggcatgtgggcccgtgcgggccgttcgccgccttcatccactgtgtgagccgtgtgcgcc

SEQ ID NO: 675828 - DNA, 690 bp, Homo sapiens
gttattaaaaaaaaaaaattgggccaggcacggtggctcacgcctgtaatcccagcactttgggaggccaaggccagcggatcacttgaggtcaggagttcaagaccagcctgaccaacatggagaaaccctgtctcaactaatagtacaaaattagccaggcgtggtggcgcatgcctgtgatcccagctactcgggaggctgaggcgggagaatcacttgaacccgggaggcggcggttgcagtgagccgagatcgtaccattgcactccagcctgggcaacaagagcgaaactccatttcaaaaaaaaaaaattggtgacagactcaatgatggaatgattggtcggaattaacacaaagcagacttttattcatataatgactttttctcttaagagtctcttttttaaaaaaccttaattctctaaaaccgaaatggttcatgcttctttttaacaatgattgtttaacctgtttggaatggttagcctggtgtggtggtgcacacctgtaatcccagctacttgggagactgagacatgagaatcgcttgagcctgggaggcggaggttgcaatgagccaagatcgtaccactgcactccagcctgggcgacagagcaagacactgtctctctctctctctccatatatatattggggacggcgcgatatatatatatatatgg

SEQ ID NO: 675829 - DNA, 225 bp, Homo sapiens
tttaatgtgaactcttgtggcaaaggaacttaaatggaaatgggtgaggtaattaaaaagtcactgaccttaaagtgaaaactgtggggtagaacacacctactgcggtaacaatgtacctgggtaggggcttattggcaatttaaaatgcgctttgtgtttcttcgaccgtgcgcggaggcgaagaataacttgtgttggcgggtggccacttttgacgaaaat

SEQ ID NO: 675830 - DNA, 1256 bp, Homo sapiens
  misc_feature (266)..(267): n is a, c, g, or t
  misc_feature (285)..(285): n is a, c, g, or t
  misc_feature (768)..(768): n is a, c, g, or t
  misc_feature (1242)..(1242): n is a, c, g, or t
ccgccttgttgaaaacttacctgtggcccgttagtcgggcgtgcttgataggacttccttgagggaccaaatggaacaatggagtgttgcccctgtagtgcttgcgaccaacttgccggacaaagggagagccctcaaggataccgagcaaccttgaagcccacggatcagcccaaagcgctctggcgtgcagtcgaagatggcttggcagtactactaggtagcttcatcccctagggcctcgtcttgcccagagccgatgggcnncacctagtggaacagacngtgtcagtttccttcgtagcttttcttgctcttcaatacagccctgtctggagaacagtcgtgaactggaacttggcgcattcaggcgccgtgcgttgggaacattccgcacgatcgtgactcgccttgtcacatcgcatacagcgacgacgcaggcacatgttcctatcagcgaagaatgttcctatcgacgactaggctagcaagtgaagtgcatagtttctcatgtcgctgctgatgtgtctcgggaaaagcccgcgtgttgtccctagcgctcaacgccacagaagtaccacagttcgtcgacttctgcgtccatcactgtgtcacgtgatgaccacatcacagaagcactacagtcagatccgtgacgccagccgccgtgaccagtgtcgaagaggcgagccaaacatttcaataggtcagacgtcagtacagcgacgcatgggcacccaagaactagcattacccaggcaaggtccnataagaagtccctgagccatagggtccaatatgactaggagcggacgtgcgcagaccgagcacacagggcccgtgcgccatacacagcaaggtgactgcccacgagggacctgagagggaaggaagaacccgatgagaaaacgtcctctcattcccagctcctagacttactggatcgtgagattcatcacgagtcacaaggcaccactgtgctaccagagcctgaggctagtggtctaccctacagcggagatgccagagacctcaatagcaccaatagagccaatccatgcagatggacgctgtgtggagatgctccaggatgacgggatcccgcacaagctcccatcagtccttcagggctgggcaatgtggatgatttttctaaagctggagaaaggaagaattgtgccttgcatattacttgagctaaaactgacaacctggatgtaaataggacccatctactgcttnattaataagtctag

SEQ ID NO: 675831 - DNA, 111 bp, Homo sapiens
  misc_feature (10)..(10): n is a, c, g, or t
ttctgatgancaaagtgccacggcagctgttccgcccgaggacccgtgttggaccacaccattatgcttctcgcctgatacgagaaaaacacccgcaactggtacggcggg

SEQ ID NO: 675832 - DNA, 271 bp, Homo sapiens
taactactactgacaaccagcactgaccaccctcaaagcttgcggccctcaactccagtcctcgatgcaatctgcaaagaacggctgtattaggcccattttacagagtgggaacacaaaaccaacaccaaagctcagagaggttaacagcttatcaagggtcaaagattgagcaagaaaagtgggaagactccaaaaaccaagctcttcccattataccagacatatttttctcgcagactttttctaaagatatagacatctctgaggc

SEQ ID NO: 675833 - DNA, 191 bp, Homo sapiens
tggcgaagtccttcccctgttcaaggcgacgcgggagggagatgcgctttcagtgaacccaggtactaacagcacacaacggctagtagcccggagaatgctacgaaacagctagcaagccttatgaagacacagataagaccagaaaggagaaactggcacttcgacccaaggcccggggtaccgagctc

SEQ ID NO: 675834 - DNA, 491 bp, Homo sapiens
  misc_feature (187)..(187): n is a, c, g, or t
  misc_feature (189)..(189): n is a, c, g, or t
  misc_feature (198)..(198): n is a, c, g, or t
  misc_feature (217)..(217): n is a, c, g, or t
aacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggaattttntnccccccccngccccaaaccaactcagcncatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagtaaaa

SEQ ID NO: 675835 - DNA, 143 bp, Homo sapiens
tatctctggccccctcgtgttgatgcccccatgttcatcatgggtgtgaaccattagtaagtagtgacaatcagacctcaagactcatcagcaatgcctcctgcaccaccaactcgcttagcaccccgtggccaagggtcatc

SEQ ID NO: 675836 - DNA, 457 bp, Homo sapiens
gggtggggaggcaggcggggttggggccacgtgagcaaaatcccagtgagcactgatgaacacctccacttgcctaccagacagctgtgtgactgagcccgaggaggcataactagggcccccatagaatgcagaacaggggcgtggccttaatgctccaagcccattggtcaatgacaaagatgaaagggaaagggggtgtggccaggcagcagtatgtccagagggacctgtggctcacaaggaaagctgtccatgcaactgctgtccccgcctactctgaggggaggggccgccccctctgggagaggggaggggccgccccctctgggagaggggaggggccgccccctctgggagaggggaggggccgccccctctgggagaggggaggggccggcttttgctttaaaagctttaaaactttaaaaaatatatgtgtgtaaactttaaaaaa

SEQ ID NO: 675837 - DNA, 229 bp, Homo sapiens
  misc_feature (21)..(21): n is a, c, g, or t
ctcttgtcgccctagctgggnctacaggcaccagccaccacgcccggctaattttttatatttttagtagtgacggggtttcaccgtgttggccgggatggtctcgatctcctgacctcgtgatcctcccgcctcggcctccaaagtgctgggatgacaggcgtgagcaccgcgcccggcctacttgtgtattcttatagcaatccgcacattgggtatgaacttttca

SEQ ID NO: 675838 - DNA, 434 bp, Homo sapiens
gcttgaactcaggagatggaggtttcagtgagcctgagatcacgccactgcactccagcctggcaacatgagcgagacgtccatctcaaaaaaaaacaaaaaaaggttaaagaaagagaaaaggagactctcccttttaagaattggagaaagagaaaaatctcatataaaatatatgtgtgacgcgctgtgaatgtgccctgtgtgtatatattgaggaaaattatagagcgcgtgttcccttcgaacacaggccgtgtgtccctatatgcgatgttgtgtgagtgtgtgtatatttgtatgatagtgctctctttatatatctctcttcctattctctcttgtgttatgagggggtgttggtgaagaagagagaacagcacaagaggaggattatacccagagattttgtgtggagaaagggggggagaatt

SEQ ID NO: 675839 - DNA, 455 bp, Homo sapiens
aaaaaaacatggtgcagcagctgttttataatcacgtgaatagaaaaaaaaaaatatggaataatgaataaaagaaagattgaaaaaaataatgaaataaaaaataaaaactttgggggccgcctgggcccatgctattttaaactctaccaagtttatgcatgcggccgaatttcgggctcatttggccaattcgccttatagggagtcgttttacaatgaatgggccgtagtttaacaacgtagaaactggaaaaaccttggggttacccaattaaatcgctttgcataaaatccccttttagccatatggcttaatatccaaaaggccctaaccgatcgcctttccaaaaagttgccaaccctgaatggcaaatgaaaattgtaggcgttaatatttggtaaaatttggcggaaaattttggtataagcccttttttaaccctggcctgggg

SEQ ID NO: 675840 - DNA, 791 bp, Homo sapiens
gggcttgcgtgtgttgtctcggtgtgcgcccggctggtcgggcgaggcgtgctggcgtctacttcccgggctgtggcctggggctgcctctgatatccccagccgggctccgagctgcccttgcaggcgctgctcatggtcgacgagaggacattgtgagaaggggccggggaggccagagtagtggctgacgatatctggagcgaggtggcaatcgagaaattgggcggattgatctacttccaggaaggagggcgcatggatggatgaacctatcgtgtgacgaggaagccgattgatacgatttgtaggggcgtggtggacgtgcgaggttgtatgggtacggaaaacggcgctcgcgtcaataggtctgcgtagtattcgaccatgcgatgccttagggcaacgggtgctcttccggagtgagaaatgcgttctagcgttagaagggcagggaatgcgctgggcaaagggactagggcgtcacatgggaggttggggtaagaacagggagattcagacccatttgggtccttagtgaggggagttcgtcccaaaaagcaaaacgcttggggagtatacgccaacccccccgccgttgggcgcaaatggagagctttctcgcagttggctcccaattcgattggggcaattcgttggggtagcccaatgtgttccctttgggggaatgcccggggagttcctttcacgaccgctatggtgactccgtccttttccaggggagtggtcgacctggtgggggccccattctttgaggaggtcacttcctc

SEQ ID NO: 675841 - DNA, 950 bp, Homo sapiens
gcccgccacatggtgtggccatcactcagcccctacccctgccctgctcctaagggtagaaaactccaggttcccctgccacctgactgcccatgccactccaatgccccctgtgcatgctgccccttcctggatgcatgaaatgtgcctttatctcatgccatcctgcatgacttgcttgtgcatgatgcgtgggacatggctggaatgacgtggcaggcgtcattcagtcatccctgtgccatccccactctcacggccacacccactgcaccccaacctgggactgcagatggtgctagcttggatcgcagcctgcggaatcattgaactctgacgcgataacaaccgcgaagcgacgacgcactgacccgccgtaacacccacatcaaatcacccacacgatctcacgaccaacagcgctcatacacgggccacgctgacggtcctgagctggcacagcgacgcctgacgcggcagcggcacgtcccatgcgacacggctgcccaaccacccgcgcaccaccatgtctcgcggcccgcgcgagccgccaccagcttgcttggcgacacgcgctgcacagcatctcgccgcccctcgcgctccaccgccacgctggagaccgctcgacgcgcctcgcaccccgtcgaatggccccctgacccccattgcacccccacaacgcttcgacccccacgcgccaacacccctcgctcgcctcgcttgctcggtccccactctctagtaactctgcgcgcctgagtcacgagattccttgcgcccgtcggaccgctacgcctggtccatccgcgcgactctcctggcgcacccaccaacggaaccttggggagccctacgcaacccgctacaaccagtccccaactttggcccgcgcaccgcccccagcacccaccctacccttgcaccacacccaacccccccactccctg

SEQ ID NO: 675842 - DNA, 222 bp, Homo sapiens
  misc_feature (23)..(23): n is a, c, g, or t
catagctgagacactctcttaanatccaccgctacaggtctcctaaaaattaagagagtgattgctgttgaaggagatattgtcagaaccataggacacaaaaaccggtatgtcaaagtcccccgtggtcagatcatgatggacacagttttgacagtaattcttttgggccggtttccctaggacttctgcatgcccatgcaacacaggggcttggcagaa

SEQ ID NO: 675843 - DNA, 124 bp, Homo sapiens
tctggctggctatggaaagcctggcagtatggagccgggagtggagggcggtctgactgtgagtatggcagtcagtgatgcccatgactgtgcagagagcgagggcttgtcctgagctgtggct

SEQ ID NO: 675844 - DNA, 243 bp, Homo sapiens
  misc_feature (204)..(204): n is a, c, g, or t
tggtgccctcagcatttcttgttttcatacacaacagaggatgccccccctgcgatgtggaccaaagtaattccagtgttggaggggtgcatcatccaggcacgtaggggtcttcctggggcagtggaggagggtggaagtctggaaggccctcttccggggtgtgcatgtatcctgcccccgcggatgacccagagtactggngatgtgatccgcgggaagcggtggtaggcgagccgcgcg

SEQ ID NO: 675845 - DNA, 218 bp, Homo sapiens
  misc_feature (218)..(218): n is a, c, g, or t
gcatgcaggtcgacctctacgacgactccccgtacactacactctgcctgcctcacgcctcccggacgtgctggtattatcggtgtgagccactctgcctggcctgaacttctttttttttttttttttttttttttttttttttttttttttttttttttttttttaatttttttttttttttttatatttttttattattttttttttagtttctn

SEQ ID NO: 675846 - DNA, 509 bp, Homo sapiens
  misc_feature (128)..(128): n is a, c, g, or t
tttctatgagatatctgtgcatatcagcatgtcatgcatttcactctagattctgttgatctttgtattattcatctctttgttaattatctgatagaatctgactccttctctgtgttatcctgaanttctttgagtttcttctttgagttcctcacaacagctattttgaattctgtgtctgaaaggtcatatatctctgtttctccctgattggtccctggtgccttactaagttcatttggtgaggtcatgtttttctggatggtgttaatgcttatagatattctttggtgtctgggcattgaagagtttggcattgattttaatcttcacagtctgggcatgtttgtgtctgttcttgggaaggctttccaggtattcaaagggacttgggccccaagcccaataatagtgtggtttttgcagactcatggaagtaccaccttggtggtcttggatacgatcctgaaaaattctctgaattactaggcaaagactcttgttct

SEQ ID NO: 675847 - DNA, 120 bp, Homo sapiens
  misc_feature (20)..(20): n is a, c, g, or t
aaaaaggggggggtttcccnttttttttggcggggccaaaccccccccccccttgggtttgccccccccccgggggggatggctttcccccccctaaaaaaggcccttttttccgggtta

SEQ ID NO: 675848 - DNA, 252 bp, Homo sapiens
  misc_feature (187)..(187): n is a, c, g, or t
taccgggggggatttcggggggcccccccccccccccgaaaatacaaaaaatacaaggggtgagcaaggaggcggggtcactaaacccccctgcctttgttggtgggaatcaaaaacggtaaccccccctggaaggggtttttgcccccccttgcccccccctttagaaagtaaaccccccccctantgaaggagtagggaccccccccgggtatttcttttatacccaagaaatataatttgttctctcca

SEQ ID NO: 675849 - DNA, 103 bp, Homo sapiens
aattcagtcggcctgttacatggtgcggatcttgggaacagaactgttcagagtgaatctaaagtctgattttagttttcagagacacagctgttgtaactgg

SEQ ID NO: 675850 - DNA, 325 bp, Homo sapiens
ccccgatgtctctctgtggggtggctccgtgcggtgctggcccgccgcccgccctaccccccaagcagcggcagctggagccaccggctgggaaagacgggcatcccagagatccctcagcggtcagcggcgttccctgggaagggacgctctctctgatggggatgatacaactctgccagcaggaggagaggtatgggcaggtaggtcagcgtgcatcactatcacagagaagaatttgaatcctcactagaaaggggtaccatcctacttccagcttcatactatccctatatccaacagacatgagacgctgcagcatttt

SEQ ID NO: 675851 - DNA, 985 bp, Homo sapiens
agcgggtggctgtgcggtcccggattagctggctggcatgggacggttgagttaggctacgatggcggccgcgtgcggctgtgcgtgcctggctctgactctgtgagtgcggctgccttgtcggtagctgcagctaggctagcggtccaggctgagctggccgtgccagccggcgctgaggcagctagttcattccccgtctcaggttgacctgtacctgatggccctgtctgccgggctcctgggcggctgggagcttggccgagcgtcccccgagtgtgctagccgcgtgcggagtccttggcccctattggctgaagacgctgcgtgctatagccggacttgcttgctgtagccccattgcgttggacctgactcggtcgcctagtcccttggagtctcgtggctcgttgtatcttgcccttgtcttctcgaagccctgcattgcgttgggccagctgcctgttgcgagtttgcttgcagcaacagcggttgcgggttgctgacgttgccgtgggttccgttcagccagagacttgccgaagttagccattaggacccttcaacgggacttctgcgagatttcgggttcttgcttgccgcaacgcggagggggattccaagtgtgcctgtgcaactgaatcaaagagagcctcaggtgcgtacatttgcgatcgaccaacgttttgccatctgtggtgaccacatgaagggttgctcatccacctggtcttcagcctcaagttggaggcagtgcaaagctcaatcccacgaacaacaagggtatgcacatgttcctcaatctacgcggcgagtaccgaacgaagttaccggtgcggagcgtttatccttgggaacgcacattatgaggcggcactctggggcaacacagtctaaagccttagcagaagttataccctttattttcccatcgcaaagaaaaatggtcaccgcgcaagcttgtgccctcaccttgtctccagag

SEQ ID NO: 675852 - DNA, 645 bp, Homo sapiens
taaaccctgagtctgctctttaatgtgacaccgcccatttgttttgcccctgactgaggcggaaacaggaggggttctgggaaagtggctgccactgtgggcctgggttgccgcacagtcgtgcctccctgtggggacagaaacccacagggtctcgagcccgtgaaggcctcctcctattccaggaagggccacaacttagcagccgcctgcacctcctcagcccctgtgcagggtcaccactaggctggtttggacacccatttggcacaggcccctttatatttggtgcccgaagcgcagacatcttgagccgtccttgagaaggtccgaaggtccctgtgatcaggtggtcacacgggcggttgacacatgccgttggagtccacaaaagcttacaaccccctcaaaattgcttagacacgcataaaaaccaggaacactagcactagtttgtgaattgaaactttacatgtcatccccctcttgagcatccccttaaacatcttgagtatccatggagaacctcgtgactcatttcggaatactaggtatagtgagtgagaaaaccaaacatttcgccactgaacagacatcacatggccatttagttcccagacaccttgcaaacctcctttgggacat

SEQ ID NO: 675853 - DNA, 261 bp, Homo sapiens
agaggtgcatagtatttgagctctgtaatgtcgggtcgaagtagcgtatgatgggcagtggaggcggcgaatatgcatcctaggcctataatatcggagtatacgtagcggtaagtaaaaaccggtactctagaatatagtagagtggaaatttaaagcgctgatatcgatcgcgcgcagatctgtcatgatgatcattgcaattggatccatatatagggccggggttataattacctcaggtcgacgtcccatggccat

SEQ ID NO: 675854 - DNA, 323 bp, Homo sapiens
cgtattgtctttgtatatgtattcattacattatctcaagaatctcgtctccaccttgttgagaaatacccacaggtgtggaggggcaggccccctccaataactaaaatactaaaatgctcttggtgaacattatattaattttggagacagtctcactctgtcacccaggctgaagtgcagtggtgcaatctagagctcactgcaacctctgatacctggattcaagcaattctcctgccttgtgtctccttgagtagctggaactacagtgtgcctgacaccacgcttggctacttttccgtatcttcagatacagacca

SEQ ID NO: 675855 - DNA, 109 bp, Homo sapiens
ggaccctggtttgagcggggtttgcagcggaatcgggggttgtgttcgaattcataagaacaggcaggttagaagcaggctcttggtgaggggcaggatcttggtgagg

SEQ ID NO: 675856 - DNA, 90 bp, Homo sapiens
ggagtccacaggatcagagtggactttaaggattctgtttcactgaggccatctatccgatttcaaggaagccaagggcacatctccatc

SEQ ID NO: 675857 - DNA, 120 bp, Homo sapiens
tcatcgcatacagcgcttcgaccaatcgccaccagaacacttttgtacacctgtcccctctgccttcaagcgacagatccacgatcggtgacatcgtcgatcagtggcgcgacgtgcctg

SEQ ID NO: 675858 - DNA, 262 bp, Homo sapiens
agtgtcttcaagagtattaatttcagagtgtcttgcctttctttgttagaatgattcctatattagctattgttagaatggtactagcatagttgagaacatttacaagaatctatgtatctatctatgtatctatgtatctttctgtctgtctatctcactatctattggtgattgattgctattccagccctatttaagacagagggatgtgaataagagtatttacatcaacatggccggtatctcttgaaagaacact

SEQ ID NO: 675859 - DNA, 217 bp, Homo sapiens
aatccctgcacgaacacagaggattatctcttccaagttattttgtgaataatcaaattcgcataccactttctctgtctgtaaaagctgcaagtgttctgaagagttttctttaataacgaccctaaggaacgattgggttgtcatcctccaacaggatttgctgatattcaggtacacccgttcttccgaaatgttgattgcggttgcacgtcag

SEQ ID NO: 675860 - DNA, 411 bp, Homo sapiens
agtcagcctggctaacagactgatggaactcttatgcctgccaataagcaaagtgttgaacacgttcacaaaactatttatactagagagcaggcttgaaaagagctatacagaatcatgttctggaactcagcaaaccatcaggagctcgtaagtgagctccacgaaagaacttcaagcaacagatgtcccgtcgatgatccatattacggatataattctatatgtcaacggaggagatgaaaaaaaacaacatcccagagccagttgtcatcggaatagtctggtcaagtgtaatgagcactgtggaatggaacaaaaaaggggagcttgtagcagagcaagccatcaagcacttgaagcaatacagccctctacttgctgcctttactactcaaggtcagtctgagc

SEQ ID NO: 675861 - DNA, 330 bp, Homo sapiens
ctctgacctttggcctggcagtgccgagtggctcatgcctgtatcccaggctttgggcatcccaggcaggaggatggcttgagcccggcagttcaatgaccaacctgggcaacacagcaagacttgtctctacaatataatttgtttttaattagccaggcatggtggcacatgtctgtagtcctagctactcagcagactgaatgggaggactggttgagcctaggaggttgaggctgcagtgagccgtgatcacaccactgcactccagcctgggcaacagaacaagaccctgtctcaaaaaaataataataattgtatatatcctaa

SEQ ID NO: 675862 - DNA, 387 bp, Homo sapiens
  misc_feature (294)..(294): n is a, c, g, or t
cccgcgggtctgtctcttgctttaacagagtgtggacggaacagatacggggactctcttttagactccgaccgccctccgattttctctccgcttgcgacctccgggaccatcttcttgggcatcttctgcttctgggacctgccagcaccgcttttgtgggtaggttcttcttgtcaaccaaccatgagcttccagattcgtcagaattatttcaccgacgtggaggcaggcgtcaacagcctggtcaatttgtacctgtagggctcctacacctacctctctttggggttntatttcgaccgcgaagatgtggctctggaaggcgtgagccacttctttctccaaatgtgcccggagcgcgagggctaccaacgtcttctggat

SEQ ID NO: 675863 - DNA, 234 bp, Homo sapiens
  misc_feature (121)..(121): n is a, c, g, or t
  misc_feature (127)..(127): n is a, c, g, or t
acaacctgaattactcaacaaacgaaggttctgcatcatccgtagcaggttgagaagctgaactttctgttgatgagcttgatgtggatttacccgcaccgccagtaataaatttactgantaaatnttctaaatccattgtgccttgagtgtttgaaacgacgtcaccacgtttcaagtagttgacaccaccacctggtacgactttcaaatatttttcacccaataagccat

SEQ ID NO: 675864 - DNA, 1047 bp, Homo sapiens
gatccgtacagcgcgggtcagttctctgtgagacagcgctactcattaatctccggtctcgcgcgttctctcctaccctaaggtgcgtgcgcgtgcaccctgatggaacatgctgactgaaccagtgtgcacatctccccctgatgccccagagcctagtcttaacgatgtgctgaactacacggccgacaaagattatcacctcttcagtgtgtggactgactgcacttgacacaatgagcacccagattagtgctccgaggaacatgtcaggaatcaccagctgtctgtcgatgggtatgaggacccagcacttgttggagagacgagatgggcacttcgatatttcagagtggctaggtcacaaaatctaccatgttagactaactgaactaaaccttatggacacaactcgatctggtaagctagcacataccggatgtatcccatatggaatgggcgtatggagacatagacaactcacccatgtggggtcctttgcacggtttgaagagtgtgagcgttgcatagggggcccaggtagcaatgtattcaaaattggcaccttgggcactttcaagtcatgactctgatgaggacacgcaaagcattcgaaagcacgttccaattacaactatttggaaccttgaacgagaaccgcgtagcagcattggcatgagtagccgccctttcttactgttgagtaaaatccattgacgccaaaaaggccaacgttcgtggctccgcgcccgggatattggggcttcgtgtgacgacgcgaacgggacatttcgcaacacaccgtataacacaaacgacgttggttagcaccagtatcctttcggtttccggcgtttggggcgttaggagaggctttactcgcacagtggaaacacggcgaatttgcatctggaaggttgtatcccgccacgttggatcttccaatgggcttacttggacggcacttggaatttggcgtaagaacagagagaaacgaggccccctttcccaaagggattgggagccccaggggacggaattggaaac

SEQ ID NO: 675865 - DNA, 900 bp, Homo sapiens
tagacaggcaggcaagtcgtcagacaaccgatcccgtgggtaccgtgtgtggctctgccgggggccggggcttcttccgtgggggccgaggactggggccgtgggttctctagagtgaggaggggaccgaggctatgttggggaaccgggttcgagtccagtgagtggggtgctacggaggctccagagactactatagcagccggagtcagagtggtggctacagtgaccggagctcgggcgggtcctacgagagacagttacgacagttacgctagacacaacgagtaaaagacccttcctgctcaagatcgtccttccaatggctgtgtgtttaaagatgtgggagcttcgctgaagcgttaatgtgtaggtaaatgcatcctccttgtattcgccacgtttcgtagtcagtttcggtatctgatcttgtcaaacccagccgtgagccgcttctgacgccgggatggcctcgttactagacttttctttctaacggaagtgctgtcagtgggagggtctggcaagaacatttggagaggcatttacttgtttgaccaggagccatgagtctcaaaagaaatcgggggtgtgtgggtacacgggtatggcgtgaacgtgactgggtgagcgtggccttgttgactcggcaggggggtgtggccccatagaagttggggtgcgcaacgttcagtttctcgggagatcgggagggaggggtgattcgcgcctttggtcggatgctggcaagctcggggtttttctacccaactccgtggtgacgttctgaatgtgggtgtggggaggacccgggggggggtggccgacctgggcttgggcccagcccttgggtccactcggggagcgatgggttaaattggcgcgttacggcggaggtca

SEQ ID NO: 675866 - DNA, 286 bp, Homo sapiens
ctggcctgccttagagacatgactctggggcccaagcgatacctgtctcagcctcccaaagacactggaattagagccgcaagccacttagacaggccctgtaatggagtatactctcagaattaatagtccccctgaagattcagaaagtctgaattagtagtcactacattatgatgattgagtaaatcatttacacctcagtgcctcccattttgtttatcacgtaacagtgactaggcttgcatattcatttacaagcggataaacttctcatgattgtaga

SEQ ID NO: 675867 - DNA, 806 bp, Homo sapiens
cagtggaggacgggtctcaagctcctctctgtggggtgggacctgcacctcaaaagcgcgggggggctgcccctggctgaggggtcctggctttggcatgtagcaggcctgtggctgtcacctggccaggccgtccatcctggtcagtgtggccctggtcatcagggcagccccgtgtccaggtgctcagggaaatgaagtggccatggactgtcaggacatggccagggtggacagaccaggagctgaagtcaaagggtggaaatgtttttaagtgtggtcctaggccagggaccacgggagccaggctgacactgtgggtgaggggaggccatgcttgcttagaagatggattgctggccccctctttaccccaaaattgaatcctggggtgtgggagggtcaggggcttcccatgcagattggaccaggaatgagcacagaagggaagaggagaggcaaggaaacacgggactcccctagtccataggcttgttctttgtcctctttggaaacaggtggggctgggggtgggaggaggggagaggcttcactagcccagaaccccagtctcctcttttggctctaccagaggttgggcctgaatcagtcccaacagccccaacagggtgccagtgtttggtgaaaccactcaagttcagtggtttagtagtttctaaccttggttctaaaacatacatgtggatgcacagaaaaagctgatatattagggtagagaatttgtgcatgacttttgaaatgtttcctttaattatatatcatgcagttgaaatgaaaaaaaaaaa

SEQ ID NO: 675868 - DNA, 470 bp, Homo sapiens
ggtaccgaaaatgacatagaggcaggagaatggattgaacccgggaggcagaggttgcagtgagctatgatgtgccactgggctccagcctgggtgacggaactagaccctgtctctaaaaaaagaagaagaggtgtgtatccttctaaatgataaaacagatcactcccctgcttacataaaactttccggtggctggccaggcacggtggctcgcgcctgtggtcccagcactttgggaggccgtggtgggcggatcacgaggtcaggaaatcgagaccatcctggctaacgtggtgaaatcttgtctctactgggaacacaaaaaattgacccaggcatggtgactcatgcctgtggtccagcactttgggatgctggggcgggaggatcacttgagcccgggagtttgaggttgcagtgagctatgattgtgccactgggctccagcctgggtgacggaactagac

SEQ ID NO: 675869 - DNA, 3293 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 675870 - DNA, 249 bp, Homo sapiens
  misc_feature (12)..(12): n is a, c, g, or t
  misc_feature (55)..(55): n is a, c, g, or t
  misc_feature (58)..(58): n is a, c, g, or t
  misc_feature (68)..(68): n is a, c, g, or t
  misc_feature (98)..(98): n is a, c, g, or t
  misc_feature (110)..(110): n is a, c, g, or t
  misc_feature (113)..(113): n is a, c, g, or t
  misc_feature (123)..(124): n is a, c, g, or t
  misc_feature (188)..(188): n is a, c, g, or t
  misc_feature (201)..(201): n is a, c, g, or t
  misc_feature (216)..(216): n is a, c, g, or t
  misc_feature (221)..(221): n is a, c, g, or t
ctttaaccctanaaggtggggacctggggggagggacagggcaggcgggcccatnaanaaagcccctngttgcccagcactgtttgggtttgtttttntgtgcccagggnggntgccagcccnntgcctcctgcctgggggggcctggccctcctggctgttgcgacgcgggcttttggagcttgtcnccattggacagtntccctgatggacccncagtnttttcatgaataaattccttcaacgcca

SEQ ID NO: 675871 - DNA, 3726 bp, Homo sapiens
  misc_feature (1511)..(1511): n is a, c, g, or t
aataaaaattaaaaatagatgtagatgctatgttgctgaggctggcctcaaactcctggcctcaggtgatcctcccgccatgacctccaaaaccacagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacaattgctgtgaaggtgagaaaagttcatttttattatgtttccccaagagacgcactctattgttctcttgaaaacacacagctcatgtcctcctttagaacacacatcctctttaaagtaacatacaaacatgccaaaacaaggtaaaaaattacatctgaattctcacatttcaaatatatatgaaatatcaaataaaaatttatttttacaagaatttaggggaactactacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatataacagttataatatccatcacacagctttatagaaacagcatctattcaaaaataccagtatttccaaaatatttaaaataatatttaaagtaataataatatttaaataaataaatatatttaataaatatttaaataaataaaataatatttaaataattctatacccatgtttttcaaaataaaccaataaaatagatagtatatattagacgtgttagtatatatatctgaggcatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatgtaataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccgacattttccatacaaaccaataaaatgcagagtgtgcatgaagctatctgttacaatctgtggcactgatatttcacaaaagaattctgtcccaatctgagcccctgcattgtgccttcaaatcctcctggactgcaagtccgtaagaaacaggacctccaggttccgccccagggaggttggaattcagcaatataaaaagggtggtggtgccgcaggaaagggtggaactggaaacnctcctggtttcttacttttctccaaggactcctagaaggaccccacccccctccccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 675872 - DNA, 1048 bp, Homo sapiens
  misc_feature (297)..(297): n is a, c, g, or t
  misc_feature (453)..(453): n is a, c, g, or t
tcaattataaaaaagaagtatagtcaaaacacacacaagctacgttatcctactgctcccctcgccactacctttgttcgtctcgccaagcttctctctttagacacccgtttatttgccccaaatatattgttgtggattaaacccggacttctctgaatgttaccccccaacggtgggctaaattctaaatggttgccacccgcagacgatataaatatattgcaacccgttcacagagaactatcggggggttcccccaccccgcgggccgtccctatggcgccgcctgtgtgncagaggatccgcccggtgactcgggtggtgtttcaaagaaggtttctagatttaacaaaaaaaattccgggtgaagtaagcgcagcaaacactttactgtgtgagcaaacgcccccgccccacattttgtgagataagcacttcttgttcccgcgntcataagaaaccaatctccccgtctggttccgaccttgaaagaagaagagtttgtccccctcttgctcatacacaccacgtcctttcctggaaggaacattactttccctctctttgttggcgccaccactccgtaggaagaaactaatttttcttcttccagtggcctcctcgtgccccctgcactagagatgtttctatagattcacacccctcgtatgtacaacccaccgtgaaatatacggatataggacttcttctctttgtaaaaagagaaatagcatactccacactatagaggcgttccacgtcatagatttacacatatttgtgccccaatctcgcaccatgcggtcacaaattctgctcaaacacttgtttatgtactaccactgtccactatagctgccaaatgtgaggcccaccataacaatacaatggtgcacgcaaacggcattctttaatatataacagtaaattgctgtgggcctcctcaaaccacacgacccaattgcatctcaccccggagtacacacaacatggccagcgttagggttcacccaaaaaaacaatacaagggtcgttccccaaaaaa

SEQ ID NO: 675873 - DNA, 3255 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 675874 - DNA, 154 bp, Homo sapiens
  misc_feature (96)..(96): n is a, c, g, or t
ctcaagcagtgggccagtactgaaaatagtgggaaagaaagtctgcaactgaacaatgtgagatacttcaagttttaaacattttttgtatagatngggtttcccacgtttgcccaggctggtcttcaactcctcggctcaagcaacccttctg

SEQ ID NO: 675875 - DNA, 847 bp, Homo sapiens
  misc_feature (18)..(18): n is a, c, g, or t
  misc_feature (71)..(71): n is a, c, g, or t
  misc_feature (82)..(82): n is a, c, g, or t
  misc_feature (89)..(89): n is a, c, g, or t
  misc_feature (99)..(99): n is a, c, g, or t
  misc_feature (124)..(124): n is a, c, g, or t
  misc_feature (175)..(175): n is a, c, g, or t
  misc_feature (180)..(180): n is a, c, g, or t
  misc_feature (187)..(187): n is a, c, g, or t
  misc_feature (215)..(215): n is a, c, g, or t
  misc_feature (222)..(222): n is a, c, g, or t
  misc_feature (226)..(226): n is a, c, g, or t
  misc_feature (229)..(229): n is a, c, g, or t
  misc_feature (235)..(235): n is a, c, g, or t
  misc_feature (238)..(238): n is a, c, g, or t
  misc_feature (244)..(244): n is a, c, g, or t
  misc_feature (257)..(257): n is a, c, g, or t
  misc_feature (260)..(260): n is a, c, g, or t
  misc_feature (264)..(264): n is a, c, g, or t
  misc_feature (304)..(304): n is a, c, g, or t
  misc_feature (424)..(424): n is a, c, g, or t
  misc_feature (444)..(444): n is a, c, g, or t
  misc_feature (457)..(457): n is a, c, g, or t
  misc_feature (571)..(572): n is a, c, g, or t
  misc_feature (589)..(589): n is a, c, g, or t
  misc_feature (593)..(594): n is a, c, g, or t
  misc_feature (602)..(602): n is a, c, g, or t
  misc_feature (623)..(623): n is a, c, g, or t
  misc_feature (628)..(628): n is a, c, g, or t
  misc_feature (657)..(657): n is a, c, g, or t
  misc_feature (672)..(672): n is a, c, g, or t
  misc_feature (675)..(676): n is a, c, g, or t
  misc_feature (723)..(723): n is a, c, g, or t
  misc_feature (750)..(750): n is a, c, g, or t
  misc_feature (755)..(755): n is a, c, g, or t
  misc_feature (763)..(763): n is a, c, g, or t
  misc_feature (768)..(768): n is a, c, g, or t
  misc_feature (779)..(779): n is a, c, g, or t
  misc_feature (816)..(816): n is a, c, g, or t
cttccagtattaaaaaanaaaagacatttgcggacattttaaagccaactcttctatataatcggtttgangatctgaattngaaaatncccacatggntaatcatgttcttgatacacatttnctttttttttgagatggagtctcgctgttgcccaggctggggtacagtggngcgancttggcncactgcaacctccgcctcccgggttcangcgatantccngantcagcntcncaagtnactagggattacnggngtanaccaccatgccaggctaatttttttatgtttagtacaganggggtttcaccatgttggtcaggctggcttgatgcacatttcttataggtacattgggaaattgcttcctaaccacaataaacactgtgtacaggtttttaaaatgtccctggatacacnttaattttttgaagtcagtntggccaaacttgncagaaccaattattgctagctccaataaacctaagagctcaaactaaaaaactggtaaaaagaaaaatactcaggttctacaaacgtcccataatttgtctttaaataggcagnnaagatttaaaaaagagntggnnctgtctangaggtcttcagctaccttggnaggtnaatttaaaaacaaaaggttgatatactanaaaataagatgcttnagnncagctccaaaaacctttataaatacagccatttggaaggacgatccnggatcagaaattattccttgtgtatcnatatnatgtgcangtctnatttcagttgncataattgtctctgtaatttcctcctgagtagcggtnataaccaccctggtttatgccaatatagtct

SEQ ID NO: 675876 - DNA, 3831 bp, Homo sapiens
  misc_feature (3742)..(3742): n is a, c, g, or t
  misc_feature (3759)..(3759): n is a, c, g, or t
  misc_feature (3770)..(3770): n is a, c, g, or t
  misc_feature (3789)..(3789): n is a, c, g, or t
  misc_feature (3831)..(3831): n is a, c, g, or t
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaacagtccaggtgtggtggcacagccctgtagtcggagctaataagaagctgaggtgggaggatcgcttgagcccaggatatggaggctgcggtgagctatgatctcancactgcactccagcttnggggacagggnaagtctgtctcaaaaaaanaaccagacactggacttccatttaaaacacaccacaacaaan

SEQ ID NO: 675877 - DNA, 253 bp, Homo sapiens
agagtgacgaaaaaggatagttctaccacttactggaattgtgaggtaagcaacaagagagttcatataggcaaatccgtatcgcatacatcttgcagttgtgatgcatagtgacagcacttcggtcgcagtacacgaattgaatgatttcatgtttccaagcaaaagcttctcagtgttacattttttatcaaccgtgtaccgagcaacgaacacacgttcccaagcagcagtattctaaggcgagcgagct

SEQ ID NO: 675878 - DNA, 598 bp, Homo sapiens
  misc_feature (101)..(101): n is a, c, g, or t
gctggaggaactcggcacgagaatgttttttgatgggaagtcacttaaaggatatccagggctgtatgttttttactagggcccggaaattacgaagtttnttgcatgtgagggcccggaaaataaggagagagccaagcagtggcagatataagactgtccttgacggtcggccattataatatgagctggggagaaaaagggggcaaacagacaatggcgccagtgccaaatacaagatcgcccgggatagcctaaccgaagccaagaaaataggtcccagggaagacaaaagccacaagggaaaggtggtaataggaacccgccagaaagggggaactaacgaacctgggaataagcggctgggggggaaagcgattaagagacatgccctgccaaaaacgagcggtacggtgatatgatctctgcaatcctaatccaggcaggacccaaccaactctttaagagatgccaagagcagaaaatccaaccttatggcaaagcaaaggcaaaggagttatttttaagcagacctaataaaacgcccctagggggtccgttagaggccttcttttgccccctggggcggcctcgcggt

SEQ ID NO: 675879 - DNA, 380 bp, Homo sapiens
caaaacgctcgcgggagtactggtagttgcggccctcgaacttgccgcccgcatggagcacggtgtacacatttccacagtgggcatgccagcataggagcccgtcttctggtgcgccacggggatgccgcggccgttgtcccggaccgtgatggagccatcctcgtggagggtgatgaccactcggtccgcgtggcccgccatcgcctcgtccaccgagttgtcgatcgcctcccaggcaaggtgatggagtccggaaaccccggtggagcccacgtacattcctggcctgaggcgcggcggcatcaagccctcgagggcgatgatgtcttctgcaccgtactcatcttcatcgggcacctctccatgtctcgccatcg

SEQ ID NO: 675880 - DNA, 2739 bp, Homo sapiens
tgtcactttctacacggcggcggatcgggtgttgcatccttggagagagctgagagctcgagtacagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaaagctctgaaacatcacacatctaagattcaagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 675881 - DNA, 337 bp, Homo sapiens
gacacacatatcaatgaaaggacaaacatatagcagatgattgttatgtatctagtctcatcaagtacttgatcttcagaccaccttcagcccatctcaccacatccgtcccaagcccttaagagccagccaaccccaacccgccatgtactttaacaaaatagctacctttttattatacacagtacgactagcttctctagtccctggaagctacttcccctatatatatcaccaaggtacacctatgagcacaatccttctgctcccgtgaaaatccattactcctactacccttatccctcacctcatgagcttaaacagactgccaccgaag

SEQ ID NO: 675882 - DNA, 1477 bp, Homo sapiens
gacaaaacgccctgtattcctattgccaaaggttctaacttaactgtatatacctgcaagaacccatgcattttgtgcatcttattatattcctgtattgagctgcttgaatgtaaaacagtcccatccttcttgtcaactccaatctattggtggatccttataggcatttcatatctctttgtgctgtcaagattgggttccaaagcgcactggcgtcacttgtgctccaccagtgggtgctaacgcgctattttgcgagcttcataagatgccaccgttgtcttaaccagtgcactacgacggccacagtgccatatatactgtggtgtatacgccccacgcggcttctctccgtgggacaacacgctgtgaacatcacttcttacggggaaacctgtgtactctctcaacagttcctctaaagatcatacacacactgtggggttctcccttacacactttttacacacaacgtctaacacaccacacacccacaccaacacatacatacaatccaaagagacactacacacacaaacaacaccacgacacaataacacacacacaacaccacccacaacacacacaccaacacacaccataccacaccaaaccacacgacgaaaaacacaaccacccagccacacgcacacacactaccaccaacacagacacttcccaatcacagcaccacgactaccaccaccccacaacaccaatcaccatcacatatttacatcttcatgaaaccagcgacgagaccctctcgacgactaacctcacatcccaaacaatgcaatcacttacttctaatccaaatccacaactacaacaaataacaaatctcaccccgccttaagcatcacgacccctccttactcactattagatccaacctatacaacacaacatcatatctctctactcaacccaattacccccatacacatcattcaaacgacaagacaaacaaggccgaggccgaggcagcatgaaagaagtctaaacatagaagcgcagacggtcgagacacgcagcgcagaccagaacgcacaaaacaaaaaaagagaaagaaacagcacggcgcgcgtggagcaggatcaaggagcagagacagcgctagacacagccacgataaagcagaccaaacaaatcacacataccgtgtcaatcatagcttgcaatatatcacaaaatgaagccaactaacactcagcaatagatagagaacatcagagaatttaaactcaagactacaagaccagctacatacatctacactactatcaaaacatcacatgactatcacactaatactactctacaaactaaacacaacatacactccacacccagacagacaatgccatcacgactatgaataagacgtaacttaaacagttacatcatcaacatctaaaaattgtaacaccattactaaaccctcctatacaacatcatttaacactcacca

SEQ ID NO: 675883 - DNA, 615 bp, Homo sapiens
gcctgtgccaatggcttcacagcgagacaggcgtcttggctgcccacaatgataatggctagctccccggacatggacctggccacagtgtttctgcgtctcaaggaaggatgggggtgaagttgatcgaaccccacaagcaagggagacggtgcagtacagtgcatgtgctcttcctggactgtgaagtccagcacatcatccccttcatcctggtagtgaaatacggcgccgacattgaggagcagaacacattgtgagtagtaccttgacgtcgggacgcgagcgatctaccactacaggcatccagtgtggtagaagcaaagcatgtcaggccgattatcaggtccatgtcccccgagggtcatgccgtcgtgacaatggactcgaagcagctcccagtcgctgggtgcgtggcatgtggggtccaccgatgtatagcccaacaggggctaactgacaacagaccctacggttgcggaaggtaacggggaagcggcttctatgcgtaggacaatgcctagcctcgatggctaggctgctagcgagctttctcgcaactggaagggtcgcgtagaagagagaccttgaatttgggatagcccggatcaaggc

SEQ ID NO: 675884 - DNA, 3667 bp, Homo sapiens
  misc_feature (3642)..(3642): n is a, c, g, or t
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagagagaccacggaagagaatagtgatagcgcttggtatattgtcccagaaggtgaagccggccccggctggaaataaccgctatgacccatagccaggagatacttgtccgacaccctcagatctttgtcccaggccaggaatcttttaatgacaggatcctctgtgattagagagcagatgtcagtgtgagaagcaggacagggtttccgtgggagcagcagggcagcgaggagaagtgtgcctcccggggggaagtctcaggattgtggccgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttggtatcccccactatggatggagacacttaggtttagaaaagtcagtaagagacattaagtttcagagggcacagctgaaaccacttttttgatttttgattttgtttttctttatttgatttttatttttatttatttattaatttatttcnagactgtgtctcacaaaaaaaaaac

SEQ ID NO: 675885 - DNA, 3125 bp, Homo sapiens
  misc_feature (3036)..(3036): n is a, c, g, or t
  misc_feature (3053)..(3053): n is a, c, g, or t
  misc_feature (3064)..(3064): n is a, c, g, or t
  misc_feature (3083)..(3083): n is a, c, g, or t
  misc_feature (3125)..(3125): n is a, c, g, or t
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagagctgaggtgggaggatcgcttgagcccaggatatggaggctgcggtgagctatgatctcancactgcactccagcttnggggacagggnaagtctgtctcaaaaaaanaaccagacactggacttccatttaaaacacaccacaacaaan

SEQ ID NO: 675886 - DNA, 3255 bp, Homo sapiens; identical to SEQ ID NO: 675873

SEQ ID NO: 675887 - DNA, 150 bp, Homo sapiens
tgcatggctcgggctgcttgtgccctcagcgctcgcgtcttttcctggcagttggacactgcttcctgttgtcctcggcctgtaacctgcctgttgccccctgtctccagagtccctccacgcgtcccctcccgtcacattgggtaccgc

SEQ ID NO: 675888 - DNA, 328 bp, Homo sapiens
ggttgaaacgttgctgtagacttcatagacagcaactgagtgccaagatcaatagtcatctctagatgtggggtctgcaacatgtttgtagagcctcctgtgcaaagatcctatgtctcagctctttctgtgtcttgttctctttcaaagtactctcccatcatcaattttcactcaaattctatttattcttcatgctgagttattatccccttcaagaacttattctgggtaatacagtagctagggttttattctagaattatatatgcatccttgaattttcccatgatatatgttgatgtttgttgttagtcacttgtaaaaa

SEQ ID NO: 675889 - DNA, 2732 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 675890 - DNA, 2803 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 675891 - DNA, 842 bp, Homo sapiens
  misc_feature (39)..(39): n is a, c, g, or t
  misc_feature (63)..(63): n is a, c, g, or t
  misc_feature (127)..(127): n is a, c, g, or t
  misc_feature (132)..(132): n is a, c, g, or t
  misc_feature (185)..(185): n is a, c, g, or t
  misc_feature (217)..(217): n is a, c, g, or t
  misc_feature (220)..(220): n is a, c, g, or t
ggtaaagatggagctggaggaagagtcagccttgggagntgggctctgggcagcaggcggcancagtgaaggacaggacacacagttctagacctggtatggggagagatccccaggtggcgccagnctggncctgaatagggctctatcccaaggctgcataaagggcacactcagtgccccanagctcttcaggcccttcctgtgcctggcggcntcncacgctacccttttgtacctctgagaaggctctggacccacgcaggagcacacgtgtcgaccaggggcgagtatcttgtctcagggaccgtccgtatcgcagagccctgagccatgacccagccccagacaccaggtccagagtgctccagtctgaacctggtatcttcgttccaagcacagccattaccctcgttggagtcagactcaagcatctccaaagaagaacttttgagagcccaggcgctgagagagcagggtcagacactcccgagcctctcggtacagatgtaggggcagacacaggtaggcttgcagctgcgggaacagtgcacacctctgcacctaagcactcccattcctggccagcatccttggggctcatctcatacaatagcccacggtctcaagagctacctccttctccagatcttctcgtcctcagggctgggtcaccagatcagcagatgtagcgttacatgtactgccgatgcattgcggacaggcaggaagaagtttgaggggaaagggcaatagctttgggttacaattgcagggtaaattctacgtagtacttgggagatatcaaaaagtatgtactggatgggtgggcagaatgaaag

SEQ ID NO: 675892 - DNA, 1350 bp, Homo sapiens
gccattgaaatggaccagtgctggacaggcgaatctcactacctgcccggagctgccctgcaccgcgtacagacgtgtgtccctgagctgactgtggatcagtgtgtgacactggcagccctggctgacggcattaagatgcttcctgctggcactgcccgctgccagccagactgtccatctgcctgcctgccatgtggtgtgctgcatccctgactgtggcagtgatgcccatgcccatgacttccctggactgctgcttggtggagaagcttgcttcagtgaacacttgtgaaagaagcaggtgaggttagcagccgccacagcagcttggacgagctaacacccgcgcgcaaggccagaagcctggaccccacagcaggtccatgggcccacatggagtgcgagcaccaggcactaccctgacacggaatgctagacgattggttacatcggagtggggaaccagtcatcaaaagggggacagggacgggtggaccccggacgggacacaacagtaccgaagggaagccaagacacgcgcaggaacatggcagaaccgtaacacacatagactcacgcgcacgaaaatgaccggacagtaggcacacaaggcaatcaccaggagggcaaccgaacggataaccaaccggcacagtggacagcaccacaacacgagggggacgaaaaggaggacgaggagaacaagcgcgcaggcagaggcagctgagcgacgtaagcgggcgtacgtttgcagccacaaacggcacggaacgaggacgcatgccaaccccaccgacgagggacgaagacagtgccacggaagagccccggcagaaccgaggacgcggaaagcgatagtgacacgtcacccgggaacgggcaggacggaaacaccgagtccgaaagacagccagagaagtgacagcgcggatgacacacacaagtggccagaaaacgcgcgagagcagaacaagaacccgtgggcggagccgcacacgaccggagggaggacagcacacagacggacggcacaagaccaaaagggcgcacaagaggaagacaacgacaagacaacagcgggcgagcagagcccaccagaacgagactaaagccgcagcgaatagaggagggtcgccaaagagcacagagtgacacaccaaaagaacgacgagcgagaacgcgccgcaagagaagacgtcgggggacgcgcaacacagacgagaacagaggaggaaccgcaaaggaggcgaacaaggagaggacgagggacacgcgagacgagaagaagacagggagcggacgcacaggagggacagacacaggcgagggccgaagtcaagccgagaa

SEQ ID NO: 675893 - DNA, 477 bp, Homo sapiens
acccactgtacatagactagtggaggcactgaagctggctccatcttgctaatgtgtagtagatgaatcgaagacgacgtattaaagctggtattaagtaacagataatcttctctacttgctctttcacgctgtcaccagtaaacatatacttcatgtgatagaggaagtcacagatgggatccaagtaatttaaatgggtgctacactggtcaacattcagcagcatgtcataaaacgccacaccaatctctatcatacaacgagtactctcttgctgaaatctttgtaaaactggtccaacaagatggtatacataaagcaactggaatacggacttcactataggaagaagtaattccgtaagaaacttgggaatgagcgaaagtagtccgaagctaaaatggggcacacagactgtgccagagctaaagtatagctaccactcatctcagagtaggactgatgacaggccgt

SEQ ID NO: 675894 - DNA, 535 bp, Homo sapiens
gcagtaggggtggcttaagatcaggcagataacaagataacctgaaggactcgaataacatcgtatccagtgagtcctgcaagaattcaggctctttctcatccagcagctcccatgctgagcctggggcatgatgggtctaggtcttcttccacttcttggtacttttcaatttcatccatgtcaatagccaagccaacacgctgttgctccaatacgtaaaaggcacttctgtagggctggcatgagttagtcagtacaagacaacctgttgcctcttggtcctcctttttcacttgaccccagcgatgtctgcctatgtcaacagccatgcagacttgctgttcctctaatgagtgaaatgtgctgctgtaagactggtacgaggccaacatttcaggaggaattgagagagtcgaataaccttcatcccaggactcctgggggacttcctcctcttcagactcctgcagcatcctgggagacactggcccttgttcttcctcttcctcatcatcagttacatttactggaa

SEQ ID NO: 675895 - DNA, 220 bp, Homo sapiens
acgacttgataggtcatagcagtatcacgcgggcatcacggagctgcaggagagggtagatccagcgagaacttgactacactcacatggctccaggatgccctgtgccttcccagcccagtgggcctgctctaccagtgcacaggagtggaattctgaagctctggcctagaggacttcaggcccagaggcacacaaaacagtacataactcatcaatt

SEQ ID NO: 675896 - DNA, 351 bp, Homo sapiens
  misc_feature (108)..(108): n is a, c, g, or t
  misc_feature (222)..(223): n is a, c, g, or t
  misc_feature (272)..(272): n is a, c, g, or t
  misc_feature (298)..(299): n is a, c, g, or t
gaaaaaaaaaacccagaaagaaaaaaaaaaaaagaaaagacagatttgactgttgttttgggcacacaaacagatgttataggaccaagcctgaaaaattagatgttnggaaaggacagatttaggctctaagaaattcacacaagatgaggtctttaaaaaaaacgatttcctggatggtggagtttttaaaaacttaagcgccgcaaatgagataataannaagccacccctccaacctctcttcccttttaggcaccattcccagcttntatgggagggaacgatttcgaaccannacttaaggaattagtgcaaactgaaataaaaagaagaaaaggcaaacaacac

SEQ ID NO: 675897 - DNA, 214 bp, Homo sapiens
ggcgagtcgagtctaaggcttccgcctcatactccacattatttggcttgctctctagtgtatcatctcttatgttcagtatgttgttattattacgtgaaaagctttgccacatttctcacatttgtgtggttcctctccagctatacattatctgatgttgagtatgggttgtggactgcttaaagacctccccacatttttcagcgtctga

SEQ ID NO: 675898 - DNA, 927 bp, Homo sapiens
acactataaggatcccctgcctctgatgtcctgcagtaaaaggagagttacacagtaaattaatagtaagtgtgtgtatatgttatttaaaagtgatgtgacagggaagctgattattagagattattaacagaaaaacacttggaggtatgtgatgggatctgtgcagttgggacagatttcagtctcatctacgtttaaataactgaatagtgatatttgataaaagctataatagttaacagcagtccttattatgggtcagagtatgaagacttattgactaggtttaaaataaggaagggttacaggaactctaaggaatcatagatagcagctgtggaaagcagctccccacctcttgacctaggggaataaaggaggcagttgaaattactgctaacactgagatcttttaggggcaagtgttgtgctgctgttgctgtctcttgaagagtggccccatgggcatgggatcgagacttcaaactgagaaggaggctccagctgcctggtgctagtgtctctgatggagatgatgagattggttctcctagggttggataaattggatattgggttcagctgctgctgttgggcattaccactgttggggtgatgcagataaagagacaggaaggaacaagtcccttctctctctatccttgtctccctctagcagttgctattggtagaacctatggatcgagctgggaaatcagaaatcaggttgctgagtcccagcatcacagcagaatataaaggatggtttggcattggaagacagtaaccgaactggtctagtaggttcagacaatatctattgcagtgtgtttttgttcgctggacttctgtatataggagtgttttaagttttttgttttaaataacatttgtctataggaaatttgtaactacataaagttg

SEQ ID NO: 675899 - DNA, 85 bp, Homo sapiens
gctgatcctgtttatttggcagtaaaacgagacaatccagcagcccagtagggacaggtggacttaacccttctgtcgtcttctc

SEQ ID NO: 675900 - DNA, 1321 bp, Homo sapiens
  misc_feature (307)..(307): n is a, c, g, or t
cttagggcgtcttcttgactgaatctgactccattggaggctgtgaatccatggaacccagatgcacagtgcctgcgtggtcgtaccactgccccttagcactctgctcgcccgtggtgcatgagaccacgagacccccatgagcagcacgagcttgatcccacacgtgatgatgccatcatggctggtctccaagcctgcagcctcgcttgctcgtcagatccatgggtgtacatcgcaccattctcaatgggccacaaggcgccggtctgactcttccaggcttagcggagtgtcgacagatgtngtctcatcgattcctggaggctgccgcatggagtcactagggctgctctcatggttgggcctttgccgataaggacgaggctaagggtagtgccgcgaagactatacacgcataggacaaaccatggagtggacgggagcagtgggcaaagtccttactctccctaaaaggctaccccaatgcaacgttcgagacacatggggcagaccagcgtacaagacacaccagggatcctcgctgctggaggaacaggggagacatcataatgccaaccaccaaggcccttcgagtacacgctcgccactggggagtcaacgtgcctgacatggctagcggagcagctccgccgggggaaagtagcctccctgttggggcccttctaagcatggcgtcgggccacgatcacgcgcactgggagaggccatcagggcccatgttgttgccctttgggaaccttcacagggattgcgcttcgcttggggacccattctgggtgttcacccataggggtatcgacttggggccttgcgccatcacgaaggcccttccttccttagtttggcgcattcgctaacacccagtgagtgtgtgttggcgctcgtccctgggcgtgggttgagcgctagatggagcaccccttttggcgtgtgtcgtgcgttcattagggcttccctcctttcccacttagggggctttgtgtggaactcgcgttgtgggcgacgccttgcgcaccattacacaaaggcctaggccgccaaaaccgtcccaattgcgaggaccccgcgttattcagacccaatcgtcgcttggacgccccaagtgtggaagtatcgttcaagcccacaaaggagataaccttcggaacgcaaggcgatccacagtgcccattttccgtggcgcgacaggaaaggacccccccacaagagggggacccccccgcgtttaagtgccataggcccacccgggtctaacaaagtatgccttccacacgcattccatggaatataacgttcc

SEQ ID NO: 675901 - DNA, 445 bp, Homo sapiens
ctttgtacttctccttgatattaccctttgataaaaaaaaaaaaaaaaaaaaaaaaaaaaaaaaaaaaaaaaaaaaaaaaaaaaaaaaaaagatgaacaaaaaaaaactcaccataacagacaccatatcactttctttttctcgcctttttctttgcctgctctctccttccttcctttcttacccctctcgagcggggtgtcgcgtggcggtcgcggtcggttagcggcgctcgtggcgtgtcgtttgcagcggccaggttaggctgcttgcatttgtatcatatactctttttttgtctggctgcccacgtctagctgcgctggttgtaggtgcgtgcgggacgtagtatgtggttgggcctcctcgtctttgctgcgttgtcggtgtttatcatctcttcttttgtgtgtgtgctagactctgttgtagcgcctgcgtgcg

SEQ ID NO: 675902 - DNA, 176 bp, Homo sapiens
  misc_feature (176)..(176): n is a, c, g, or t
gggcggacattcagactgagcgtgcctaccaaagcagccgaccatctttcaaaacaaggaagaggggtcctgctgggggaaactggcaaggagaagctcccgcggtactacaagaaacaccggtctgggcttcaagaacacccaaggaggctattaagggcacctacatatgacan

SEQ ID NO: 675903 - DNA, 1656 bp, Homo sapiens
  misc_feature (1656)..(1656): n is a, c, g, or t
gctggagcggcggcggtgctgcagctagcgggtctgtgccgcggagcggaggtgcagctcggcttcccccgtgcaccctcgtctccctagaagcaattgccagaacgacgggtggtaaacaggacgggcaagtaccatagcataagtagatagcgacacacgtagtagggcaccaacaatagctacaagaaaagcatggagaaacgacaggataagcgagcagagcaccacatacgaagaagaactactcatacgagacggacagcacgctactgcatacatggtcaatagcatagcgaagcagaacacacaggataaagaggacgcagcagaccagacacaatataaaaaccaggatcaccacaacaagagaatgcaaaaggaaacaaacaagagagaggcgacagacacaggagagggagagaggggacaagacgacgaacagacaaagaatagacaaaacaggaagaagcgacaagaacaagggaggaagagaaggagacacacaataaaaacacacaggaacaacgagaaacacacaagagagatgagagacaagaaagacaacacgaagacaggacaacagacaagagaagcaatgagcacagaatacaaagaaagaacagaccagacacacgccacaacaaaagacaaaagagacagcaaacaacaccatgaaacacagctcaacatagaagaaaaaagaaagagacaacgaaagaaacggaagcagcaaagaagacgaggataagaggcggacaaggaaaaagaggagaaaagaaaaaagaatgaagaggagagaacgcaagaacgaagaggacaaaatgagaacacacacaaacaacagcacacaacacacaaacacaacatagaggacaaacagaaagaaaaacaagaacaacaaaaaaaaagacaagaacgacgagaaaggaaacaaagacagaagagacaaaacacacaaaagaggaagaacagagaaacaacaataaagccacacagaaagagaaagagcaaataaaaaagagacgagtagaggagagcaaagagagtagacaacaacaaggacaacgaagacaaaaaacgaagaaagaaatagcaggagagaaaaaaaaagaaacacacaaagacgagacatcacatacagtagaaagacagaggaagaaaagaaagacaacgaggagaagacaccaagaaagagacaaaaagacgagacccaaagtagacacaacagagaaaaaaaatagcgcgaaacgccgaagcgacgagacaaaacaataacagacgagaacaaaaaaagagaagacaccacaagcgcagctagtaacaacggccgacacacagaagacgaacgaaagcagacaggaagacaaggataaatagagagtaagatcagaaaataaagaataagataagtaggacgaaaaaaaaagcgaagaggcacgtacgtcagttaatgtagaaaacagaagaaagaaagagaagagaacagcaagagaagtagagacacaaagaagaagaaggatggaagacatacagagaagaacgactagggaacgaacgagtaataagagaaaacatagagaataagatagaaggataagacgaaagaagagtagtgaaaaaataattattggtgtttctatgctgacgcgcgan

SEQ ID NO: 675904 - DNA, 353 bp, Homo sapiens
  misc_feature (1)..(1): n is a, c, g, or t
  misc_feature (7)..(7): n is a, c, g, or t
  misc_feature (20)..(20): n is a, c, g, or t
  misc_feature (38)..(38): n is a, c, g, or t
  misc_feature (42)..(42): n is a, c, g, or t
  misc_feature (138)..(139): n is a, c, g, or t
  misc_feature (141)..(142): n is a, c, g, or t
  misc_feature (144)..(145): n is a, c, g, or t
  misc_feature (189)..(189): n is a, c, g, or t
  misc_feature (193)..(193): n is a, c, g, or t
  misc_feature (208)..(208): n is a, c, g, or t
  misc_feature (238)..(238): n is a, c, g, or t
  misc_feature (240)..(240): n is a, c, g, or t
  misc_feature (249)..(249): n is a, c, g, or t
  misc_feature (268)..(268): n is a, c, g, or t
  misc_feature (325)..(325): n is a, c, g, or t
naaattnaatccaaattttnttaaggatttcaggttanatanttcaaatttctagaatggaatggaatcattttgggactggaaaaatggcataaacactgacgtcccttaaaacttcaattttataaagaaaattcnncnncnnaccacatcccctttatgtaacaagactacgcgtattatctacancttnactttggcaatagcnatttcctaaagaatgaaaaagatgattttncnacttccgtnccttaaaaatgggattctntctttgaagttcagaaaaagctgcatttcggtgaactatggttaaaaaaaaaaagcncatagtgtctaatcaaagcaaaggaaat

SEQ ID NO: 675905 - DNA, 460 bp, Homo sapiens
tattgatcaaagagacatattgcaaaagtccagagagtataaaacatattcagacccagtctaggccttactccagagtcgagctagttctgcaccttctagaatgtgtatcaaagaagtgtgagcttgcatgatttaaaattcaataagaacttgcaatacaagattccgggtagatgttgttcggctatgtccccagccgaatctcatattgaattgtagtacccataatctccacatgttgtgggagggacccagtgtggaggtaatacagggatttcctccgatgctattcgcagtgatagataagttctcatgcagatctgatgtgttttataatggggcttccccccttcgtctcgtgcgtctcattcgttcttcttgccaccacgttgaagaaaggacactgcttgttttccgctttccaccattgattatcagttccctgattccttcctag

SEQ ID NO: 675906 - DNA, 106 bp, Homo sapiens
acggtgcacacgttatgaacgggaagaatggcgtggcatggtggctcctggaaaagctcacccaggcagaggtgccctgagctcggggccttggttttcttgtccc

SEQ ID NO: 675907 - DNA, 817 bp, Homo sapiens
ggactctatgagctagcccgtagtgctgttgtatactgggaaagtgctttgtaccgaggtatgcagtgactatacccacagacatgaaaatcaaccttagcgagtaaagatgacccaaagcattaagaatgacaggacaagagaaagtcagaatcggctactaaatactgcccctacatctttcctgtgagcccgagggcctcagtccataggctagtgagtcatcttgccctctgaagcttacttttggcttctttggtttcaagcaattgagaaactgtcacattgccccgtgatgttttgacagttctcctatgtgctcctggtagtgccacgtaacgggaagaaccaagtgtgcgcattctcttctccactggactttaccgttacttgttagtctacagccccactgtttccacccatccccttagccaacctctgtcttctgtgaattattctgagcaatattgtcctatcctcttttactatatggagttctctcctctttatatcctgagactttgacaccagatgtagactattctatctggcagctggaaatgaaaaattctttgtctgtacctcatgcctatctggtaatgtctactgggttattctctctttgagggtggctttctctggaacattggttagagcagcttagttgtcgtgtttctgggattctcttccccatatttgcgtaacatattggtctaatatattctatgcctattttcgtggcattatgctcaccataaagatatgaacctgatatagacaaggtactacctttttcaaattctgaaaggctatttac

SEQ ID NO: 675908 - DNA, 217 bp, Homo sapiens
ggtcatctagaggatcccgcagcgtcgtcagaggggagagatagtccggcaagtcagttccacggcatctgctgtcgccgaagtcgccgctgcatggtccaggtggtctcgtgctggccgtgctgcatgaagagcgtgttcaggacgaggaaacctggaccgatgataatgcatggggagcagcaggcatagtcccctacccaaaatgcacgctggg

SEQ ID NO: 675909 - DNA, 142 bp, Homo sapiens
cacgaggtggtgacctggcattctgtgaacttgccgtcataatgatacttgttcacggcctatgggactgggaatatcctgccttcaggcaattcggacgttgtcctggataattagccatgcatgcactcatggcgcttga

SEQ ID NO: 675910 - DNA, 428 bp, Homo sapiens
ggtaacagctatgacatatgaggaactgtggctagttcttcctgtgagtataaactgtttaggcgagaacatggtagctgtcttctcataccttagattgtcatttcacaaacagtgctcagaacccaaactagtggactactattagtaacgcgagacaggtttcagctcactacatggaaggaagacaatctcttatgtatgggtggtagagaacactcagaaaccaactgacattgaatagaggtggctggactaaaactcagtaactctaaagcctctttgaatgcttgagcctacgactttgtgatatatgtttaaacttatggccaaatctggatgtttttcaggagttcatgaagtcatacaaaagtttgaactaataggtttaagtctggggtccctgagtcactccttttacaagtctc

SEQ ID NO: 675911 - DNA, 2634 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaacaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 675912 - DNA, 218 bp, Homo sapiens
  misc_feature (76)..(76): n is a, c, g, or t
  misc_feature (110)..(110): n is a, c, g, or t
  misc_feature (127)..(127): n is a, c, g, or t
  misc_feature (147)..(147): n is a, c, g, or t
  misc_feature (198)..(199): n is a, c, g, or t
ttgagaaggaacagattcagtcagaggggatgtagtaagttaaaatggtgttatccactcactagatgtatgaccnatttctgataaatacatcaaaatactactttctncatcaaaatacaactantaaaatagagaaacggacangtatgaatgatggttcttaggctacaaagtggcctctaaacaagaggtggnnaagttcaagtctattgttt

SEQ ID NO: 675913 - DNA, 1557 bp, Homo sapiens
taaattttattttattttggaaacagagtctcactctatcacccaggcgggaaaccaggggcacaatctcgggcttcactgtgaaacctctccacctctccagggtttcaagcatattcctcctgtgtgtctcagctctccccgagtatagcgtgggattacggggtggacccaggcccaagcgccgatcccccacaacagcctcactcagcgattgtgaccgtggaactctctgtgtgtcttcttagcgggccgtgcgtggtgcctcctgtgggcgggaaatctcctctcccccacactctcgttcatctcaaatgtgtggtgggctcctccctctgtgggcctttacacctgtggctgtgccctatacaggccccgccgggttctcctcgtctcagaggggggaatgtgtggtgcgtgggtggaaagcttttcgctcctgtgggtgtgcctttttttctcaatctctgtggtggggccacaagcctgtgtgtggtgggtgtgtggctcttctcgcttaaacatatcttcatatcgaggcccttgggggggaggtctcaccatttcctctctctcccctctcagcgtggccatctcttacccccgagggcgcgcggagaattcttcgcggggtgggctcccctcaggggacacgtgggggacagcgtggggcgtgctgtgggggggccccgtggttccatacgcgggggccctacaccacgagggcgggggcctcttccccccttcagaggagaaaccgcgtggtttgtgtccatgtgggcgggggaataatccgcgtggtcctcgtgtctgtgctgtgtggcccaggcataatctcccttgtggggtgggccctccacaattcttcccgtgggggggcccccgaagaggaacccccgttgggcagtgcggtcaacggaacagaacgccagaaaggaggacgccaagcccccgggagaagagccccccctctaatatagaaacaacccgtagggccccccgggaggagacttagaaaaagcccaagagggacttcacaaggcttccaagggacatctttctcccttctgctggcacacacgggggagaacaaggcgggttcacaaaggggggacaaggcgcagtgtgggcggcacacttaggtgtcccccttagagggacctgaaaatctaactttaggcggaaggaacatttccctatccacaccagggggagattagttttaggaaacccccctatttatcctggggaaaagcatctccgctggagaatacgaggcggcccacagaaaaacccgggcggtggacccaccaattggctatccaagggggcgaggcaatgtagtacccccacaaagactaaatccgacagaagagggaaacccgcacaaccaggtagagcacgcgcacagagtgaagtggcaacgccaggaggtgatcccatctggacaaacgacatgaacagaagcacagcaacgacacaaacgcagcgcagcaacaacagaaagaaggaccggcaggacgacaaccaacctagcaccccgcgatagtaaacaca

SEQ ID NO: 675914 - DNA, 3537 bp, Homo sapiens
  misc_feature (3512)..(3512): n is a, c, g, or t
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatcttcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagagagaccacggaagagaatagtgatagcgcttggtatattgtcccagaaggtgaagccggccccggctggaaataaccgctatgacccatagccaggagatacttgtccgacaccctcagatctttgtcccaggccaggaatcttttaatgacaggatcctctgtgattagagagcagatgtcagtgtgagaagcaggacagggtttccgtgggagcagcagggcagcgaggagaagtgtgcctcccggggggaagtctcaggattgtggccgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttggtatcccccactatggatggagacacttaggtttagaaaagtcagtaagagacattaagtttcagagggcacagctgaaaccacttttttgatttttgattttgtttttctttatttgatttttatttttatttatttattaatttatttcnagactgtgtctcacaaaaaaaaaac

SEQ ID NO: 675915 - DNA, 2624 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 675916 - DNA, 264 bp, Homo sapiens
tctgctcggaccacagcaaggaaacaatcaccgagtgaaaagatacccagaaaatgagagaaaatatttgcaaaacctacattgccgaaggggcaaatatctgaatacataaggaattccactcaactcaatagtcgcaaatcaaacaacctgtttgaatgacagcccctggacctaaaatcggtttctctcgagaagcaatgttccgagagcatccctctgaagagttgcggacgtgcaggacagtgggatcctcgtagcagt

SEQ ID NO: 675917 - DNA, 2630 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctgaaagtggtaccgactaatt

SEQ ID NO: 675918 - DNA, 640 bp, Homo sapiens
  misc_feature (2)..(2): n is a, c, g, or t
  misc_feature (10)..(10): n is a, c, g, or t
  misc_feature (18)..(18): n is a, c, g, or t
  misc_feature (27)..(27): n is a, c, g, or t
  misc_feature (37)..(37): n is a, c, g, or t
  misc_feature (46)..(46): n is a, c, g, or t
  misc_feature (88)..(88): n is a, c, g, or t
  misc_feature (103)..(103): n is a, c, g, or t
  misc_feature (109)..(110): n is a, c, g, or t
  misc_feature (135)..(135): n is a, c, g, or t
  misc_feature (156)..(156): n is a, c, g, or t
  misc_feature (158)..(158): n is a, c, g, or t
  misc_feature (169)..(169): n is a, c, g, or t
  misc_feature (174)..(174): n is a, c, g, or t
  misc_feature (226)..(226): n is a, c, g, or t
  misc_feature (228)..(228): n is a, c, g, or t
  misc_feature (234)..(234): n is a, c, g, or t
  misc_feature (250)..(250): n is a, c, g, or t
  misc_feature (269)..(270): n is a, c, g, or t
  misc_feature (291)..(291): n is a, c, g, or t
  misc_feature (293)..(293): n is a, c, g, or t
  misc_feature (295)..(295): n is a, c, g, or t
  misc_feature (304)..(305): n is a, c, g, or t
  misc_feature (309)..(309): n is a, c, g, or t
  misc_feature (326)..(326): n is a, c, g, or t
  misc_feature (347)..(349): n is a, c, g, or t
  misc_feature (351)..(352): n is a, c, g, or t
  misc_feature (360)..(360): n is a, c, g, or t
  misc_feature (364)..(364): n is a, c, g, or t
  misc_feature (370)..(370): n is a, c, g, or t
  misc_feature (378)..(378): n is a, c, g, or t
  misc_feature (383)..(383): n is a, c, g, or t
  misc_feature (392)..(392): n is a, c, g, or t
  misc_feature (415)..(415): n is a, c, g, or t
  misc_feature (419)..(420): n is a, c, g, or t
  misc_feature (447)..(447): n is a, c, g, or t
  misc_feature (450)..(451): n is a, c, g, or t
  misc_feature (487)..(487): n is a, c, g, or t
  misc_feature (494)..(494): n is a, c, g, or t
  misc_feature (500)..(500): n is a, c, g, or t
  misc_feature (511)..(511): n is a, c, g, or t
  misc_feature (513)..(513): n is a, c, g, or t
  misc_feature (522)..(522): n is a, c, g, or t
  misc_feature (544)..(544): n is a, c, g, or t
  misc_feature (635)..(635): n is a, c, g, or t
cngcacctcnggcgccgncgccgtccngcgcagaacnatcggccgngagcgcggaagagttgagcgctgcgcgggcggactccttggnactggcttagcgcanccatcnnatcttcccagacaccctgggaccgntccaacgagcggctcctccangnggagcccttgnagggnatggccggcaccattacttccaaccgagtggtagctcattccacctcccctnangggtgnaccgcctcttggtggnagtcaggtcactggataannccatcgacaataacgacaaangncntgattgagnncggntattgattagagtttcnaggaggccctcgccatctacnnncnntgtggcangcgnaaaatnatcctgtnggaanagggacaanatgtatggtcggaacgaactagnttgnncgctacatcaaactctggacagggaanaanngcaccaggaaatatgtctctatctactatcaaggtnctggctngtcgcnaagctcgcgananccaggccangctaaaggaccaggcagctaanggacaaggccctgcagagcatggctgccatgtcgtctgcacagatcatctccgccacggccttccacagtagcatggccctcgcccggggncccgg

SEQ ID NO: 675919 - DNA, 644 bp, Homo sapiens
cgcagtggctcacgcctgtaattccagcactttgggaggccgaggcgggcggatcactaggtcaggagattgagaccatcctggctaacacgctgaaatcccgtctctactaaaaatgcaaaaaaaagttagccaggcgtggtggcgggcgcctgtagtcccagctactcgggaggctgaggcaggagaatggcgtgaacccgggaggcggagtttgcagtgagccaagatcatgccactgcactccagcctgggtgatagagcgagactccgtctcaaaaaaaaaaataattaaatatctaccatacaaaaaaaaaaagaagaaaaaaaaaaaaaaacagtgtgtggggcgcgcgccggggcccccggaaaaagctttctcgaaacccttccgggtgggggcgcgcgggggccccgtgggttaggggaacccggggccacaaaggggttccccgagggaaaatccgcgggcaatggacatagggcggtggggttttcccccacaatataaaaagagcgccgcggggggaacacggcgggtgtttgctgaaacaatttccgaggagggggttgcgggaggccacataacgggtgttctttcacacggggggtcccaggggaggcccgcaattttcaattaccag

SEQ ID NO: 675920 - DNA, 2316 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcaagcaatcctcttgcctcaggactttgaggctgcagtgagttgagattggccactcc

SEQ ID NO: 675921 - DNA, 990 bp, Homo sapiens
  misc_feature (277)..(277): n is a, c, g, or t
ggagagagagaactagtctcgagttattttttttcttgtttttaaaaacaattctctaggtgcacggtgcccaaggggtcattctagaacacggggtggcgcaccacccgcttagaagcaaggagaaacaacgaagaaagggcaaactaattgcaagaaggcagccagagcttctcccagtatgtcccgctgtgtcgtcaggaccctttccccgagagcttgggcaggtggcgcagctccggggctgtggccacgaggcagggcgttggtatcacgntatccgtggtcaggggcaataagccaagcgtgtcgtggaaggagtcgggggagtccaggaaggactggtgggggaactcaccaggccattgtgcgtgacattgggggctgacaggcgtgaaatctgccaaggccggagggacccctgaggcctcatcgctcacgagggggtcctattccgggaaggagtgcctgaatgtgcgaattcccgaggcactgtcgtcttcacaggcaagtaagggaaaagccatgtccttgaacagggagatagggaaagtatgtggccctctagccctcacctcaagagagacggctcacaggtataaatggagcaggaggaacagatgtgcccagatagtggggtcctagtcgcgggccgctaatagcccatgcgcaaaacgagaccttctcgttcagaatgcaagccgtcaggaatgcgccggtatgaaatgcagggttcatacggggggttaccacaacagagaaagcattgcctacggggggaccacaagccccgtgtgtaagcctcggggatcacgcaacgataacaagcggcgcacaggggtgatcactgggaaggcgccctagggcccagaatcggggaagccccccatgggggcccggtgcaaatgtggttggtgggggcccaagtcgtggccctccaaagaagaccaggagacactccggaagtaaactgggcaccaaagattgagc

SEQ ID NO: 675922 - DNA, 394 bp, Homo sapiens
cgagatcagccggctcagctgcccaagtgcgggatacaggcgtgaacacgcgccggctcattgccattctgagcgttagatcgaaccttgcaaagtcgggcactagatgccactgagactttagagaaatctgcttatcctggaattactcttctgggagtgctgcgggaagcactgcagttgggaggtactgggtctaaaaagagcttcatttgcataaaatacatgttggatggtttggttggctaaggactcaatggagccctagtaattgggtgaggtcgagtgggtagaaaataaaaagaagcattcctttcttccccaaccttcttttcctcaccacaaccttcaccattacggtgttacttcataaaataatgaagtaacaccgtaa

SEQ ID NO: 675923 - DNA, 1839 bp, Homo sapiens
cacttcccccagcaagcagacgtttccggttgttctctctctctccttcccacatcaaccgcaaaagccatcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 675924 - DNA, 1768 bp, Homo sapiens
gaattccggctctctggggtaaaggcagaatattggggtctatttcggaaatccgaagaacccaattgcttgatctggcttcaagcctgggcaacgtggcgagatcccctctccacaaaaatacaaaaactaaccgtgctagatctgtttctaatgtgacaacatcacgaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaa

SEQ ID NO: 675925 - DNA, 151 bp, Homo sapiens
aattgtagcctttgtgggatgccctgtgtagattattcagggccacagtttgattaatctacacagggcatccttcaaaggctacaattaaggctgcccctttgtagattattcattttgtggcactgaataatctccacagggccatctc

SEQ ID NO: 675926 - DNA, 111 bp, Homo sapiens
aaatcccatcaccatctaccaggagcgagatccctccaaaatcaagtggggcgatgctgccgctgagtacgtcgtgaagtccactggcgtctacaccaccatgaagaaggc

SEQ ID NO: 675927 - DNA, 3068 bp, Homo sapiens
  misc_feature (1511)..(1511): n is a, c, g, or t
  misc_feature (2979)..(2979): n is a, c, g, or t
  misc_feature (2996)..(2996): n is a, c, g, or t
  misc_feature (3007)..(3007): n is a, c, g, or t
  misc_feature (3026)..(3026): n is a, c, g, or t
  misc_feature (3068)..(3068): n is a, c, g, or t
aataaaaattaaaaatagatgtagatgctatgttgctgaggctggcctcaaactcctggcctcaggtgatcctcccgccatgacctccaaaaccacagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacaattgctgtgaaggtgagaaaagttcatttttattatgtttccccaagagacgcactctattgttctcttgaaaacacacagctcatgtcctcctttagaacacacatcctctttaaagtaacatacaaacatgccaaaacaaggtaaaaaattacatctgaattctcacatttcaaatatatatgaaatatcaaataaaaatttatttttacaagaatttaggggaactactacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatataacagttataatatccatcacacagctttatagaaacagcatctattcaaaaataccagtatttccaaaatatttaaaataatatttaaagtaataataatatttaaataaataaatatatttaataaatatttaaataaataaaataatatttaaataattctatacccatgtttttcaaaataaaccaataaaatagatagtatatattagacgtgttagtatatatatctgaggcatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatgtaataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccgacattttccatacaaaccaataaaatgcagagtgtgcatgaagctatctgttacaatctgtggcactgatatttcacaaaagaattctgtcccaatctgagcccctgcattgtgccttcaaatcctcctggactgcaagtccgtaagaaacaggacctccaggttccgccccagggaggttggaattcagcaatataaaaagggtggtggtgccgcaggaaagggtggaactggaaacnctcctggtttcttacttttctccaaggactcctagaaggaccccacccccctccccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttcttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaacagtccaggtgtggtggcacagccctgtagtcggagctaataagaagctgaggtgggaggatcgcttgagcccaggatatggaggctgcggtgagctatgatctcancactgcactccagcttnggggacagggnaagtctgtctcaaaaaaanaaccagacactggacttccatttaaaacacaccacaacaaan

SEQ ID NO: 675928 - DNA, 2275 bp, Homo sapiens
  misc_feature (1511)..(1511): n is a, c, g, or t
aataaaaattaaaaatagatgtagatgctatgttgctgaggctggcctcaaactcctggcctcaggtgatcctcccgccatgacctccaaaaccacagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacaattgctgtgaaggtgagaaaagttcatttttattatgtttccccaagagacgcactctattgttctcttgaaaacacacagctcatgtcctcctttagaacacacatcctctttaaagtaacatacaaacatgccaaaacaaggtaaaaaattacatctgaattctcacatttcaaatatatatgaaatatcaaataaaaatttatttttacaagaatttaggggaactactacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatataacagttataatatccatcacacagctttatagaaacagcatctattcaaaaataccagtatttccaaaatatttaaaataatatttaaagtaataataatatttaaataaataaatatatttaataaatatttaaataaataaaataatatttaaataattctatacccatgtttttcaaaataaaccaataaaatagatagtatatattagacgtgttagtatatatatctgaggcatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatgtaataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccgacattttccatacaaaccaataaaatgcagagtgtgcatgaagctatctgttacaatctgtggcactgatatttcacaaaagaattctgtcccaatctgagcccctgcattgtgccttcaaatcctcctggactgcaagtccgtaagaaacaggacctccaggttccgccccagggaggttggaattcagcaatataaaaagggtggtggtgccgcaggaaagggtggaactggaaacnctcctggtttcttacttttctccaaggactcctagaaggaccccacccccctccccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctctctccaccttccagcagatgtggaccagcaagcctgagtatgatgaggcaggccctccattgtccacaggaagtgcttataaagtcaggacaggttctccaaggatcccctcga

SEQ ID NO: 675929 - DNA, 1967 bp, Homo sapiens
  misc_feature (1511)..(1511): n is a, c, g, or t
aataaaaattaaaaatagatgtagatgctatgttgctgaggctggcctcaaactcctggcctcaggtgatcctcccgccatgacctccaaaaccacagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacaattgctgtgaaggtgagaaaagttcatttttattatgtttccccaagagacgcactctattgttctcttgaaaacacacagctcatgtcctcctttagaacacacatcctctttaaagtaacatacaaacatgccaaaacaaggtaaaaaattacatctgaattctcacatttcaaatatatatgaaatatcaaataaaaatttatttttacaagaatttaggggaactactacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatataacagttataatatccatcacacagctttatagaaacagcatctattcaaaaataccagtatttccaaaatatttaaaataatatttaaagtaataataatatttaaataaataaatatatttaataaatatttaaataaataaaataatatttaaataattctatacccatgtttttcaaaataaaccaataaaatagatagtatatattagacgtgttagtatatatatctgaggcatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatgtaataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccgacattttccatacaaaccaataaaatgcagagtgtgcatgaagctatctgttacaatctgtggcactgatatttcacaaaagaattctgtcccaatctgagcccctgcattgtgccttcaaatcctcctggactgcaagtccgtaagaaacaggacctccaggttccgccccagggaggttggaattcagcaatataaaaagggtggtggtgccgcaggaaagggtggaactggaaacnctcctggtttcttacttttctccaaggactcctagaaggaccccacccccctccccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccag

SEQ ID NO: 675930 - DNA, 121 bp, Homo sapiens
tcacagcgttatatcagaatagtattctccccaaatcaaccatttaatgtattctaaaagggaaaaaatgacaccattacatagacttagaagtgaatgtaggctgggcgcggtgtatccg

SEQ ID NO: 675931 - DNA, 803 bp, Homo sapiens
  misc_feature (54)..(54): n is a, c, g, or t
ggaaaacagttggcgccgccgccgccggggcctcatttccaggtcagcccccgngctgacgctggcgttgcgtcccccgggagcttgcgctaggcgaaaccggctgcgcgcgctttgtgtggctccaagtccgctcctaacgctcccttgcccggtccggggtccccggcgcaaggttaggggcccactctgacgggcgggggaagacacagccgggggggggaggcaccgccgggtttggccagggatgtgttccgttggccttcagggggaagaaaaaggcctttcaggaaggtttgaaaagacaggttttcaatttccacactcaaaggaaaggtttggagccaaagcatgtgtgtttgtctcaagtggggtacgaaaatttacgggaagaaaaattcctttgggttgggaaaattaaataacggggcgaaaaggaattttgggcgcacctgtgtgaattcacagagtcatttttatattcaacggaggaagacgaatttgtgggagttccaagacggaccctttttaagaaagggttggaaggaaaattcccatgtggcacgcgtatttgttgaccttgaacaaaggcactcttttaatatttggtggggcttaaacgctggcacccagggtgtgtttgtgagggcaaaagaaaatcttccctcttttttccctttctttccaaaagaaaaagaaaacactataatgtgagggttgtgcggggacaatacagcacacaaatgtgcgcactcattttaagaaacagagaaagacgttaatttattgtgggaattcccaaa

SEQ ID NO: 675932 - DNA, 951 bp, Homo sapiens
ataataactgtaagcgcgtacgcggaatcgggatgaatctacttaagaaatggtatcataggacaggtctgtaataaaacggaaacgaacctcaagtgtaaagtataaataaatagagttcattcatatcagactatatagctgttacggtagatcgtggtgtggaaatgggatgatgtcaagtatccattcaacgtgagggagaaacgcacacatggacaaaacagtacctctaatggctccatggtatatgattaatatatatatatatatatatgtctcatcctatatgtatatatataaggaaacttgccttatttctgaagttgctgggtgggatttctctgttctttcaccccctgggggaacacctcagttaaagcaagatcagtctgttggccgagagtggtggctcacgcctgtaatcccagcactttgggagtccgaggcgcgtggatcacctgaggtcaagttctagaccagcctggccaacatggcgaaaccccatctctactaaaaataaaaaataataataaagtgaaaaaaataaaaaaaattagccgggaaaaaaaaaaaaaaaaaaaaaaaaaaaaaaaaaaaaaaagaaaaaaaaaaaaaaaacaaatgaaacaaaaaggagaagtggggcgggcgctacaaaatatgtacaccggcgagagagggaaccagcagacggaaacggggcacacagaagtgtagaggaagaaaaaaaaagtagaccccccacagattgtggggagcacaaatcaacacgagacgaggaaccgacgcggcggcggcgactaaacacccagggcggccgagcaaaaacaaacaggcaatagagggaacgtatgcggagaggaagacacaaccaaatatagaggggcggaaaaacaaagagcaggagacaaccgccaagaagaagagaagaggtcgcagtagcgaaat

SEQ ID NO: 675933 - DNA, 1016 bp, Homo sapiens
  misc_feature (14)..(14): n is a, c, g, or t
  misc_feature (124)..(124): n is a, c, g, or t
  misc_feature (184)..(184): n is a, c, g, or t
  misc_feature (237)..(237): n is a, c, g, or t
  misc_feature (301)..(301): n is a, c, g, or t
  misc_feature (464)..(464): n is a, c, g, or t
  misc_feature (575)..(575): n is a, c, g, or t
  misc_feature (579)..(579): n is a, c, g, or t
  misc_feature (586)..(586): n is a, c, g, or t
ggtggcctcaggangcttggatattaattcttctgtgaaaggggctcgttctgtcagattctctgatgcattcaatattccactcataacttttgttgatgtccctggctttctccctggcacngaacaggaaaacgggggcctcctccggcatggtcccaagcttctctacgcatttgcttangccactgtacccaaaatcacagtcctcaccaggaaggcctatggaggtgcctntgttttcatgggctctaagcacctttgtggttatccccactatccctggcccaccgcagaaatngcagtcatgggagccaagggcgctgtggaggtcctcttccaagggcatgagaatgtggaagctgctcaggcaaagtacatcgagaagtttgccaaccctttccccgcagcagtgcgagggtttgtggatcacctcatcccaccttctcccaaacgtgcccgantctgctgtgacctggatgtcttggccagcaagaaggtacaacgtccttggagaaaacatgcaaatattccattgtaaacaaatcaaaggaaaagaaaccaagaactgaatnactntctgccnattcacatcccattcctgcctttggcaatcatgaaacctgggaatccaaatagttggataacttagaataactaagttcattaaattctagaaagatctctttggtgccttactgtacaatcatttactttcttaaacatttcaagtggtatatccttgagcattaaattcgatttccacacggtgcgaaatctgacaatctcaatacaactagaacgaccactagtacacagtgtcatcatctagagctgattctaatttcacacctctgggtatggtactttatcctctcgagtaagttaaacatatccataggtgagatacatagtaagtcccacggcaaagtaacccttaggcttaagttccttatctcacaaatagggtatatgccctatctaccctaatcctccatgattggcgctaagtgatg

SEQ ID NO: 675934 - DNA, 620 bp, Homo sapiens
  misc_feature (551)..(551): n is a, c, g, or t
ggcccccaacgcggccgcgtctcctccctcggcgtagtccgcggagcgagccacagcgcgcggggtgagccatcgagagggcgcagagacggcggggctgcctgcagacctgacagacctgcacgggctccggccggacggtgagccagtgctgcgtgactgcgagtggtggactccgtaactggaccggtggtagcggagctgatcggcgggagggctatctgagccagacggtgtgaggcggcgaggcgaggccgagccgcgagcgacatgggggaccgggagcagctgctgcagcgggcgcggctgtgcctgagcaggcggagcgctacgacgaacattggccctccgcctattgaaggccggtgaccagagccttggaacacacttaaacgaagggaattccttattaagggacttcccacggcttgattccatggcaagttggctggcgagacaacctcaccctctggacgagcgaccagcaggatgaagaagcaggagaaggcaactgaagatccttcaggtcccctggcccttccttcaccatncaccccatcatcaccgattcttccttgccacaatcactaaatatctagtgctaaacctatctgtattgg

SEQ ID NO: 675935 - DNA, 259 bp, Homo sapiens
cccttaaggttgggggcacccgggccgaccccccgggttttttttattggggaccttggccccggggggttttttccccccccccccccgcctttccccctgggggtttttttttagggttcccccccccccctttttttccccccccttttgggggtttgggggtttttttttccccggggggggggggggggcccccggggttttcttttcccttttttttgccccttttttttaaaggggcccccttttaatttta

SEQ ID NO: 675936 - DNA, 145 bp, Homo sapiens
cggaacagtggcttcgaaggggagctctgggtgaggacccaactgtggctccgctgctgctgttgtgaccatggacttggctggaggttcagggaccgcttcggttgaagcatctgactcggtcttgggtgatacggggtcttgc

SEQ ID NO: 675937 - DNA, 139 bp, Homo sapiens
ggggaccttcctgatccagcttctcatacaggaactcctccactcgggcactggggttgggctgcagcagctacctctgtctgcctcaagatcttctctgtccacgttcttgtgtgctgtcgtgcccggtgcgcagggc

SEQ ID NO: 675938 - DNA, 524 bp, Homo sapiens
aaaaatctataaacaaacccagtgaagattatattgtaatatcatttaataaaaattattattagctatctaaacttgggcaaactcttcactttttgtattaggccattcttgtgctgctatgaagaaatatccgagactggataatttataaaataagaagtttggctcacagttctgcaagctgtgcaagaagaatagcagcatctgcttctggggtggcctcaggaagcttccaatcatggcagaaagcaaagccaggtcgccatgggttgggcagatcctgaagagaaccaacttgagtctgacagtccttccagaacacggcacccacctccaccatataacacagccaagtgaaacactaaggaggctctgtaaggcatgactctgaagaaggccactatcttttatgccgtgacaccatttctcagaacacatcacatggcccctgagtggtcaggagtccagagaaaaacagtcaagccctcctttaatagtaaaatttttgtctgaccctctca

SEQ ID NO: 675939 - DNA, 162 bp, Homo sapiens
agcagtcacccaatgtcactcttcttcaagatgaagatcggagccatgacacatgttaactaagcacagactgaatggttactcagaagataccactgcgaggtgaagtaaacatcagccgagcatcttctctttccaaaattttctgagtctgatcatcat

SEQ ID NO: 675940 - DNA, 797 bp, Homo sapiens
tccgtctttgctcctaacatctatgtactggattatctaaagtgaaaccacagcagcttactccagagttcaagtccaaaggccattgttatctcaacactggtaccagagacagttgaactacaaacactatgatggctcctacagcacctttggggagcgatatggcaggaacccagggcaaacacctggctcacagcctttgtcctgaagactttggcccaagctcgagcctacatcttcatcgatgaaagcacacattacccaagccctcatatggctctcccagaggcaagaagggaccaatgcctgttccaggagctctgggtcacttgctcaaacaattgccataaaagggaggagtcacacagatgaagttgaccctctccgcctatatcaccatgcgcccttcttgagattcctctcacagctcactcacccttgttgtcccgcaagtgcccgtgttttgcctgaagtcagcctggcaagacagccacacaggaaggggaccatggcacgccattgtattataccaaagcactgctggccatatgcttttgtgcccgtgcaagataaacccaggcacaagaggaagggaaggaactccaaagtcactttactgagaaagctgtgcacaaaaagacaacccttgcccatttgggacgccccttcagaaaaagcaaaggcccagtgggcaatttttagaaacccaggtccctctgctagggggaaataaatctaatggcccctcgctatttcaacggcacagccaaccgggggaatgtacctgaacacat

SEQ ID NO: 675941 - DNA, 361 bp, Homo sapiens
tcatcaccctatggagtcctcttcgttttaaaattctgactgtggtgttacggaaggaccttctaggtgaaagggtaaccgaaataacaaaggttccatttcgtccttcagcaaattcaaaagcttgagagcgagtcatacaatgtgattatttgataattctctctatattctgatagaagaaccagagggatataaaagacagaaaggtaaaatgggatggcatatggtaacaactggaggcttagaacctagcagatcggggtcaccatgttggatgaatgtgaagggtaattatgccgggaggggtcacaagaagaatcttaaatgaagcttctaaggataggcagggtttcgatga

SEQ ID NO: 675942 - DNA, 396 bp, Homo sapiens
aatggggaagaagaattggggaagtagtacaaggggaagggaaatttaatagaggtgtgactgccttatctggcatcaatgggagaggaggtctttggtcctgaggaggctcgaagctcccagtgtagggagatgctaggaaggagaagtggatggggaaagcccacaagaccgaaaccctacacaaagaactacagacaactaaggagtgctgggagtgggaggggcttctgctgggaggagcacagcagctggttatcaatatgtaatggtcatccctgaaggcatgtgcaggtaacattacacatgctgagcaggttaaaaattaaggaacatgagcccatgagtctgaaagagatcaaaaatgcaggacatgggagggtttggagtcgacgc

SEQ ID NO: 675943 - DNA, 185 bp, Homo sapiens
tgtgtctctaccggtctcaaccccactcgggcagaggttctcataacagaagaatctgttatggctaaacctgctctcacatgaaactctctctatccctctatggcctcctcccttcctctctctaggagaattattgagttcatacagccagctgcttctctgtcgacgcggccgcgaattta

SEQ ID NO: 675944 - DNA, 145 bp, Homo sapiens
  misc_feature (12)..(12): n is a, c, g, or t
  misc_feature (18)..(18): n is a, c, g, or t
  misc_feature (65)..(65): n is a, c, g, or t
  misc_feature (70)..(70): n is a, c, g, or t
ctactctcctanttgtantttgtggtcctatcaaagtgtcgtatctgggagatgacctgccttancctgntctataacagttttgtttgctgctgtgtctttagaacagtgcctggcacacagtaagcactcaataaatctttga

SEQ ID NO: 675945 - DNA, 153 bp, Homo sapiens
ctccccgttgtactgttgaccagtacccgactatagctcaatacattattcatgcttttactgctctctctctcggataataaagagggaaaaagttacatcatacttcaatttggtttcaccacgtaatggtctccaacccataagaggacc

SEQ ID NO: 675946 - DNA, 388 bp, Homo sapiens
agatcctttccatccacctgataaatctttctatttaagagctataaaacaccagctaaaggtctagctggtaatctagaaattgtgtgcccttgaagcattcctaacagaaaacatgaaattattcatctggcctgagactgtttaatgagaacctgaaagagactattggtttcccaggttcaatcctcattacagacaaaggttttcattcacaaactgagcatcagggtatcattgaattttgctggcttagttctgttttacacaatggttcatttcttagcaaagtggaaaacaaaattcagccagagtgtgctggtagtgtagtgttcatgcggaatatttaaatgaaggtgtagtgcaatggttttcaaccctgggtgtt

SEQ ID NO: 675947 - DNA, 180 bp, Homo sapiens
gatttttaaaaccattttattccttttattaaatttattctaaaattttttaatggtaaattcttaaactgtggaaacccctgaaggtgcttattaactgttctcccaaatttgtacaaatattggattattcccttagtttacacctgtccaaaaaatgtggaaaataaacttttttta

SEQ ID NO: 675948 - DNA, 1148 bp, Homo sapiens
ggcagtaactaatacggttctatggtagcgaggctggtgtggcgcaaacaccaaattgcggatgacgccggtgcagcggggtgggcccggtggtgccctgtgtggccctgggtatggggaacctgctggtggcttccgcggaggtttcggcagtggcatccggtggccggggtcgcggccgtggacggtggccggggccgaggacgcggagctcgcggaggcaaggccgaggataaggagtggatgcccgtaaccaagttgtgccgcttggccaaggacatgaagatcaagtccctgtgaggagatctatcatcttctccctgcccattaaggaatcagagatcattgactttcttcctgaggggcctctctcaaggatgagggttaagaagattatgccaggtgcagaagcagacccgtgccggcacagctgcaaccaggttcaaggcattatgtatgctatcggggactacaaatggacaacgtcggatcatgggtgtaaagtgcttccaatggagtgttggccaaccagacaatcctgataggagccatcaatccatggccaaagctctccataagtccacgtgcagccagaggctactgggggaacaaggatcggggaaggccccacgaattgtccctttgacaagcgtgacatggccgatgcgagatctgttgctggtaacgccttacatcccttgaacacaggggcactggggatcggaactcccgaaaacttgtgccttaagaagcatgctccatgattggctgggtattcagatgactgataacaagcttaagacccgggcagtgcacagtggcaacacttgggacaaatttacggccaaaggacaccttttgatgcccattactaaaaacttacaggttacgttgacccccggacctcttggaaagagagattggcatttcaaccaaagataatccgttattcaaggaagtttcaacttgaacacactttggttaaagaacccagacccagaagtcttccccgtgcacgacggacactacagggtatcacagttgttgttaccaccacatagggtaaaataacacggaaaagatacgatgaattaaggcgtcaaacaatacaacacaaacaccgcacgatcagaagaacgcaagtagag

SEQ ID NO: 675949 - DNA, 1027 bp, Homo sapiens
  misc_feature (44)..(44): n is a, c, g, or t
  misc_feature (111)..(111): n is a, c, g, or t
  misc_feature (305)..(305): n is a, c, g, or t
  misc_feature (310)..(310): n is a, c, g, or t
  misc_feature (312)..(312): n is a, c, g, or t
  misc_feature (740)..(740): n is a, c, g, or t
tggtgacaggtgcctcacaaaaaaaaaaaaaaaaacaacccggnccacggaaaagcagggcctgggtcccccacgattgaaaagtgcctttcccattcagcctcctgtgcntctgtgggccctgtgtgtggaccctgtggagaccctgtggtttcaagccacgggtgtgggccctcgagcccgcttaggggttacccccgtgtgcgccttttctgtgcgcgcctgtgcgcgccggccgccctgtgtgtgcctttgtgcagaagggcgggaagctgtgcctttctctcctctcagagccacaaganccccngngagaagctttgtgcgcgagggggtggaagcgtgaagtttcctccttcgtgtgcaacagaactttcggaagaattatcaggcgaaagagcggaagccgagtgtttctctctcttcagacaacagaaccgcggggcggggcgcgggcccaggggggcaccaccggcgaagagggcggagagactgtgggttctcgtggtctcgagacaacaacaacccggggagagacaacacgcggggaaagagggcaaagaagacagagccttttctctcagagacaaaaagagaaacaccgtggtgtgtgggcgcccactgtgtgcgcctcttccgcgcctatgttgggggggagaacttatatcagcttgcggagaggcgccgccggatatatcctagagggggggcgtgccacattcatatagagatctcctctnatctcgccgtgttgtgtgtgcaggaagcgcccccttttataaatataaaatctccgagggggggtccgagaagagaaaaccccagaggttttataagcaacaggggggggtctctccccgccgtggtgtgcgcaacacaagcatgtggcggcgaaaaaacacccccaaaaaggaggcccgcccctcttctgtgagaaaatctcctactatatacaccaaaaccgcgaagaggggggttctcctcttcccccccccaaaaggagcccccaagaggggggcgccgaaaa

SEQ ID NO: 675950 - DNA, 458 bp, Homo sapiens
cagacctaaccccacgtgcattttgggacaattgctttttaaattttttttatgccaaaaatccttcattgtgattggtagtttcacgtcagatataccaagcgactgtgtgtggggtttgacaactgtggaaaggcgagcagaaaactccggcgatctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggttaggtctg

SEQ ID NO: 675951 - DNA, 959 bp, Homo sapiens
gggggggggggtggggggggggaggttgggggggggcggggggtgcgggtgggggcggtgcgcgtgggtggcggtggtcgcggggggttgggtggttgcgggggaggtttgggagcgcgagggtgcgaggatgtgtgagaaggcgtgggagggagaagatggggtggggggggggggtgggtagcggggggaggatagtggggcgggggggcgcgtgttgtggtggggggtcgcgcgggggcgtggggcggtagggtgcgggcgggggcgagcgcagaggaacgagaggggggagagggggggcgagcgtggtaggcgggggaggaggggacagcgagggccggcaggagggcgcggtgggggggaaggagggccgaagaggggggaggggtggtagtgcgagcgagcgagaagcgggtggggggggaggagggcaggccgggaggtgaggatgggggggagggggggcccgcgggtggggagcggggggcgggcgggcccggtggtgggggggggggaggagcggcggcggggggaggtgtgtgggaaagatcgggagcggacggggtggcggtaccaagcagaggaggagtgctggagccgccttggggggagaggacggcgtggcggggggcgtgttggggttaggtgccaggggggagtatcgagttgcagggggggcggcgcagttgcttgccgctggttggggggtcgggctcgcgagcgaagttgttcgccgcggtggcagcattgcggcagctgttttctccccactaggtgctgtgttcagatgtgtggtgttgtggacgaagagtatgcgcgcccggataattatcacctggtaggtagatagcaatcagtattgttctggccccctaggggcacctttaaaggcgaaaaagttttttgggaaaaaacaattttttgaaaagaaagagggaaaataacccaaaagaagg

SEQ ID NO: 675952 - DNA, 3026 bp, Homo sapiens
  misc_feature (2937)..(2937): n is a, c, g, or t
  misc_feature (2954)..(2954): n is a, c, g, or t
  misc_feature (2965)..(2965): n is a, c, g, or t
  misc_feature (2984)..(2984): n is a, c, g, or t
  misc_feature (3026)..(3026): n is a, c, g, or t
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaacagtccaggtgtggtggcacagccctgtagtcggagctaataagaagctgaggtgggaggatcgcttgagcccaggatatggaggctgcggtgagctatgatctcancactgcactccagcttnggggacagggnaagtctgtctcaaaaaaanaaccagacactggacttccatttaaaacacaccacaacaaan

SEQ ID NO: 675953 - DNA, 204 bp, Homo sapiens
agcagactctagtggatcccccttgcgcgcaggcgcgatctcactactgatcagcacggtagttttgacctgctccgtttccgacctgggccggttcacccggtgcttaggcaacctgagggcccgccgctcccggaaggtcaccatattgatgccgaacttagtgcggacacccgaatgaatagaccactacagcccagaact

SEQ ID NO: 675954 - DNA, 569 bp, Homo sapiens
gacagtattgactttttgcctcatcaatgtcgggaatgctatacattatagggctaggatatataatctcaaatgtccgcatggcatccgaaatggcataacatctcaaaacaaaatatcctacaagtgttccttgtgctagacttaggcgacggactgaggataaaagcaccagggggataatcttggctcagatccctaaaacgtatctatgaatttaactggctttacaatatccccttcccctgatatctggggtcagctgcctacagttgagtatgcaatgttcacagaacatctgccctggctacaattcatgactcaaaactgcatgagtaatcacagtctctaacagcatccatactatgacattcattacgttggtttgggggaagaaaagaagttcaggtatgtttcatggatccccaggatccttccaatctggacatgattgggctgattccagatggtagttctgaaatatcattagggtaagtcagcgtcatttggcactgataaagtgaaatatcaggaattcctataccacgtacagctgataccatctcact

SEQ ID NO: 675955 - DNA, 1815 bp, Homo sapiens
  misc_feature (1511)..(1511): n is a, c, g, or t
aataaaaattaaaaatagatgtagatgctatgttgctgaggctggcctcaaactcctggcctcaggtgatcctcccgccatgacctccaaaaccacagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacaattgctgtgaaggtgagaaaagttcatttttattatgtttccccaagagacgcactctattgttctcttgaaaacacacagctcatgtcctcctttagaacacacatcctctttaaagtaacatacaaacatgccaaaacaaggtaaaaaattacatctgaattctcacatttcaaatatatatgaaatatcaaataaaaatttatttttacaagaatttaggggaactactacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatataacagttataatatccatcacacagctttatagaaacagcatctattcaaaaataccagtatttccaaaatatttaaaataatatttaaagtaataataatatttaaataaataaatatatttaataaatatttaaataaataaaataatatttaaataattctatacccatgtttttcaaaataaaccaataaaatagatagtatatattagacgtgttagtatatatatctgaggcatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatgtaataatacagaaacaaatttaaagataataaaatatttaggataaaaagaattgtctcttaaaaatgaaaagaaaattatctttatgtatatataacaactataactctcatcaaaaaactacaggaacagcatgttttcaaaagtacaacaatttccaaactatttgaaataaatctatgaataattcaatggccgacattttccatacaaaccaataaaatgcagagtgtgcatgaagctatctgttacaatctgtggcactgatatttcacaaaagaattctgtcccaatctgagcccctgcattgtgccttcaaatcctcctggactgcaagtccgtaagaaacaggacctccaggttccgccccagggaggttggaattcagcaatataaaaagggtggtggtgccgcaggaaagggtggaactggaaacnctcctggtttcttacttttctccaaggactcctagaaggaccccacccccctccccccacccctgctccttggaggacaacgtgatcactgtattcagctctgtcaagaatggtccaggttcttctagatgatctgcacaaatggttcctctcctccttcctgatgtctgccattagcattggaacttgacctgccatgtgtgcctgccttcctggccagctgtgcttgttatcttccattctcacagctgtctttgaagcatagaataaagaatgtgtgtttctttcctgtatacatgacctt

SEQ ID NO: 675956 - DNA, 104 bp, Homo sapiens
gaccggtcctagtacggcgcagtgtctggaattctggctttgctgcagttgtctgtgagctgggcagagagagcagagtgcatgcaggggccaggcgtgtgctc

SEQ ID NO: 675957 - DNA, 124 bp, Homo sapiens
catgacggggggggtatactacggtcaatgctctgaaatctgtgcgagcaaaccacagtttcatgcccatcgtcctagaattacttcccctaaaaatctttgaaatagggcccgtacatgcaag

SEQ ID NO: 675958 - DNA, 763 bp, Homo sapiens
  misc_feature (100)..(100): n is a, c, g, or t
  misc_feature (393)..(393): n is a, c, g, or t
  misc_feature (464)..(464): n is a, c, g, or t
  misc_feature (489)..(489): n is a, c, g, or t
  misc_feature (560)..(560): n is a, c, g, or t
  misc_feature (582)..(582): n is a, c, g, or t
  misc_feature (584)..(584): n is a, c, g, or t
  misc_feature (613)..(613): n is a, c, g, or t
  misc_feature (653)..(653): n is a, c, g, or t
  misc_feature (698)..(698): n is a, c, g, or t
  misc_feature (732)..(732): n is a, c, g, or t
  misc_feature (751)..(751): n is a, c, g, or t
acaactaatacttacctttagccccctgccctgcccccccccttaaaccattgtaccccccccccaaaatttaaaagccccggaactaaaaagaagaatntcccccctcttaaacacacactttaatccccacatcttcttgtccctttaaaaattttttttataaaaaagattatataaatacattctcaaaaaaccctctcttttaaaaaaaacacctttttaaaaatagatggcaaaagggcggccataaacaaaaaaatataccccctttttttattcggcccaaaattggtgggccccccccccaaaaaagaaaaacaacaccacccccccctggtgtgcccacccccccccaaaaaaaaaaaaaaattccccctcctcctccttttnttttagaaagaaaaaaaaaaaaaaaaaaaacccccccttttggaaaaacaaaaaaaagagatttttttttnttataaaacaaaaaaaaaaataatnttttttgcggccacaaaaacaaaataaaaaaaccccccccacaaaataaaaataaaaataggaaagaacancagaaacatacacaaaaaaaantnttttcttctcttgacaccccccccccctntcttttttttaatataaacaaagaaaacaatacaaccccnccccgatggtggttgtttctcctcctttctcctccacacaaaaanaacaatacataataattctctctccccttccccnccaccaaagtgttgtgttntctctccgcccc

SEQ ID NO: 675959 - DNA, 472 bp, Homo sapiens
  misc_feature (1)..(1): n is a, c, g, or t
  misc_feature (81)..(81): n is a, c, g, or t
  misc_feature (94)..(94): n is a, c, g, or t
  misc_feature (105)..(105): n is a, c, g, or t
  misc_feature (200)..(200): n is a, c, g, or t
  misc_feature (291)..(291): n is a, c, g, or t
  misc_feature (295)..(295): n is a, c, g, or t
  misc_feature (321)..(322): n is a, c, g, or t
  misc_feature (368)..(368): n is a, c, g, or t
  misc_feature (428)..(428): n is a, c, g, or t
ntcccacccaccctggaaaatggcctcctccaaacctacccccgtctgagccgtcatcctccctgcaatgccgtggttggnaggcaggaccccngggagggagcnacaggctgtggccacctcttccaggcaccctggactccctgcctgacccctgccctacctatagacccagccgtcctcagggccacgaaggggcnaagacagctctggagctgccatcaacctgctgtgactttggccaagcccctgcgccctggctggccttcagttcccatatcaaatgacacncaangagaaacaatgggggcaggttcaaannacaaagtgggagaggggggtacatgagagcttggccactggggctncccagattggcagacaggggggtgggtttcccccagtggcgagtgagagggggggaggtntgtggaggttcctgccccacatgcctatgggcgccccagcaaga

SEQ ID NO: 675960 - DNA, 373 bp, Homo sapiens
  misc_feature (18)..(18): n is a, c, g, or t
tgtacactgtactccagncctaggtgacagagcaggttctgtctcaaaaaaaaaaaaaaaaaatcacaattataattaataaaataaaaaagtccttaaataccaacactctagccccattaaaggtgtgtttctaattaccttatgaaaacttctagatcctatattaactccccagagcagggccccatattaaagcataaaaaaaaaaaaagcaacgtattaaaaaatggctataattttcctccaataagggaaggcgcctagggaagggctatggatgggttccacccccaagctacctggctaatacaaaacgtctcacggattcatacttggggcataagggggggtcgcacatatttatcaaggt

SEQ ID NO: 675961 - DNA, 980 bp, Homo sapiens
tgtcactttctacacggcggcggatcgggtgttgcatccttggagagagctgagagctcgagtacagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaaagctctgaaacatcacacatctaagattcaagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccag

SEQ ID NO: 675962 - DNA, 1603 bp, Homo sapiens
  misc_feature (1514)..(1514): n is a, c, g, or t
  misc_feature (1531)..(1531): n is a, c, g, or t
  misc_feature (1542)..(1542): n is a, c, g, or t
  misc_feature (1561)..(1561): n is a, c, g, or t
  misc_feature (1603)..(1603): n is a, c, g, or t
ggatctggaaaaacaaacgcgctttgagaagacggggactccccaggatacccctctctcccctcgtccagcttccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttcggatttccgaaatagaccccaatattctgcctttaccccggaggatgcagatgtaccttctctcaggccgatgacctcaggcctccacggtccctggagctctaggaaaggtgagcgcgatctcgcgcccacacccagtgctctgggtcataagcctggatctggaaaaacaaacgccctttgagaagacggggactccccaggatacccctctctcccctcgtccagcctccagcccacccgattcctccccacatcctccacctccccaggccccacccacctcctccaactcctccagggaaacccaagccctgcagcgcatggaacagaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaacagtccaggtgtggtggcacagccctgtagtcggagctaataagaagctgaggtgggaggatcgcttgagcccaggatatggaggctgcggtgagctatgatctcancactgcactccagcttnggggacagggnaagtctgtctcaaaaaaanaaccagacactggacttccatttaaaacacaccacaacaaan

SEQ ID NO: 675963 - DNA, 1419 bp, Homo sapiens
tgtcactttctacacggcggcggatcgggtgttgcatccttggagagagctgagagctcgagtacagaacctgctaaggccatcaaacctattgatcggaagtcagcccatcagatttgctctgggccggtagtactgagtctaagcactgcggtgaagaagatggtagaaaacagtctggatgctggtgccactaatattgatctaaagcttaaggactatggaatggatctcattgaagtttcaggcaatggatgtggggtagaagaagaaaacttcgaaggcttaatgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaacttacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaaacgtgcctgcttccccttcgccttctgccgtgattgtcagtttcttgagggctccccagccatgcttcctgtacagcctgcaaaactgactcctagaagtaccccatgcagaagttggaagacgagggaaggcatcacagaggctgtggggtgaaccgacttcaaggaatgggtccttcccttcagaaccacatgtgtgcgggacacccagacagaaaacacaaatgcaaagtcaagtggagggcatttggaaggagcagtgaagccaagccaggaaacaccaagatggcgagccagtgtggttgtagagattgcagagagggacaagataag

SEQ ID NO: 675964 - DNA, 885 bp, Homo sapiens
  misc_feature (156)..(156): n is a, c, g, or t
  misc_feature (860)..(860): n is a, c, g, or t
gggggaggggcagggggcccccccctttgagggttggggaagaaaatttctttaaacccggagggatcggccccaattaatcaagatttaaaccctgcccccccaccttgggaaaaaaaaaaaaattttttttttccccccccccccccccccccnccaaaaaaaaaaaaaaaaaaaagactgtaggagcatctggtgggaggtggtggagggagaactgtgggtttggaagctgcgccctccccccagccatgcgttggaacaggaacacagttacatggagaacaaccttaccttgtccgacaccctcagatctttgtcccaggccaggaatcttttaatgacaggatcctctgtgattagagagcagatgtcagtgtgagaagcaggacagggtttccgtgggagcagcagggcagcgaggagaagtgtgcctcccggggggaagtctcaggattgtggccgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttggtatcccccactatggatggagacacttaggtttagaaaagtcagtaagagacattaagtttcagagggcacagctgaaaccacttttttgatttttgattttgtttttctttatttgatttttatttttatttatttattaatttatttcnagactgtgtctcacaaaaaaaaaac

SEQ ID NO: 675965 - DNA, 572 bp, Homo sapiens
ataggttggataaagggataactgtgggggaaacggatcgttgttcttttaaaagtggtaagttgcggtattgtgagcccacgagccgctggaggaagtcaatgacgttggaaatcctagggtgactatcggcatgcctctataatctttcacctaccaccctaacaatcgtacccgtaccgtactacgtacacgggaaacgggaggcatctagtacctcaagggaacgcgcagggattccgagagcaggcgatgcagcaatgtatatctcacccgacctcggggtcatataccgccccgccagcttggaaccggccgaaataggcgggcctaggaaagaattaaatattgaccacggaacggcatgagtggttggtggataggtaacgcacttgattggatccgcctggggtactctggccgcagcgaatggcgctaacacgtttgtggattcaactaccgccttatcaaagaaatacgacgccactccagggacggatcggccggggaagcataaagtctatacagaccgctattgaagttggacataacctgagagggatgagggcacg

SEQ ID NO: 675966 - DNA, 1022 bp, Homo sapiens
tggacttctcgagatagagtgcgcgcctccttcgccgacgctctgcagtcctcagcgcagttatggcccagttcttcccgtctgtggggacacgaccgacggaggaatccttgcttcagggactcgggaccctgctggagcccttcctcgggtttaggggatgtggggaccaggaggaaagtcaggatccctaagagtctgccctgcctggatggatgagtggcttcgttctccacctagattcttctccacaggagtccagcatacttccatgaacatggagagtgctgttcgctcgctgaccattcttatcccgagtcccccaggccttatctgcagaaagcaggcagatctctgtgtgctatgcccaaaactgccccaagatgatggaagttggggccagagccagcgccctcgggcatagtccactgcagcagtacactaccaacagatcaatagataaccccatccggccagtgtagaaagagcgaagcacgtgctagggtcacaggtccatcagactcctgcatggatcccagcagagtccagatggcacactaggttccgtctggacgccccttgctgtgcacaagccaggtctactggaggcatagtgccctttcctggcaactacagatgaatcagagaggcaaccagtgtgttctggatggccagtcttgaagcttccggaggatgtgcgggaaatgactgccgtgacgaaagcggggtgaaactcagcagggccaggtggttaggtgaaaccgatggggggatcccagtgatgtgcagaactccggacgtaatgaagtacagccagaagagggtccactcttcagatactggcaattggtcattcagatgcggtttggagacaatgggaacagaagccccttcggttaatggaccgggcacatccggagagaatgacccccaaaaaggggggggagaacaaaagcccggggggataagggggggaaggaaggaggggccagacgttgagacccacgatggcacagccaacc

SEQ ID NO: 675967 - DNA, 903 bp, Homo sapiens
taaatagacagaacggactgtgatcgttcgtgaaaacgccgtaagtaatgtatacggcgatgtagtttgaacgctggtggctctaagaggattatcaccttcagaagtcatgctgtgttcataatgctagagtatcctgtacgacagacggcactaagcaccctataccttgcgtagctgtacatggattaaaaatacaaatatacctactcgaaggcagagtccgaatgcatgagaacctcaccgaaatagctagtaccagcatactttagagcaactggcatttccaggtagacagcgaaccagatcatcatgataagccccaaaagtaagtggagcaatgcattgtatcgagttcgaagtgcgaatctatagtaactcggtcgaccctgagttgaatcgactgcgattgatactgttgcatggatatctttagatacaaaacatttaaattgggcccagcaggaatccctcatatatcccctttggtgagagatcctaagctgtatagctgctcaccacgaggataccagtgtcttaagggaggagctcacgcgaaaaaaaaagccttggttagaagatgagtaaagaagaatttgagacagcccatagataaagacctacgatagacaggcccaccaattgatgtaaacagcgtgcatcgtcttcaagcaagcgcaactattctaataaaagatgcccgatagccatataatctgaacctcctcatcataccaaattggtaccaagtctatccaggcctaatagtaacgaaactaaatgcttagtaataaaggtagtcaatgacaaaccttgtctcactccctcgtaggccctgcagtctgattaaaaccagctgaaactgacaatgaacagttcaattatctgcaccacgaaaaaaac

SEQ ID NO: 675968 - DNA, 1601 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaaagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacagttttctgtctcaatatctcagcttccagcttctgaattctgttttgtctcactgccaatctaagtcctagtacttctgaaatgtgagcaataaatgaatgaaatgaagcaaatagtattgttaaaaaaattggttacccttattaaaacagtaacttctcaatttgaacataacatatagataataaatgatagttaccaaaaaaaa

SEQ ID NO: 675969 - DNA, 1296 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtaaacgtgcctgcttccccttcgccttctgccgtgattgtcagtttcttgagggctccccagccatgcttcctgtacagcctgcaaaactgactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctagcttcatagcgaggacactcagggtgcgtctcccaggcagtcaggcaccctcatccagacctgctcccttcgccacttcatccacacctcagggctttatccgtggtcccttccgcactcctcacctccgtcacattgttgctagacactctctaccaccttcacttgctgacccaccatccgcaacacctaggaatcccagaacgccctcacttcctcactcctccctccctcctcaccaacgtatcctagcccatgtgcgtcccgccgcgaccgccgtgcaccgcatgtcaaccagcgcttactctgcacgccg

SEQ ID NO: 675970 - DNA, 2084 bp, Homo sapiens
  misc_feature (1620)..(1620): n is a, c, g, or t
  misc_feature (1810)..(1810): n is a, c, g, or t
  misc_feature (2003)..(2003): n is a, c, g, or t
  misc_feature (2009)..(2009): n is a, c, g, or t
  misc_feature (2019)..(2019): n is a, c, g, or t
  misc_feature (2021)..(2021): n is a, c, g, or t
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaaagctctgaaacatcacacatctaagattcaagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagaaacgtgcctgcttccccttcgccttctgccgtgattgtcagtttcttgagggctccccagccatgcttcctgtacagcctgcaaaactgactcctagaagtaccccatgagtcaattaaacntcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctnagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttcctggcaagattctctgaattgtactgncttgcnaaaagagtangnagggggatgatcccagtggctcacgctgtattccaagacttgggagacaatccgggtaagatc

SEQ ID NO: 675971 - DNA, 240 bp, Homo sapiens
  misc_feature (108)..(109): n is a, c, g, or t
  misc_feature (116)..(116): n is a, c, g, or t
  misc_feature (119)..(119): n is a, c, g, or t
  misc_feature (121)..(121): n is a, c, g, or t
  misc_feature (143)..(143): n is a, c, g, or t
  misc_feature (151)..(152): n is a, c, g, or t
  misc_feature (171)..(171): n is a, c, g, or t
  misc_feature (200)..(201): n is a, c, g, or t
ttctattttatctaagaaatccttccaaaaccaaggtaactaagattttctcttacttttcttcaagaagttttatattttagctcttcatttaagctggactcattnntatatancangnaagggatagttcatttttacanatactatnnatgccagcactgttgtacnagataccttccatgaatcctggcatcttnncaaaaaaaaacaacaacaactgaccataatatgtggatg

SEQ ID NO: 675972 - DNA, 366 bp, Homo sapiens
cacggaccgtgctggtcatcgtcctttgacttttactgtcgcagacatgagtcttgctctgtcattcatagctggagtacagtggctccatttcagctcaccgaagcctccacctcccaggttcaagcagttctcctgcctcaacctcccgagtaaccgggattcacaggtgtgtgccaccacacccgactaattttaatattttaggtagagacggggtttcaccactgtaggccaggctggatcttgacctcctgacctcaggtgatccacccacctcgaactcccaaagtactgggattataggcgtgagccacggaatccagcctcatccttcttataaccaatacacatgatgctgtatct

SEQ ID NO: 675973 - DNA, 1094 bp, Homo sapiens
  misc_feature (55)..(55): n is a, c, g, or t
  misc_feature (58)..(58): n is a, c, g, or t
  misc_feature (70)..(74): n is a, c, g, or t
  misc_feature (1005)..(1005): n is a, c, g, or t
  misc_feature (1022)..(1022): n is a, c, g, or t
  misc_feature (1033)..(1033): n is a, c, g, or t
  misc_feature (1052)..(1052): n is a, c, g, or t
  misc_feature (1094)..(1094): n is a, c, g, or t
tgtattggtggtgctctctgattggtggtgctttggtaatgtaggcgggctttgncgntaaaacctttgnnnnntgtattggtggtgctctcatataccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcgtctcccactccttcaggatggagacaaaaacccaactggtggccgagagtggtggcttatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaacagtccaggtgtggtggcacagccctgtagtcggagctaataagaagctgaggtgggaggatcgcttgagcccaggatatggaggctgcggtgagctatgatctcancactgcactccagcttnggggacagggnaagtctgtctcaaaaaaanaaccagacactggacttccatttaaaacacaccacaacaaan

SEQ ID NO: 675974 - DNA, 538 bp, Homo sapiens
  misc_feature (81)..(81): n is a, c, g, or t
  misc_feature (257)..(257): n is a, c, g, or t
  misc_feature (261)..(261): n is a, c, g, or t
  misc_feature (437)..(437): n is a, c, g, or t
  misc_feature (452)..(452): n is a, c, g, or t
  misc_feature (478)..(478): n is a, c, g, or t
  misc_feature (482)..(482): n is a, c, g, or t
cagacaaggatgtggagaaatcggagccctcatacttgctggtgagaatgtaaaatggtacagctgctgtaagaaaacagnctggcagttccccaaaatattcaacatatagttaccatatgactcagcaaatatactcctaggtatatatacccatgagacatgaaaacacacttctaacacagaaacttgtacacagattatcattcataatgtctagaaagtagaatcaactcaaatgtctatcagctaatgantggnttaacaaatatgcctatacattagaatgttaattattcagcagtaaaaagcaatgaagtacagatacgtgctacaacataggtgaaccttgacgacatgctcagagaaagaagccagttcacaaagtactgcacattgtatgatttcatttatgtgaaatgcccaggattggcaantccttagggacaggnagtagactaacggttgggggttgggnaggnttaggggagtaggactcctaattggtggtacggttctttgagggatgatggaaatc

SEQ ID NO: 675975 - DNA, 202 bp, Homo sapiens
atctagaggatctctctgtggtgcatgcatgtgtagaccctgtggagactacttaattcacaccgggtgtctgatgtgtagactcctgtggagacctacttaattcacaccgggtgtcctgacgtgtagaccctgtggagacctacttaattcacaccggtggtcttacgtgttgacgcctttggagacctacttaattcag

SEQ ID NO: 675976 - DNA, 1012 bp, Homo sapiens
ggtggcctcagcgaagatgggccgggcgggtaccatgggtggtggcagcagaggtgggaggtgcggggcggcatggcggtagaggaggctgtggtcctcagtgggctgttggtggaggtatggctcgggccagcagtgggaacggtccagacgaggaggcctggggggcacttcgggcgccgcaagctagctagcttcgagagctgtgcccaggaggtgagcaatcagccctacctctgtgagagtggtcactggctgcggggagactggctgctgcagctacctactatgagctctggtggttctggctggctctgtgactgtcctcatcctctttagactgctgttgcgccttccgcacgcgacgtagctaaactcaggctgaatacaacaggagtgggagcgtgaaatcaacttgttggcctatcattgggggcatgtcgcatggggttggtcctttcccttaccgtgttcagtggttgatcttcggttcctcagcagcttcaagcccccagcctacgaggattgtggttcaccgccggtgcacgagcagcccagccttataatgtggccgcagggcggccttgacttgcttccagtgaacaaactggtggtcctcctcatccagctgcctgccactttgaaggaacgaatgttgaaggttgtttcgtcccaccagatgtgcccccctcatcaggagggtgagccgggcatgggttacccctgcttaatgccccctcgtgtcggtatcgcggttagctgggactcggttttgagctctgcctgtctgcgtcggtgaggtagccgtcagcagttggttaaggccctcgactggggaatttcccgttgttacccaggtgtacggaatttcatggggactccaggaggaccacaattgtgaggggtggttgcacaacagataattgtttaccctcacaataaagtggggatggtgtaccacagtatagaaaaaacggaaagtcgctagaaatatatatgaggactatcatac

SEQ ID NO: 675977 - DNA, 860 bp, Homo sapiens
ctttcccttcagaaggacggttagtaaatgtggaaacaaatgaagaacacaaagtaagatgatagaaataaattcaaatatatctttagttacaataactgtcaaaggtactgaacttttaagttccaagacaaagatggttaccactgcatttccaaaaatccaggtatatgcagtggtaagtgctatgcctaagtctataaactttcacacactggttaaacaataccacgctgcacacaatacctatatcacgcaaataataatcacaacgtaaagctgggatagctatagtaagaaataaccaatttcagactgcaaagcatggttacagattaaaaagattattacaattgtgataaaagattacaatattctgaaggatacagttctaatttatatctgaagtctgttaaaatttttttataaagctaaaattaatgaattatacggggaagttaaacaaattttcagtaggagatttgagcataaatgtctctgtaaatgatgtgaccaagcaggtcttaacactctggtaaagctatgtgggcccagtggagctctaccaaaatactgcactgtgattataactggtttcatgttgtatattactgctacaacactgggtggaataccacattccttttacacacagtcatgcgccatgtttaacaaaatgccacctacttcacgataactgacagacggggagcaggtggaatacaggaacctctcaaatttctccccatggtttgaattacttaccctctcactgctattcacatttccttacttctttgagccggactgctgcgccaaacggagttaggagctaataccgcctctgtagtcgaagtggc

SEQ ID NO: 675978 - DNA, 987 bp, Homo sapiens
  misc_feature (184)..(184): n is a, c, g, or t
  misc_feature (260)..(260): n is a, c, g, or t
  misc_feature (288)..(288): n is a, c, g, or t
  misc_feature (297)..(297): n is a, c, g, or t
  misc_feature (544)..(544): n is a, c, g, or t
  misc_feature (570)..(570): n is a, c, g, or t
agcgggaatgcttccgaagctggacgacgcctgtgtgtctggcctttccttcttcttctcttccccgggcaggcacagtgtgggcgtgtgtagtctcgctatgcccctggcgataagtatgctagcgtcagatccaatacggtactctcgacagcataagctcagccactttgcgttcattctngcgtaccacaatgtagagctacgatattgaacccaatgttctggtagaacgtgcattatcctaggaaggagaggtngtgcgacagaaagtgacaggacaattgnaacatttancccacaatcagcgactaaccccgcgtgctctcgccagagagagactgataccagatatgatactctcagaacgatggttgtgtgaccaggttcaggtagggtcccaaactaaaggagcgaggggacaatgagtatgaattcaccgtgagatgtcatataccgcgcattgtcccgttcccctctgatacggagtcagtcattgtggcgcaaatatctttccaattctcatcttcgtaacgggaatgcntcactaaggaaactactatactacanacatacgaagcgactaggcgtgaggatagtaagagagcaggaagagatttgactggaccgattgcgtgaaaagaaatctaggaagctcctaccaccataatagctttgttgcaatggtaccatggcaatagacactctggaccatggtggactatctgcaggccaggagcggaagcgagagcacggattggcgtgaattgcagacacacgggtctaagctgatatgcagaggtctgcgcatctatcgcagggaaacgggggaacatggtttgaagcgcctctactccaggaaacaattgacgcgattagaccgaatcacgcggagcttacgacacgaacaaaggaaataaccgatgtccaggaaagtcctcttggggtactatgtagggaaacgagatgctggaagaaagtggaccg

SEQ ID NO: 675979 - DNA, 595 bp, Homo sapiens
  misc_feature (487)..(487): n is a, c, g, or t
  misc_feature (518)..(518): n is a, c, g, or t
  misc_feature (529)..(529): n is a, c, g, or t
  misc_feature (535)..(535): n is a, c, g, or t
  misc_feature (540)..(540): n is a, c, g, or t
  misc_feature (569)..(569): n is a, c, g, or t
  misc_feature (579)..(579): n is a, c, g, or t
tcggggcagagaaaagggggtgctgcatcttcttcctcacctccagctctctcacctcgggttgccttgctcactgggctccgctaaccactcaggctgctcagtgctggcacacattgccttcttttctcattgggtccagcaattgaggagagggttgggggattgtttcctcctcaatgtagcaaattctcaggaaaatacagtccatatcttcctctcagctcttccagtcaccaaatacttacgtggctcctttgtccaggacataaaacaccgtggacaacacctaattaaaagcctacaaaactgcttactgacagttttgaatgtgagacacttgtgtaatttaaatgtaaggtacaggttttaatttctgagtttcttctatttttatttaaaagaagaaaataattttcagttttaattggaataaatgagtacttccacaagactatatacctgaaaattcccgtgccgattcggngagttgtctgcagttcagctggaattccatntctccagtcantcggancttgntgaagctcatctctctggtttgttgaaanagagtgagtnctgggcctgtatggac

SEQ ID NO: 675980 - DNA, 124 bp, Homo sapiens
tgggtagcccagcaatcctaggactggggcgaagtgcagcagacacgtaagagcggagcctgtggaagagtagccaggcaatcctcagactgagtgcgaaagcacagggaccactacagaggcg

SEQ ID NO: 675981 - DNA, 370 bp, Homo sapiens
gaggttttccaactgttggaggcgcctttggggctgcccctttgtttggagtcactgggggcttccaagggtttccctcgaccctctgttgtcctgggatggctgtcgggaactgtatcacctgggttctgtcccctggctctgtatcaggccctttatttaaaagtgggccccagtggggtgtgtttgtttcctgcttttttggagcctggaaggaaagggcttcaggaggaggcttttaggctggaggggccaaatggaggaggccaacaactaacccttgccccctggggttatgggtgggggcggtgactgccccaaacttggttttgtaattatttgtacaggaataaaccccccttcgctccga

SEQ ID NO: 675982 - DNA, 245 bp, Homo sapiens
  misc_feature (194)..(194): n is a, c, g, or t
catgcatgtgctgcaggtgattgaggatccctgggcacctggaatgggggcagcaaggctgaagcctcccacacataccccagccctctacagcggtacagtgaggaccccacagtacccctgccctctgagactgatggctacgttgcccccctgacctgcagcccagctgaatattaaccagcagatgttcnggccccagcccccttcgccccgagagggccctctttgcctgctgcccgacc

SEQ ID NO: 675983 - DNA, 226 bp, Homo sapiens
cacgaggcgaatgtgcatacttcatctgtctgtacccagatggcgtcttctatgacctgcacattatgcatgcattccacctaacctgattcaaagggggctcctgactccctgggggactggactgtggacccacctgacccagccatcccctatgacaccttctaaccggcaacagccgcttttatccacccccatgctgcccaactctgctacgaacccccca

SEQ ID NO: 675984 - DNA, 293 bp, Homo sapiens
aaccgttaattccttggtttaagcagttgctaagttttttaattttaggctcaaaggcccataggaggttttaaaatttatgtttagtccgataggtgaggtttttgatattttgaattttaaccccttttatgatacatcccagtaacctcatttttgaagtctttttttggactttaatgttctctctgttttaatagttgaagtatgaaatgtaactattataaactgttgctgaaaacataaatgtttgtaacttacaaacatgataaataaattaaaaattccctcca

SEQ ID NO: 675985 - DNA, 368 bp, Homo sapiens
gtgtgatgatatctcaatgtattttaatttgcatttctctattggtcagtggtgttgagcaccttttcatatgcctgattgccatttgtgtttcttcttttgagaaatgtctgtccaaatcttttgcccgtgttttgattggattattagcttttttcctatagtcgtttgatctctttatatcttcttgttattaagccctggtcaaatagatagtttgtagatattttctcccattctgtgggtatgtctcttcaccctgtggggtacaaaagttcccttttctctgcatacttgccagcattttttattgcctctcttctgcatataaggtatttttactggggtgtgatgatatctcaatgtag

SEQ ID NO: 675986 - DNA, 278 bp, Homo sapiens
  misc_feature (27)..(27): n is a, c, g, or t
  misc_feature (56)..(56): n is a, c, g, or t
  misc_feature (176)..(176): n is a, c, g, or t
aaaccaaccaaccaaccaaccaaccanaaaaaccttaggattttcccaaccaaggnggttgaaggactgctgcaggggaacctacaaaacactgctgaaagaaatcatagatgacacaaacaaatggaaacgcatgccatgcccatgaatgggtagaatcaatattgtgaaaatgnccatactgccaaaagcaatctacaaattcaatgcaatccccatcaagataccaccatcattcttcacagagttagaaaaatcaattcaaaaaaatcatatgg

SEQ ID NO: 675987 - DNA, 218 bp, Homo sapiens
  misc_feature (78)..(78): n is a, c, g, or t
  misc_feature (80)..(80): n is a, c, g, or t
  misc_feature (101)..(101): n is a, c, g, or t
tgtaatttaccttttagtaatcagaaaaatttccaatccatttttatcttaggtttgggtgggtgtgattaaaacttntnatttttattaatgtgaataanccaaagggtgattgtttttgacacacggcattgtgccatagtaaaatgggtagtatccttctcagttaacctttaatactctgtacacactattctgaaatactgtgggggggggag

SEQ ID NO: 675988 - DNA, 1248 bp, Homo sapiens
acaatatgattccacccagtgggcgacattccatgtgcaccgtcaaggctgagaacgggaagctagtcatacaatggaaatcccatcacctatcttccaggagcgagatccctccagaaatcaagatggggcgatgctggcgctagagatacgtcgtggagtccactggcgtcttcaccaccataggagaaggctgggtgctcattagcaggggggagccataaagggtcatcatctctgaccccatctgctgacgcccccatgtacgtcatgggtgtgaaccatgagaagtatgacaaaagcctcaagatcatcagcaaatgactcctgcacacaccaaagtgctatagcaacccaggacaaaggacaaaccactgacaacataagcgtcatcgaggaaaggaactcaatgaacaacagaccatgcacaacacatgccacccagaagaaagaaggaatagaacaacaaacgagaaaacaagagagagcagaatagaccgaagagagaaacaccaaaaacaacaaaaccactgacactacaagaaacatgacaaaagaaagagaagaaaaggacaaacacagaacatgaaaacgggaacagcaaacaaaaaggaccaatagacaatacacgaagaatcccaacaacaagcccaagcagctacgacacacggagaagaacaccacgacacgaggcaagacacaacaaaaaagaccataacacacaaaaagaatgacacactacaaaaaaaaagcagaaaaaaccaagagcaaaacaaaaagaaacaccaaaacaaaaggacaaacaagaagacaaaaaagaaacacaaacaaagaaaaccacagaaataaaaaaaagaaaaacacaaaacaacaaaacaaaaaaaaaaaaagaagaataagacacaaaaacacaaaaataaaaaaagaaaacaagaaaaaaacaaccaaagaaccaaaaagaaagagagacaaaagaccacaaaacaacaaagaagaaaaacggaaacacaaacagtagataaacaaaaaaggataacgtataggacggtaaaagagcaaaaagacgatcaacgtaacaacaagataaaagatgaatgaaaagagacaataataaaataacaagaacaaacagataaaaatatatatcaagaaaagattaaaaaagtagaagtagaaagaagtatgaaaatttagaatcacagaagaataaaagataatgaaactattagtaaaatatatataaaataa

SEQ ID NO: 675989 - DNA, 146 bp, Homo sapiens
acgcgagcccttcggcgcgagcacaagcttcggttgaccggtcacttcaagctcctagccactgcctgctggtgaccctgtggcggccaactccaccgccgaagttcacccctgtcggtgcacgcactccctgtgacaagttcctg

SEQ ID NO: 675990 - DNA, 114 bp, Homo sapiens
agtcggtaccgcgtgctcgatatcgaggatggcctggggactggtgctgcactcgggtcgaatgtcatcaggaatgagcagctgccctgcagtacttggccgatgtggacaggt

SEQ ID NO: 675991 - DNA, 106 bp, Homo sapiens
gcttggtcgatctacaggatcttaaaacaccgcaatctcgggaggatcacttgatctcaggagtttgagaccatcctgggcaacatagtgagacctggtctcttga

SEQ ID NO: 675992 - DNA, 84 bp, Homo sapiens
ggatttgctggtgcagtacagctaggcttaatagggctcgaattcgaggaattcgagcttctaacgttagaagcttgaattcga

SEQ ID NO: 675993 - DNA, 464 bp, Homo sapiens
  misc_feature (31)..(31): n is a, c, g, or t
  misc_feature (34)..(34): n is a, c, g, or t
  misc_feature (45)..(45): n is a, c, g, or t
  misc_feature (102)..(102): n is a, c, g, or t
  misc_feature (413)..(413): n is a, c, g, or t
  misc_feature (442)..(442): n is a, c, g, or t
  misc_feature (452)..(452): n is a, c, g, or t
attcggcacaggggccggccggagccgcacnagnccgcgattccnacgggcgatgctgggggctttccggtcggggccgcagcgcttccggagccgcggganggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgccttttgacccaccacgccccctatcctgcccccatataaaccccaaaccccaacctccagagcataccagcaggtgaggagatacgaggcaagccgacttgacggcaaaacgacgtaggcagagaaagagagaagaggagggacgtctggacaccnagagatgttttgggttcggggcagtcagngcgggaattncaggcccttggt

SEQ ID NO: 675994 - DNA, 224 bp, Homo sapiens
aggactgattgatcccaggagttcaaggctgcagtaagctgtgcctgggtgacagagcaagaccctgtctctcaagaaaaaaaaaaaaaaaaaaaaagggttgggcgtgggtggctcatgcttgtattcccagaattgggaggttgagccggttggttcatgaggtcggaaattggaaaccatcgtggccaacatgtgaaaaccgtgccttctatgtcaggttt

SEQ ID NO: 675995 - DNA, 701 bp, Homo sapiens
  misc_feature (357)..(357): n is a, c, g, or t
  misc_feature (368)..(368): n is a, c, g, or t
  misc_feature (422)..(422): n is a, c, g, or t
  misc_feature (502)..(502): n is a, c, g, or t
  misc_feature (690)..(690): n is a, c, g, or t
gactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggccctatcaacactctgaaatgttcacccagagtatgtccttttgctggaatcttagaaatagtggagccgtacgctatacgactttttgaatatcccaacacgatcagnttttcttgtanacactgggttttatctgaatggcgctgattctgccaagtgcactgaggaagganaactggcgcccggagcttacctgtctgtgctcccatcatctgccctccaccatccatacctacgtttgcaacactatcgngtttataagccatcagctggaaacaatatccctctatcgggacacagcagtgttgaatgtttgccacaacatgcgatgttgggaacatgataccatttacctgcacgacacatggcaattggactaagattaccagaatgcagctaagtaaatgccgcatcccatcaagaccagaccatggatttgangactatgcttg

SEQ ID NO: 675996 - DNA, 523 bp, Homo sapiens
cagaccgacacagacctatgctcatagatgccgtagcacagcgtcaagcatgccacaggcctgcgcacagacacacaatcgacgtggagtcacatatgcacacaaccaccggcccacagtatgcacacagatgctgacgtacacacagacacatgcacacagggtacacacaaacacagcagtcacatctccacacacacctatgcagcacccagtatacacacaattgccgccacggacgggtgcagagagacgcacatagacagtacatgcaaacatatatccacgtagatgcagacagattccctcacagaaacatatgcaaccagacaccacagagacttgcagacatgtggacccagacccagtctcaatgcaaagacagcacacacaaggacatactacacagacgtgcacacacaggtctcatatgcacggaagacacacaccatgcagacagatacagacacatagaacatgccaccacacacacaaatgcacacagacacacaagcacgacagt

SEQ ID NO: 675997 - DNA, 606 bp, Homo sapiens
tggagccacactataatagctaacataccacgtacctacatagtactactatactaataggttaagtacgtacagtccctataccatagcgtaccataacctactaggtaggcaagacagtaacatacactacagaggagcagctagctaacagtataagtagctagacaatacataccagaacacagctagcgagggtacaatactaggccgtagccacataaccctactaaggtaaggtaagaataaaccaagataaggataacatagatattaccctagaataagctactactatacacaaaactatacaacaatatacagacctaacacacaagaaaaggggcctacccgaaaggaaaagaccacctagagggaacaccagaaagagtaccaaaggctagtagaagaataggacacacaaacaagctaaacaaccctagaaaacaatgtagaagccaaggaagcagcggaaggattgaagtacaacgaatagaaaccctccaaagccacgtcaacagaactagtaacggcacatatagggtagagcccaaagcacgaaacagctagctgaaaaagacaggcaacaacaacagaagaaaccag

SEQ ID NO: 675998 - DNA, 365 bp, Homo sapiens
tgtggcaaccgaatgcagggacaccagctgggggagcttctgctggaggagctgttgtgtctctctgctcgtgcctgctcttgctgcctgcaatctctggttttggttgtccttgctttctttgggttaggattggctgtgcactgggagcttccgccagctttggtttctcatcgcctgcctctgtttttgaattgaaggtggccagttcctcagcctccgctgtaagctgcaagaaagcggaggaagctgtattattggctggtggtgctggggcgctgtaagcctgtgagggcatcggggtactgcaggatgagctggtaggcgtcaggatttccatggcatccatggaatcctcattttgg

SEQ ID NO: 675999 - DNA, 184 bp, Homo sapiens
ttgaaattaaggcccacaaggcgccgttgacagcttcccactgataaaccaattgccggtgatacgcctcatcttctaagttgccgagctgtgtcaacatttgggtacgcatacgcgacatcaaggtggcaaagtaaatgctatcactatgcaaattcaacacggcattataaaaggcagcggg

SEQ ID NO: 676000 - DNA, 114 bp, Homo sapiens
gtgcggtaccttgacgtacaaccagtgcatcaaatatcgcttcagggcttgtcttttttcaggcattaacccaaggtggggggggggcaaaaatgcggcaaccggttggccgga

SEQ ID NO: 676001 - DNA, 1210 bp, Homo sapiens
  misc_feature (1016)..(1016): n is a, c, g, or t
  misc_feature (1191)..(1191): n is a, c, g, or t
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtacagaacctgctaaggccatcaaacctattgatcggaagtcagtccatcagatttgctctgggccggtggtactgagtctaagcactgcggtgaagaagatagtaggaaacagtctggatgctggtgccactaatattgatctaaagcttaaggactatggaatggatctcattgaagtttcaggcaatggatgtggggtagaagaagaaaacttcgaaggcttaatctctttcagctctgaaacatcacacatctaagattcgagagtttgccgacctaactcgggttgaaacttttggctttcgggggaaagctctgagctcactttgtgcactgagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagantattggttaatgcacatgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatngtgagactctgtctctatg

SEQ ID NO: 676002 - DNA, 869 bp, Homo sapiens
  misc_feature (1)..(1): n is a, c, g, or t
ncaaaaagtggagtacggtggaatccagttagagcagtgtaatgttaatgagtgtatgtttattgtttattgtcgactgtaagtgcgtgactgaagctctagtcagttggaacccgtccccttggtgtcccccccgaggttattcccacaattggcgttcttcccccggttaggcccacatcctttttgcgaagactccccaatcctctcttgacacacaatatcgtgtttcctttcccggccccgcgaaaattgccccgggtcttgcccccattcgcgcggggctccattctagctatgtggtttccacgcctctctgtagtttgggacacgacaataggtcactctgggggcccggcgccctcttctcctacaagaaaggagcggtttcggcccccaaagcgggcgctcatcccccgaagttccccctattcccggggttcacccttggtgccactgaactcttgccccacagaagcacccgattgtcctcatttaagttttatccgggggagagtacgtaccggtgtttccccccacacactttcggagcacgcacgcacgaaagtccccgccacggcgtacatcgggaaatccccccaggcgatagcagaccgactgaggtaaaacatcccattcacttcgcgtaggtccacacttacttatgttctcgtacgccccgagaatatgtgagaaattcatgtcgacaagagtagcgacagacacatctgctggtcgcagaacaggcaaatcctcgataaaggaacataagagccccccccaccaacccgcgggggaccaaattcggaggacccccccccctcccaccatttgggaacccctaacaaaaaattttacacaacaaaaca

SEQ ID NO: 676003 - DNA, 1259 bp, Homo sapiens
atcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgaagaacctgctaaggccatcaaacctattgatcggaagtcagtccatcagatttgctctgggccggtggtactgagtctaagcactgcggtgaagaagatagtagaaaacagtctggatgctggtgccactaatattgatctaaagcttaaggactatggaatggatctcattgaagtttcaggcaatggatgtggggtagaagaagaaaacttcgaaggcttaaagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacagttttctgtctcaatatctcagcttccagcttctgaattctgttttgtctcactgccaatctaagtcctagtacttctgaaatgtgagcaataaatgaatgaaatgaagcaaatagtattgttaaaaaaattggttacccttattaaaacagtaacttctcaatttgaacataacatatagataataaatgatagttaccaaaaaaaa

SEQ ID NO: 676004 - DNA, 968 bp, Homo sapiens
  misc_feature (879)..(879): n is a, c, g, or t
  misc_feature (896)..(896): n is a, c, g, or t
  misc_feature (907)..(907): n is a, c, g, or t
  misc_feature (926)..(926): n is a, c, g, or t
  misc_feature (968)..(968): n is a, c, g, or t
aataaaaattaaaaatagatgtagatgctatgttgctgaggctggcctcaaactcctggcctcaggtgatcctcccgccatgacctccaaaaccacagggattgtaggtgtgagcactgcacccagccttatgtttttttctacataaaaaacagcacaggattatcttccagagctaataaatatgttcaaataaccacaaccccattaaggaaaaatatcactgggcagcaaataatcaatccagaccaatatgatcacaattgctgtgaaggtgagaaaagttcatttttattatgtttccccaagagacgcactctattgttctcttgaaaacacacagctcatgcctggaatcccagcacactgggaggccgaagcaggaggatcacttgaggccaggagtttgagacgggcctgggcaacatagcaagaccctcgtctctattaaaaatataaaaaatacgccaggcgcgtggctcatgcctgtaatcccagcactttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaacagtccaggtgtggtggcacagccctgtagtcggagctaataagaagctgaggtgggaggatcgcttgagcccaggatatggaggctgcggtgagctatgatctcancactgcactccagcttnggggacagggnaagtctgtctcaaaaaaanaaccagacactggacttccatttaaaacacaccacaacaaan

SEQ ID NO: 676005 - DNA, 528 bp, Homo sapiens
  misc_feature (26)..(26): n is a, c, g, or t
  misc_feature (151)..(151): n is a, c, g, or t
  misc_feature (200)..(200): n is a, c, g, or t
  misc_feature (310)..(310): n is a, c, g, or t
  misc_feature (326)..(326): n is a, c, g, or t
  misc_feature (378)..(378): n is a, c, g, or t
  misc_feature (453)..(453): n is a, c, g, or t
  misc_feature (503)..(503): n is a, c, g, or t
ggtagtagctggaagtacaggcgcangccaccacacccagctaatttttgtatttttagtagagacggggtttcaccattggccaggctggtctcgaactcctgacctcgtgatacgcctgcctcagcctcccaaagtgctgggattacangcatgagccaccgcgcccggccattttgtaatttttttttttggtgganggaggatagaagctcagccacctcttgcccagtctgcagcaggtcagccaggaaccttcaaccatctctgcagccagagcctgtcttcaggtggacagagccatctcgcnttgtcacccaggctcnggtacatggcacagtctcagtcactgcagcttcaactctggggctcaacgantctgccaactcagctcccaagtaactggggatacagtgtgtgccaccacgcctggctaattttgtattttagtanaagaggggtttcgccaggttggcagatggtctcaaattcttgcctcaggngagctgcctcagcttcctgtgggat

SEQ ID NO: 676006 - DNA, 470 bp, Homo sapiens
ctagaggacccgaccatccacatcacttctctgttagtctgggagagtgtatgtgtcgagattatcattcttctaagatttctacttattgcgtagaggtgtttgcagatctctgatgtagtagattctgtgggatcgggtgggatatccccctttatcattttttatcgtgtctatttgattcttctctcttttttctttattagtcttgctagcgggtctatcaattttgttgatcctttcaaaaaaccagctcctggattcattgattttttgaagggtttttcgtgtctctatttccttcagttctgctctgattttagttatctcttgccttctgctagcttttgaatgtgtttgctcttgcttttctagttcttttaattgtgatgtcagggtgtcagatttggatctttcctgctttctcctgtgggcatttagtgctataaatttccctctacacactgctt

SEQ ID NO: 676007 - DNA, 227 bp, Homo sapiens
ctgatattacctgcaatggccccttcactgtgctggttaaggagtcttgtgactggaatgggagacgtgaggcagaagcaggaagcagcagacatgctctggagaccgtgagtgacagatagtcgaacagagcataaccttcttaccatccccttctcggctagggtgtctcgaagaggctctgagccccatggcgccgggcccctgaggcgtggtaccgatctcga

SEQ ID NO: 676008 - DNA, 278 bp, Homo sapiens
ttggccaaattgggtacctgtcgtgtatgcctgcttcctggatgacaaccaaatcatcaccagctctggggatgccacctgtgccctgtgggacattgagacaggccagcagacaggtgtggttagtgctggacacagttggggatgtgatgtccctgtccctgtcccccgatgaccgcactgtagtgtcagtgcgcctgtgatgcctctatcaagctgaggaacgatgcgggataccaatgtgcctgaccagacctaacatcggacatgaatccgaa

SEQ ID NO: 676009 - DNA, 319 bp, Homo sapiens
cgccatttacaactatctggaaaaacagttttatgacagtgggcaacaggcggtgaaggttatagtggtcccaggagaaggcacacaaaagaggtgagccctacacctacaatctattaatgcaattgatttgttgcctgcaggcattttccagatcataatgcatgtatggtcttccaagcagaatatagtaatttcaatgaattgaggagacaaaaataagaatttggggagtttaaggcagctaaacatttgggcctgagttccagaggagaaagaactatgcagaaaagagatccagagatagttgtaaatggcg

SEQ ID NO: 676010 - DNA, 160 bp, Homo sapiens
gtcacgtcggccgggcatggctgcatggagcccggccgcggcagcccttttcctccgcgggatccggggcattccacttaaccatcggatgtttgccactagaacttagggggagctcagagtaacccaattctcaaagaaagttccacggctaagctat

SEQ ID NO: 676011 - DNA, 102 bp, Homo sapiens
gttggctaacgtggtcggtggagaggctggagagagaggcagggtctagtcatttcatgtcaaagggtctggttttattaagtgaggaaactcagtcagata

SEQ ID NO: 676012 - DNA, 153 bp, Homo sapiens
cccccaaaaaaaaaagcccctttttaaaaagcctttttttaaacaaaaaagttttcccccccgggaaaaaaaatttttggaaaaagggttaaggtttttaaagttaaagggggggcccaattttccgggtaaaaaaaatttttttcgccccca

SEQ ID NO: 676013 - DNA, 1071 bp, Homo sapiens
  misc_feature (472)..(472): n is a, c, g, or t
  misc_feature (571)..(571): n is a, c, g, or t
ggagagagagaactagtctcgagtgtttttattgtttttgaaaaaacaaattaaaaactttatgggaggtatcaagcatctaaattgggatcaattggatacatcgtgggcccatttggcagaaccataacaggttggcactttggcaaagatgtgcaatctgggctgtcggggtcttttcatggctacatggggggtctacccctggctcttcccttctcccggacctggcatcctggtgcctccacagtccggcccggcctccggtcgccacgggttggaagacccaaggcccgggaggagaagaaccctggtctggcacaggggggctgggtctgggctggcgagacgcacaagagaggggcacagggcagtgtatagcctcggcacaacagggggaggggggcagggcaagggagatcgcgtttactccctactatcctgggggtctgagagcccccggggccagggngcacaggcacaacaagaggtggccctaatgtacaaggcccattggtgggctccacagggaaggcctggctgagtgggttcactaactccacatccccantttacacccggacagctctaatgtggggcaaaaaccccccgggataatctcccggagcacaaatattacacccagagtttccagtggatagaaactcccagaaactcttgtaacccagtgtgtctgtgggtttatcacccattcctgtgggttcactgagaagtgtagggaaacaaaggggtacgtggcagaaagctcccttccgtgggcccgtgggaaaaaccagatctgggagggggaaagcgaactctacagccaccacacgggtatatcctcgccatcaactcccccgagaggaagatttcggaaacacaacaaaagctgcgggacgaaagaaacacaacaccgagtacaactaaacaacaaaaggtcccgatgcaaccacagggatccgcgacatcgggacccatgggggagaacggtaaacaaattcaccccatctccccccatcaagcagacggccaggagacaatgacctcgggtaaccggaaaaaaggggt

SEQ ID NO: 676014 - DNA, 132 bp, Homo sapiens
cgcaccgctggcctggacgacgatctctgggtcctcgatgtcccttgctctgcaccatccgatccagctgatggtggtatctccggactgggcttttgcacactggatcaacaaaagccaaacaaaaaataa

SEQ ID NO: 676015 - DNA, 160 bp, Homo sapiens
tgggccattaccggggaattcataaaaaacaatagcctcatcatcccccccataatggccctattaccctccttgacctctacttctccctgggcctaatcttctccaacctctatcaccttctcccatatctaacaagtaaaaaaaaatgtacggtttg

SEQ ID NO: 676016 - DNA, 659 bp, Homo sapiens
  misc_feature (30)..(30): n is a, c, g, or t
  misc_feature (64)..(64): n is a, c, g, or t
  misc_feature (68)..(68): n is a, c, g, or t
  misc_feature (72)..(72): n is a, c, g, or t
  misc_feature (75)..(75): n is a, c, g, or t
  misc_feature (94)..(94): n is a, c, g, or t
  misc_feature (96)..(96): n is a, c, g, or t
  misc_feature (99)..(100): n is a, c, g, or t
  misc_feature (102)..(102): n is a, c, g, or t
  misc_feature (107)..(107): n is a, c, g, or t
  misc_feature (110)..(110): n is a, c, g, or t
  misc_feature (117)..(117): n is a, c, g, or t
  misc_feature (120)..(120): n is a, c, g, or t
  misc_feature (124)..(125): n is a, c, g, or t
  misc_feature (135)..(135): n is a, c, g, or t
  misc_feature (138)..(138): n is a, c, g, or t
  misc_feature (145)..(146): n is a, c, g, or t
  misc_feature (148)..(148): n is a, c, g, or t
  misc_feature (155)..(155): n is a, c, g, or t
  misc_feature (169)..(169): n is a, c, g, or t
  misc_feature (172)..(173): n is a, c, g, or t
  misc_feature (176)..(176): n is a, c, g, or t
  misc_feature (182)..(182): n is a, c, g, or t
  misc_feature (207)..(207): n is a, c, g, or t
  misc_feature (215)..(215): n is a, c, g, or t
  misc_feature (219)..(219): n is a, c, g, or t
  misc_feature (223)..(224): n is a, c, g, or t
  misc_feature (227)..(228): n is a, c, g, or t
  misc_feature (235)..(235): n is a, c, g, or t
  misc_feature (237)..(237): n is a, c, g, or t
  misc_feature (239)..(239): n is a, c, g, or t
  misc_feature (243)..(243): n is a, c, g, or t
  misc_feature (245)..(245): n is a, c, g, or t
  misc_feature (250)..(250): n is a, c, g, or t
  misc_feature (252)..(252): n is a, c, g, or t
  misc_feature (261)..(261): n is a, c, g, or t
  misc_feature (265)..(265): n is a, c, g, or t
  misc_feature (270)..(270): n is a, c, g, or t
  misc_feature (276)..(276): n is a, c, g, or t
  misc_feature (282)..(283): n is a, c, g, or t
  misc_feature (285)..(285): n is a, c, g, or t
  misc_feature (287)..(287): n is a, c, g, or t
  misc_feature (293)..(293): n is a, c, g, or t
  misc_feature (330)..(330): n is a, c, g, or t
  misc_feature (336)..(336): n is a, c, g, or t
  misc_feature (338)..(338): n is a, c, g, or t
  misc_feature (341)..(341): n is a, c, g, or t
  misc_feature (345)..(345): n is a, c, g, or t
  misc_feature (358)..(358): n is a, c, g, or t
  misc_feature (386)..(386): n is a, c, g, or t
  misc_feature (434)..(434): n is a, c, g, or t
  misc_feature (477)..(477): n is a, c, g, or t
  misc_feature (491)..(491): n is a, c, g, or t
  misc_feature (579)..(579): n is a, c, g, or t
  misc_feature (657)..(657): n is a, c, g, or t
cttactcaccccggtgcatgcgggattgcnggagagaacgcggggatggagccgggcaggaacnaganaaancangaaaccaggtaaaaagaananatnntngaggngangaaaaanaanaaanncatcccatcngcntgcatcnntnagcctcncaaagaagcacaanaannganagcccngggaactgtggaaattgaactcaanagaatcangaanatannggnnctgggcnanantgcnancttcntngaggatgcngtanaaatntaaaanaaaaanntntnaaccanaaaaaggcggaatctgctatggaaaagctcggcaccnacggtngngtntgtnctgtgctgctttngtctctggatccatcgttccctggagcnggtggaaataaacataaaataatattaagcagtgtgctattacatgcngatgctggtcatggtggaaggctttggggggaaggaggcagtnctgaggacgctganggacaccccgatgatggtccacacaggcccctgctgctgctgctgcccctgctgtccacggctgctgctcaccaggaagaagcttcanctgctgatgttggggcctttccaatacgccttcttgaagataacgctgaccctggtgggcctgtttctcatccccgangg

SEQ ID NO: 676017 - DNA, 175 bp, Homo sapiens
gtgaagaagctggatctcatagatactaaatggtggatctaggcgcagctgagcggatagcaccgggacatatattggaatggatgaggtctggcacccatgagcagtccagacgaggactatggatcttacgttgcgcacatataggctaggaggatacatatgcaagcacggc

SEQ ID NO: 676018 - DNA, 751 bp, Homo sapiens
  misc_feature (383)..(383): n is a, c, g, or t
  misc_feature (430)..(430): n is a, c, g, or t
  misc_feature (652)..(652): n is a, c, g, or t
  misc_feature (683)..(683): n is a, c, g, or t
  misc_feature (690)..(690): n is a, c, g, or t
tccttagaagaaagggcgccctgagctcttatatctcctaattgacacacattatacactatcaaatcctatcattcttggccagacacgatggctcatgcctgcaatcccaggactttgggaggccaaggccgtcagatcaccaaaggtcatttgttcaagactggggtggccaacatggaggaaccccatctctactaaaaatatggaaggaaaagataaatggctaataaaaaacatgggggccgccttagaccatccgactgtagactaaagcgagtttatgcatgcagccggagttcagactcacttggccaatttaccctaaagtgagggggattcatttcactggccgtggatttacaacaaacagactgagaaanccttggcgtgtccgaacttaatcaccttgtagcaaatccacctttcnacagctggtgaaactcgaaagaggcccaaaaccgtcgaacttacaacgaaggcgcatcgcgaacggcaaagtggaattgccggcgttaatattcgcgtgaaaattgcgtaaaattactagggaattacctgattatataaccaaagggccgaagacggtataaacccttaaaagcaaaaaaataggcccggatggggtaaagggatttccaaaatgggaaanaatggcctttaaactacctaggctccaaagnaaaaggnggaaaaacggcttttgggcggggcccaccacgtgaacaatacactaaaacccctattaaac

SEQ ID NO: 676019 - DNA, 198 bp, Homo sapiens
aggtcagtaacgatatttggagtcagcacggtagctcacgtgtcgaaggaacttgtacagggaggcatgcaccgacatgttgaatacacgtcgaccaggatccatattaacgatatttggagatgagcacggttctcacaatgttgaaggaactagtatagggaggcatgcacccgcagtggtgaatacacgtcgagc

SEQ ID NO: 676020 - DNA, 318 bp, Homo sapiens
gctccttcgcgcactccagtcatgctctctctccgtactgccgcctgccggtcggctccagtgtccccacctgtgcctccgataccagcccgaatggagtagacacatctttgtggcctgtgaagggagcccttatgtgccagtccactttgatgcttctgtggaggactctaccttcggtcagagctgtgtgatatgctgatatccctcaacctcatcctctccacagctgcctcttccctcttccttccctgctgtgaaagaagtaactacagttagggctcctattcaacacacacatgcttccctttctggtgg

SEQ ID NO: 676021 - DNA, 940 bp, Homo sapiens
gctctcaagcttggcgtttgtattgtgtggggtcacacgcggtttcaacatgcgtatcgaaaagtgttatatttgttcggggcccatctatcctggacacggcatgatgttctgtcctgcaatcgattgcagatgggtgtgcacgatctcgcaaatctagaaggttgtctataaataactttaggcaaagaatgcgcaatcctcgcaaagtgaaggtggaccagacgcatccggaaagcacggctggtaaagagctgacagtggatcattcagttcgaatttgagcaagcgtcagaaatgaacctatcaaataccagcgagagctatggaataaaactattgatgcgatgaagagagttgaagaaatcagaccagaagcgccaagctaagtttactaatggccagatgggtagagcaactaaagagctacacgaaagtttcaggatactcaaggagaagtcaagcaaaagcatccatcgtttatccgagcccctcttggcggctaagggaacacagtggggcagagcacccatggttgccggccgtttacaagaggatgtggactggaagatgctccttaaggaatctctgttacccattgtcttctatgtacatttgaaaatgccccttggattcttggaacctgcttaaattatttatcttcttacatcaggtgccttgaatgcagaagggattcaaaagacatctttcctgcctgcatctacttatatccgatttcgcgtttcgatgctttcagggtgaaccttcggttgatgttctagtatccggaaattcccggaaccctgaaggagtgtggcgccaaggtgggccattgggatgtgcaggcgctctgtggtactctggcgcactgtttctgttcacaaaattttcgccacctctggtaagggagacaaaaagaggggaatttttcggttcaaaa

SEQ ID NO: 676022 - DNA, 169 bp, Homo sapiens
atcccacaggttcgggctacccctctcttagagccagcgcgctgattccagcttacacacttcttagggataaatatgacttatttttcaaaatcgtttttaatttacactgtgtgttagtgtacaattgttaaccttgtcagatggatcatgtgtataagaatgtagg

SEQ ID NO: 676023 - DNA, 202 bp, Homo sapiens
tctcgtcaactggtggattatatcacttgaatgctgggcgaagaccgagatcactttagtcgatgcagggcccacgtgataagcagatgttttaacgggggtatgtttcgtcttgcgtccgctcctccggcccccacgcccatcgcgtccgcatcctgggggagcgatcgctgaaatcgcccattgagtccgacttggatgc

SEQ ID NO: 676024 - DNA, 241 bp, Homo sapiens
  misc_feature (99)..(99): n is a, c, g, or t
aactcccaggttcatgccattctgccgcctaagcctcccaaagtgctgggattacaggtgtgagccaccgtgcccggccttagatgtagaattttcccnaaagagaattctttgagttctgtttcagttatttttgattgagacaagtgtcatgtacctacataggtatagtttgcatttgctgtaaactcttgtgtggactatacagatagattgagtagtatagctgtattgtggttct

SEQ ID NO: 676025 - DNA, 161 bp, Homo sapiens
gacgacgaagcgtagaacctacataaccattcttaatttaactatttatattatcctaactactacctgcattcctactattaattaataatcaagaacaatgaccctaatactatctcgcagctgaaacaagctaacatgactaacaccacataatacca

SEQ ID NO: 676026 - DNA, 129 bp, Homo sapiens
tagtcggcaactaaaaatgattatggatactagtataaaatatcaggttcgtcctttagtgttgtcgtattgttctcatttgttttgatgttcagtttgatatagtcattgtcgggtggtgattagtct

SEQ ID NO: 676027 - DNA, 613 bp, Homo sapiens
  misc_feature (577)..(577): n is a, c, g, or t
  misc_feature (579)..(581): n is a, c, g, or t
ttttgagggggcccgcggcccaatattaatcatctcacccatcctaaatacttcccccgccttgggccccacccaaccttttgtccccccctcttattgcccccccctcccccatttaaaaggccccaaaaacccctttttgggggcccccccctttttttaaaaacccccttttttgtggggtttttttaagccccagaaaacccctctttttttaaaaagggcgaatttctttttcctttttcaacaattgaaaacgcccctgtggcccgcgcggggttttttaattttttataaaaatttccccggcccaaaaaattgtttttatttaaaaggcctttccctcccccccggtgtttttaaaaccttttcttgaattaatataagggtgtgcccaaaacccttctctataaaacaaattttccccttaaaaaggccattttggcccatatggcccaagggggttccctaaaatttttgttttaaaattttgggggccccccccccctttttctatgtatgtgacaaaagccttttttttttcccttccaaaagcatatattctcagttttgaaancnnnccctcgagactagttctctctctctctctcac

SEQ ID NO: 676028 - DNA, 100 bp, Homo sapiens
cgtgctgccagtttctacccgcccccccttttttgcttttcggggcgattggggctgattgggctcatcggggcttgtctgtggcttcatctgtggcctt

SEQ ID NO: 676029 - DNA, 139 bp, Homo sapiens
aaccgttctagaggatcacctgcttacgtgggagtattcctttttctacactcacaacaaaataactaatactaacatctcagactgctcaggaaatagaaacctgtctgaatatcctgccctgcatcatcctagtcct

SEQ ID NO: 676030 - DNA, 108 bp, Homo sapiens
ctgctgctccatagaggtgctgcggtgctgctgctccctagccttcatgttctgtcttcctccttagccagaacgccactcccttccacacatccccttcttctctcc

SEQ ID NO: 676031 - DNA, 964 bp, Homo sapiens
gatcccagtctcagaaacacagataaaattgcaacattcatctcatatcctccaacagctattccctgttctattggactccctagcagtcatctccttgtaagattatttacttacacattggtttagtggtgtatatacccacaaaaacttatgctctataaggacatggattcttatatgtttgtaacttgatgtttcctagttccttgaacagcacgttgatatacagtatgtgctcaataaatagttgttatatgcataaataaaaaatattatatttatttatttattattattatttttgagaaggagtcttgctctgatcgcccaggctggaagtgtagtggcgcgatcaccagactcactgcaaactctgcctcccgggttcaagcaattctcctgactcagacctccagagtagctgggagtacagccatgtgccaaacatgcccagctaatgatcagtataaggtatccagtataaataatggctcgctcaacgggtttcaacaacttaccatgttatgaggtatataaattagtactactggagaaaccaggaataaactatcgaggatagctcaggtacatgaagctagactccagatacaagaagtcatgtcaatacctgtgaaaactgtgcacttgttacataccattcattcaatatggcgaaaggataacagcgcactccgactacatagcgctatcgcataacgcgcacaccgatagcctcaaggcgaaatccaccaccaagataacacgccaccggaaccttagacaggaccacaggagaagaaccaactacatctggcacatacaagaggagccagaacaaagggacaaataaaaggacgagagcgacagaaacacaccacaaagaaggaaagaagcacataaagcatccgaccaccacataacacaaaataggcaacgagacacaacacccataaaacgcaaa

SEQ ID NO: 676032 - DNA, 889 bp, Homo sapiens
cttgcttatcaaactgtgcgccccaatagtttagatagcctccgtggtacccgcagaataattcttctcgggaaaaagttttcccggacaacggttttttcaacaccagacgtggtaccacagcccaaagggtccccctgcgctcaaggtcctttgatctttaggagggtgcgcagccccctttggtagtcataggtgcctcccacgccctgtcacaactggacacccaaggcttagaacattaagggatgggaacgggttataacactgcccccctcggggctgtgtaaagcaatttccccttttctagggccagtcaccggcaatttcttcttctgatcgttgtacactggcgtgacaaccgtcgaaagagggtgacactgggcaccgctgttaaatgtctcttcaatcagtaccacccacccataagagtcacccggtgtcccgtcacccccgcatgccaaagctacaaatggttctcggaggacccacgaattggctggtagtgcaaccccgtgttcgttagatgcacactgcataaaagggtcttaaaaacagacttcttgtttttacggcggcctctttaaagtggaacccccgtatgttgcggccccctccagagcccaccccgttagtaaaaaaggaaaaaaaattattcatgtttctgaaaactttggtatctttgtgaataaaccacaattagatttctttttgaataaacaagatcttcaattggcgtatcataatctatcaaagcttagagctccagaatactcccaaaagagaaaatatctccacccttacattctcctctgtaaaaataagaaaatgaactcttgcacccacaaccattaaaaaaaataatcaagaaaaaaacagcaacaaaaca

SEQ ID NO: 676033 - DNA, 239 bp, Homo sapiens
aatttgatcctgtcattatgatgttagctgattattttgctcgttaggttgatgcagtttcttcctggcatcgatggtctttacagtttggcatgtttttgcagtggctggtaccggttgttcctttacatgtttagtgcttccttcaggggctcttgtagggcaggcctggtggtgatggtttcctgcatcacatctctgtagagactcttctgtgatggacccagcaaagcccactc

SEQ ID NO: 676034 - DNA, 562 bp, Homo sapiens
gatggcttccgcaccagggtcgtgcagctgtggtctctaagaaggagacgtaacaattcatgagtagtgaagccacacgctccattaataaagttccctaacagaagagacaaacctaaactcagtgcctcagaagctttggggtctgcagcgctcccctcccactcctctgcaatttcacagcattctaaaggaagtacgtcccccgatttactgatgcaccaggggccaccagacactgcagaaattataaaatcattacctcagaaatacagaaggaaacctatgtctcaagaggaaatggaatttatccagcgtgggggtccagagtgaccgtcgtggctgctgcttgtcaccagacagaagggttagctttacaataaaggacttccacaatgtcaaatgaaaagtcatatattaaacaaccttaataaatattctgtgagcagaatgaagtacagaaactccaggtggtcacttgtatctcctacactgtgtatctcggtcagctgccccacaagctgccctgtacacttattaaagtctacatttttaaatgcta

SEQ ID NO: 676035 - DNA, 180 bp, Homo sapiens
ttgtgactatgaatgatatctggcggggaagagaagtagcacaagatgctactaagcgcctgtgcaagtctactcagctaagagctgcgggtgtcaggcctgcgtccggtgtgagatggcagccgagctaggttctgattcacctggtggacccaggtgtgcctgggattccattggggg

SEQ ID NO: 676036 - DNA, 115 bp, Homo sapiens
  misc_feature (47)..(47): n is a, c, g, or t
ctactctctctctctctgtctctctttctctgactatacctactctnactatagatatatcgaatcgatatgtgtatatccagatctgtctatagatatatctgtatcttgatag

SEQ ID NO: 676037 - DNA, 156 bp, Homo sapiens
tgcctttaaacaggagtgggaagcagttagataaggagaggaaaggctggctgatgaacaaactccattatccttgcttttgtgtttctactcaagtgttttaactaatgggctgtttagagagagtttgccctggtgaaattaaaagcaaaaaat

SEQ ID NO: 676038 - DNA, 161 bp, Homo sapiens
tagagaatcccccgtcagagcagttcttatgtaagtgctgactcccttaacaattacctcatatctcttctggctgtagggtgactcagtggaatccattttgtaaacaccgacaattagttgttaacacacccagtgtgttaggccagaagggcatgctc

SEQ ID NO: 676039 - DNA, 120 bp, Homo sapiens
tcctggatcaatgcagtgcatccaccgtgaacttgcgagtgacctggtggtggcccaccacgaaatgggccacatccagctagtttcatgcagctacaaagacttaccgtgtggcgcttg

SEQ ID NO: 676040 - DNA, 254 bp, Homo sapiens
  misc_feature (148)..(148): n is a, c, g, or t
  misc_feature (183)..(183): n is a, c, g, or t
ttccaggacaccttgtggataccaaaacctacagatgcccaagtttgttatataaaatggtgtagtagttgcatataacctatgcacaaccttctgtatattttaaaccatctctagattttttataatacttaatacaatgtaaatnctatgtaaataattttatactgtattttaaaattngtatttttttactgtcattgtgtttttcctgaatatttgtgcattgctattggttgaatctgcatatatga

SEQ ID NO: 676041 - DNA, 333 bp, Homo sapiens
accagcagcgtagatcacctgggcatgatctggaccatcatccttaggttcgccatccaggacatctccgtgggaatagacctcggctaggaagggctccttctctggtgccagagaacagacagccctcgtataacaacgtcaatgtgcggagacttccaccatcagctggaaggatggtcttgccttccatgccctgatccagcggcatagaccagagctgattgagtatgactagctgaggaaggacgaccctgtcaccaatctgaacaatgccttcgaagtggctgagaaataccacaaaatccccaagatgctggatgcagaggacat

SEQ ID NO: 676042 - DNA, 208 bp, Homo sapiens
ggggtgtcttagtgctgctattgggatacggtgtacaaatatttgctataatccccattttcagttccttgggatatatatccaggagtggaatggctgaatcatatggtaattgtatgtttagctgcgggacagacccccatactgttttccacagtgactgccccgttttacattcccggcagcaatgcacaaaggctcccatctc

SEQ ID NO: 676043 - DNA, 141 bp, Homo sapiens
gcttcgtctgtatcgccataatcacagacagtccatacttctcctatctctcccagtcctagctgctgacatcactatactactaacagaccgcaagctcaataccacgcttcttcgaccccgccgcgaggatgagagccc

SEQ ID NO: 676044 - DNA, 727 bp, Homo sapiens
cccctcagcaatgctctcgcagttaccacatgatccttcgtgtatcttgccttccatttcccttgggtggatggttgggtagtgtggggttatcctggtttggtggtttactcagacaacgggccctcatacgggatgggtgcacctgtgaacccccaccactcctgggctgaggagcgtgtcacatgatgcctgttgtgtgatggtacttggaagccgtcatagagttttggttgtgtgatagaccgcatacatgacatccaacaatcatgctccaccagcagctacagctgctcctcagtcatgctcatgtggaacctctacttatgaggtttcgaatggtgcttggagccattggcacgcaatggaagcttgagaacccttgctgcatgatctaccaccgatactgcaaccacctatgtaccatgtgtatccagaagcggcacatcagccccttgcagcatcagcatcttatagtagttgaacatgtcgccataccaggactgcccatcaacatccacaaactcttgtggtcagcttcacaggctgacgtctcaaagcccagattcggggtgagctggcgaggaagaagccaaagttcgatgtgcatgatgtggcctcatgcgtccaaaggatattcccatgtgtctgaccttgacttgccccaggtagcaaaccaagcagtaccagaccattttgccacttcgcgatcgtcatacggcggacg

SEQ ID NO: 676045 - DNA, 545 bp, Homo sapiens
  misc_feature (428)..(428): n is a, c, g, or t
  misc_feature (466)..(466): n is a, c, g, or t
  misc_feature (511)..(511): n is a, c, g, or t
  misc_feature (522)..(522): n is a, c, g, or t
ttcagtaattccctaattcctagtttacctctttacacctaccctgaaaacttcagtatactcttcttataacctggttgttcaagatctcatggcaccacttttgagtggcagtcttgggagtttttctcatcaccactgttaaatttgcctctgttgtatttatttccctttccaagattctactttgggagaggtgaagctaattaatttgataaattgtgtcagtgggcgccatgagaaattttggcgtcggcaagcctttgatatcaattatcaactgacaaaatatagagaaggcattttgctgtgttcatgtgcatctctgtcctgcaggaaccatcttattacagattctcagtgggttgggggaggatggtggcactggtgtctggtagcacggaaaagcatccttttttttttttccnttttgagaatccggatctaggtaatttggtaaactccnggagggacataatatcattcacggggtataagcccctaatggccncgggtctggcntcccaattaataataagtaaaaa

SEQ ID NO: 676046 - DNA, 198 bp, Homo sapiens
gccagacttccgcccaagcatgaacaggacttgaccatctttccaacccctggggaagacattttcaacttactttgggaggacacagcttcagcacagcctcttcttccggccagcccgctgcgaacccttcaccagctaccgcgaggaggagggagagatgcgctgtgtggggtgtttttttacataaagcgaact

SEQ ID NO: 676047 - DNA, 170 bp, Homo sapiens
tggttgggggactgaacaaactctgtattatcagcttcagtttctccccctagtcctccttcaacacataggaggatctccccttctttctgctcacgggctttatctaggcttccccagtgcccccaggacagcgtggctatgtttacagcgtcagcctgtgcttaaga

SEQ ID NO: 676048 - DNA, 788 bp, Homo sapiens
cctgtctggactgtggagctcggttctgcaaacactggccatctaactgctctgcatgaaggagagtaaagggtggaaaagacggttacttggttttgagtaagccaccacacacatgatgccgaccacaaggagggcgatgcagatgccgcatatgaaatgggcaacccattgagcaatccctgcagctcctacacctcgcacccgccacacccatttttttttccggaacctacaacacgcccacaccggcgatgagttcttttttttccaccgccccccccgcgggattccccgccattctggaggtcgccgccaccacccctacgggccactagatgcgtccgcaagcaacgacctcccaccccacaacccctccaccgactcgtctcccaatttccaccaccacacattcgagccgccaccataacatacaaaatcccataatcccctacactcctccaccctcacatacgtcgtcatatttatcacaacccccccccccccccgctcgcccacactagcttttctacgtttccacctctaacacgcacccagccccctaaacctacaagataccgccggttgatcgcgaccgtcaggacaaacactccccacactgcaaccctgccagcagacccaacctcccgcaccccaacccagccacacgttccccccaccccactaaccacccacacatttccacgccatcccccctctcacaacataagcaacgcactaacaacaaccaccccctctcccctttctttgcatcccgcccataccag

SEQ ID NO: 676049 - DNA, 164 bp, Homo sapiens
caaggttgctgggtgctgtgggattgcacataaatctcccaggtattgccagtcttctgagcctcaggcaagcttgtgattaaatgactccagtagtttgaggacagtccttactgtcagaaggttctttggaagcaaaagcagacataggcatgagagggtaa

SEQ ID NO: 676050 - DNA, 523 bp, Homo sapiens
  misc_feature (136)..(136): n is a, c, g, or t
  misc_feature (433)..(433): n is a, c, g, or t
ttccgggttgtgcatcctagttctttataggccctccaatatgcacattaataagtgtttccttttccattcatttgtggagtcatcagggttccaaatcagggtgtcaagaggtactgcctctcttctctactgngaatgatggttcccctatctcttcaccttccctattttctcttttccttttgggcctactgtaagaaacatactgcttgtctccaaatttctctgatgcatgcagagctgcctgcttttcagctgcggttagggtttggcttaggagcagcataacatctctccatgaggggtcaaacacctgagttaaatttgggaaagcttctttatacctatcggagtcatcagaaaatcagcctaagtatccctttatttgcctaaggtcatgcaatgagacaggaacttgaaccctagtggnatcacctccattggtcatttcctgcaggggtaagagtgaagctgggggagtggggaattttggagatagtggaatagaggagctgatggg

SEQ ID NO: 676051 - DNA, 127 bp, Homo sapiens
gccggcaaaccccccctccccgggtttttggggttgggggaggatttttgggcgggcccccgtgttaattttttccggggcccccgcatggaaattaagccccccgggctgccttggggccctccca

SEQ ID NO: 676052 - DNA, 304 bp, Homo sapiens
  misc_feature (16)..(16): n is a, c, g, or t
  misc_feature (27)..(27): n is a, c, g, or t
  misc_feature (62)..(62): n is a, c, g, or t
  misc_feature (281)..(281): n is a, c, g, or t
  misc_feature (295)..(295): n is a, c, g, or t
  misc_feature (302)..(302): n is a, c, g, or t
acccaggctggagtgnagtggcacganctccgctcactgcaagctccacctcccaggttcanaccatcctcctgcctcagcctcccgagttgcagggactacagcacccgccacaatgcccggctatttttttgtgtttttagtagagatggggtttcactatgttagccaggatggtcttgatctcctgacctcattacccgccgactccggctcccaaagtgctggaattacaggcgtgagacaccgcgcctggtctccatcaaatgactttttaaatnaaatacggttctcncctcctnaa

SEQ ID NO: 676053 - DNA, 429 bp, Homo sapiens
  misc_feature (62)..(62): n is a, c, g, or t
cctttcttgaagaaaaattgtaaaaattacactttgggaggccgaggcgggaggatcgcttnaggtctggagttcgagaccagcctggccaacatggcgaaaccctgtctctgctaaaaatacaaaggttggctgggcgtggtggcacaccctgtgatcccagctggttgcgaggctgaggcgggagaattgcatgggcccgggaggcggaggttgcggtgagctgagatggtgccactgggtgacagagcgagactctgtctcaaaaaaaaaaaaaattggaaaaatcagccaggtgccgtgggtgcatgccagctatttgggaggctgagacaggagaatcacttgagcctgggaggcagaggttgcagtgagcccagagcacaccactgcactccagcctgggcaacagagcaagactctgtctca

SEQ ID NO: 676054 - DNA, 298 bp, Homo sapiens
  misc_feature (33)..(34): n is a, c, g, or t
  misc_feature (55)..(55): n is a, c, g, or t
  misc_feature (108)..(108): n is a, c, g, or t
  misc_feature (111)..(111): n is a, c, g, or t
  misc_feature (114)..(114): n is a, c, g, or t
  misc_feature (152)..(152): n is a, c, g, or t
  misc_feature (224)..(224): n is a, c, g, or t
  misc_feature (240)..(240): n is a, c, g, or t
actttttgaaagtctcccttttaaattgccccnncgatttagattttacatgttncccttggtttattcttgggctttctggatttaaaactttggctggactaagcnaangcnaggttataatttagctaatagtagtttcccgcccattntgatgattatgatttcctttggtttaactaagctggactagttcctttcataaggaaatgatactgtagccnaatgtaaataaagccngtgagtccagcccccagtggggtttgttaaaaataaactaaagatttttaacctctga

SEQ ID NO: 676055 - DNA, 165 bp, Homo sapiens
agcctttctattaggctcttaggtaaggattacacatgcaaggcatccccgttccagtagttcaccctctaaatcaccacggatcaaaagggacaaggcatcaaggcacgcagcaatcagctcaaaacgcttagcctagccacacccccacgggaaaacagcagt

SEQ ID NO: 676056 - DNA, 864 bp, Homo sapiens
agcacggagacgacgacgggtgcagagcacttccctgagccctgccgccggtcgcgttcgcccctgcagtacccaagtcgtgatgaaaatcgggcggctcaaagcgcgtggtaagaaccgccgggggtgtaggcccccgccggaagggtcgcggtgcccttgagaagtgtaaacccggtgtacggcaccgttcaccacaggggggcggccttctaaaccttaccgcccgccggttaaaataacatacaatacgggggaaggcaaaaaatatttaaaactccgggggaagatgggtccccgtgtgtgggcaacgacacagtgccccccgtgttttgggttaagcttcccgtcgccctttaaacaccaaggcgttaaataaatataaggtacccagtttcacaatgttggggccgcccttcgatgcgccccgtcctggttgatcactctccccgtcacatggaaaaggcgttctttggaatttcttcaaagacccctatcaagggggccatatcggctcaaattatacgagttgttcacacaccgccgcccgttgtacgagtaatacaagggccaccaccctgtcttacaaattctggcgcagagtcatgtagccactcgttgtgcagtttcttgcacgcaagccatgcccccaatcaaacggataatgacatacgtgggtgtctcttcagcacccccaattctggaacccaatcgtctacatcggtgtcatatttaagtgggaattggtaactcgcccccactaaccaaacgagtttaacactaccggaggaaagaaaccccccattttaaaataggggcacccaagcaaaataattaaaaaaaacccccccagcccacaaaaca

SEQ ID NO: 676057 - DNA, 157 bp, Homo sapiens
  misc_feature (38)..(38): n is a, c, g, or t
  misc_feature (83)..(83): n is a, c, g, or t
  misc_feature (142)..(142): n is a, c, g, or t
aagcagcccggaggagactgacggtccctgggaccctnaaggtcacccgggcggccccctcactgaccctccaaacgcccctntcctcgccctgcctcctgccattcccggctgagtctcagcatggcggatgggagcagcnatgcggctagggaac

SEQ ID NO: 676058 - DNA, 101 bp, Homo sapiens
  misc_feature (5)..(5): n is a, c, g, or t
aaacntgcagtgagaaataatgtatttttctatctgttttatatgtatgttatataacattcagaaagaatttttttcttgattgagaaaaggatacaaaa

SEQ ID NO: 676059 - DNA, 415 bp, Homo sapiens
ctacgctgctcacagtgatgactccgaatatgtgttttgtttaatgtacatcctgactctttagtcgaaaactaaaacccgtagagaatccttcctgtgtgtgccgccgcacctaggagggtgcctctccatccacaggcaatgcatgtccacagtcagctgggtctgctcggtagccctcatctccttatagtgaatgctgtgacgctcctctggtcctactggccgccggtgttgacaactttccagctgcagaaaaaggtcttaggtttttttttttggtttttttttttttgggaaaggaagtctcgcttggtccccagggtgggatggcattggggggaacccgagttggcccattggaccccaacccggttgtgccgaagtagaaacccggtctaaaaaaccaaacaaa

SEQ ID NO: 676060 - DNA, 2712 bp, Homo sapiens
  misc_feature (3)..(3): n is a, c, g, or t
  misc_feature (6)..(7): n is a, c, g, or t
  misc_feature (11)..(11): n is a, c, g, or t
aanacnnatcngtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaataaataaaaccctttttattggcgtctgggaacaaactttagggaaattcccaattttcggttaacagccaattgtggtgtctcccaaagattgaagacattcctatataaccctcaaatgtggttgcaggatctcccagaaaactgtgggcactggattgacaactcccttacgtgtgcccagtgtcttccgtgggggccattttggccaagggaccgggaacctcttttccccctttcatccgaagggggacaccacaggcaaggttctatggccctcctattatctgtgtttggggttttgttcgccccacaagggggtctcaccaaggttaggcctcctggagacattaccccgaaaggagcgctcctgggtaaactacaccgcggtgccatacagataccgtctccttgagatcttacaacagggtccctgaaagagactctccctctttagaaaagtactccctgtggaagacaaaccctcttttctcgctgtggtgacaatgatggccaacgctgattttgattacaccatcagttctcgctgtggtgaagaaacactaccagagtggtggtgtgttccacattacaatggggggagagattaccacccccaagggcgccagaagtgttcgccctatatagacaccatttaaagcgggccttggttggtgtgtactacccccaagcactaggtgggtaagaagagaaacgactcattatagtggagggacctgatgcgaggcttgacccgcatttatctgcccccccaaggtgtgggagatctcattgctacaaatatccccccaggggttgtcacataggatggtttaccacaccttgtgtgagtttaatgatgtaggggaaagatttaatgatttttcttcctgtttcaccaattgaggttccgtggcgaccacccatgttggggcatgttctatattgggagcattttatatacaccaagtcaaca

SEQ ID NO: 676061 - DNA, 631 bp, Homo sapiens
  misc_feature (3)..(3): n is a, c, g, or t
  misc_feature (6)..(7): n is a, c, g, or t
  misc_feature (11)..(11): n is a, c, g, or t
  misc_feature (499)..(500): n is a, c, g, or t
  misc_feature (503)..(503): n is a, c, g, or t
  misc_feature (505)..(505): n is a, c, g, or t
  misc_feature (507)..(507): n is a, c, g, or t
aanacnnatcngtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtaatgtttttaacacattcacattaatgactcactaaaacttgagcttcatgttttcttagaatttctccccatcactcctccatctgtcgaccnnccncnantctgaacttctaactcaaggtaatgttggcatagccaatattaaggaaaatgtaatggtaaatatataaaatgatctaaggatttcattcttttacctttctgtccccaccctgcttgccccca

SEQ ID NO: 676062 - DNA, 497 bp, Homo sapiens
  misc_feature (365)..(366): n is a, c, g, or t
  misc_feature (369)..(369): n is a, c, g, or t
  misc_feature (371)..(371): n is a, c, g, or t
  misc_feature (373)..(373): n is a, c, g, or t
ttggacattgacataatattaatagaaaaggaaacaggaactagcactgtatctataaaatagtgagagttagaactctctgtcccctggactcagttctgaattctgtcctgctgggcaagccagagctgaacacactgactgaagttgtcttctgcccacagggagcagatgtgaactgcactcatggcacactgaagcccttgcactgtgcctgtatggtgtcagatgctgactgtgtggagttacttctggaaaaaggagccgaggtaatgtttttaacacattcacattaatgactcactaaaacttgagcttcatgttttcttagaatttctccccatcactcctccatctgtcgaccnnccncnantctgaacttctaactcaaggtaatgttggcatagccaatattaaggaaaatgtaatggtaaatatataaaatgatctaaggatttcattcttttacctttctgtccccaccctgcttgccccca

SEQ ID NO: 676063 - DNA, 640 bp, Homo sapiens
tatggggccaatttaaaatagtttaattaaagacattgcttttcccacttacaatacagtgtttataaagtgcaaggtttatttccttccccggtgtgcttatgtttccatattcaagtattgagaagtgcccaagtaacttacttatagcagcttaactttttaaaacgtgccacagaaattggctacgaattagaggtcctctcaaagtgtttctaaagtggtggtggaacaagtgctacattcttaccacgtggggtgggcttataactaaaccctcttctcaagtgggtgggcccgtggaggaagccaccaaccagagaggggaggagcctccaacccaccgagggaaactcccccagaggcaattccctccgtggcagtggcctctcctgggaactctcgtggtatcacagcttggcgtgtgaactaagtggggggtgtgcaacacttgttctctcccgagacctcattctcagtggtgtggaggttttacagcaatttcttctccctttcctacaggcgaggctcgtggaatccctttactcagagccccgagttgtgaataatttttcatttatacaacttgttgctccgagaaaactcctctcgagggtatggggcccctcattgcggttaa

SEQ ID NO: 676064 - DNA, 1365 bp, Homo sapiens
  misc_feature (3)..(3): n is a, c, g, or t
  misc_feature (6)..(7): n is a, c, g, or t
  misc_feature (11)..(11): n is a, c, g, or t
aanacnnatcngtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtactta

SEQ ID NO: 676065 - DNA, 139 bp, Homo sapiens
ctacggtgagcccaacatcgtctcaagacttttaacaattcctaaaatccttcaaggacttttggagacaagatctcactctgttgcccaagctggagcacagtagtgcaatcatagttcactgcagcctcaatttcct

SEQ ID NO: 676066 - DNA, 125 bp, Homo sapiens
ggcctccatggttgctgcgaactggtccaggtacagttcctttagaggttcctcaggtgaaagcaaagagaactgatgatggcaagggattagggatgcagttagaagtgggcccgttggggcca

SEQ ID NO: 676067 - DNA, 463 bp, Homo sapiens
cgttatgatgtatcagcacctgcctgaaaaagaccacttaacttggacgaaccctttggcagcctcagatcgtccttgaagagaatgactgaaacactatgggccatgcactgtgtgtctgctctcggggaactgtcatcattgacaataagcgctacctcttcatccagaaactgggggaggggtgagtgttcgaaaatcactttgctggtccccagggtatttgaaggacatcagtgtgcacatgatccgggcataaaggttttctctctagcctctaactcacctgacagagcccagctacgtggtggtcaagaaagtggattgtggagccaggcctcctagattcgccatgtattaccttgataagctgtggtttttttcctctgcttattagagctaattatgcttccctggtagggctgtgaggattaaattagatcatgcatatcaaacatctcac

SEQ ID NO: 676068 - DNA, 2486 bp, Homo sapiens
ggcacgagggtatttgctctgaatgctctgcataatataccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaataaataaaaccctttttattggcgtctgggaacaaactttagggaaattcccaattttcggttaacagccaattgtggtgtctcccaaagattgaagacattcctatataaccctcaaatgtggttgcaggatctcccagaaaactgtgggcactggattgacaactcccttacgtgtgcccagtgtcttccgtgggggccattttggccaagggaccgggaacctcttttccccctttcatccgaagggggacaccacaggcaaggttctatggccctcctattatctgtgtttggggttttgttcgccccacaagggggtctcaccaaggttaggcctcctggagacattaccccgaaaggagcgctcctgggtaaactacaccgcggtgccatacagataccgtctccttgagatcttacaacagggtccctgaaagagactctccctctttagaaaagtactccctgtggaagacaaaccctcttttctcgctgtggtgacaatgatggccaacgctgattttgattacaccatcagttctcgctgtggtgaagaaacactaccagagtggtggtgtgttccacattacaatggggggagagattaccacccccaagggcgccagaagtgttcgccctatatagacaccatttaaagcgggccttggttggtgtgtactacccccaagcactaggtgggtaagaagagaaacgactcattatagtggagggacctgatgcgaggcttgacccgcatttatctgcccccccaaggtgtgggagatctcattgctacaaatatccccccaggggttgtcacataggatggtttaccacaccttgtgtgagtttaatgatgtaggggaaagatttaatgatttttcttcctgtttcaccaattgaggttccgtggcgaccacccatgttggggcatgttctatattgggagcattttatatacaccaagtcaaca

SEQ ID NO: 676069 - DNA, 375 bp, Homo sapiens
gacgtgctttgaaatctactaacgttccgtcctcatctctgttccagtggtgtccaatctttaggcttccttgtgccacactggaagaggaatagtcttaggccacaaataaaatatactaatgatagccgatgagttaaaaaaaaaaaaatttgcaggctgggcgcggtggatcacacctgtaatcccagcactttgggaggccgaggtgggaggatcacaaggtcaagagatagagaccatcctggctaacacgatgaaaccccgtctctactaaaaatacaaaacattagccaggcttggtggcacaggcctgttattcgcagctactcgggaggctgagccaggagaattgcttgaacccgggaggcggag

SEQ ID NO: 676070 - DNA, 474 bp, Homo sapiens
gagcccactgacctagcagttagttatttttcataggcgcatctttagtcttcctagtcatagctttagcgtgaacacatcagagtacagtgtacaacatgtgttgttctgtgtgcttactgttaccactgagttttatccttttagatgatgtcttattgctcctcagcatccttatttttcagattgaagaaccctctttaacatttcctgtaggacaggtctgatgttgatgaaattcctcagcttttgtttgtctgggaaagtctgtctccttcatgtctgaaggatttttcactggatacactagggtaaaagtttactttccttcagcactttaaatatgccaagccactgtctcctgcccagtgagttctcctctgagaagtcgttgccaggcgtactggagctgcgttgtacgtgatttgttgttttttctcttgctgcttttagaaccctttcttcatctttgat

SEQ ID NO: 676071 - DNA, 2739 bp, Homo sapiens
  misc_feature (3)..(3): n is a, c, g, or t
  misc_feature (6)..(7): n is a, c, g, or t
  misc_feature (11)..(11): n is a, c, g, or t
aanacnnatcngtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtgaatgctctctggaattgggggtttaataaaaacccggaaaacaaggcccctcctctgctaacctatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaataaataaaaccctttttattggcgtctgggaacaaactttagggaaattcccaattttcggttaacagccaattgtggtgtctcccaaagattgaagacattcctatataaccctcaaatgtggttgcaggatctcccagaaaactgtgggcactggattgacaactcccttacgtgtgcccagtgtcttccgtgggggccattttggccaagggaccgggaacctcttttccccctttcatccgaagggggacaccacaggcaaggttctatggccctcctattatctgtgtttggggttttgttcgccccacaagggggtctcaccaaggttaggcctcctggagacattaccccgaaaggagcgctcctgggtaaactacaccgcggtgccatacagataccgtctccttgagatcttacaacagggtccctgaaagagactctccctctttagaaaagtactccctgtggaagacaaaccctcttttctcgctgtggtgacaatgatggccaacgctgattttgattacaccatcagttctcgctgtggtgaagaaacactaccagagtggtggtgtgttccacattacaatggggggagagattaccacccccaagggcgccagaagtgttcgccctatatagacaccatttaaagcgggccttggttggtgtgtactacccccaagcactaggtgggtaagaagagaaacgactcattatagtggagggacctgatgcgaggcttgacccgcatttatctgcccccccaaggtgtgggagatctcattgctacaaatatccccccaggggttgtcacataggatggtttaccacaccttgtgtgagtttaatgatgtaggggaaagatttaatgatttttcttcctgtttcaccaattgaggttccgtggcgaccacccatgttggggcatgttctatattgggagcattttatatacaccaagtcaaca

SEQ ID NO: 676072 - DNA, 247 bp, Homo sapiens
aggaatgtgataggtagtgtagtggctgacactagtatgagggtgtactgtcactataggacgtttcccttgcagtggctggtagcagtggatgcaatgatgtcatggctgatgctacgtttaacagtagtggtcatagagtaacgtactggtgaaggtggtcactggcttctgtgtcacgggagtcgaggtgtaagagctgctgaaggccacctgcgtcgtggtcacacagtaaggggtacggctg

SEQ ID NO: 676073 - DNA, 811 bp, Homo sapiens
acgtgacccctcaaaatcatggcaaggcaacgccacttatctcaggtgaaccaatcgtatctcagaatgataaactcatagacgtctctgtactatagtctcacctgactaagagtctccttaacttataacattcgcagggcagcggaacctgaatcgatattgaatatcttctgtcgggaagcactgtgtatccccaccgttgtctatcatcagccgatgaggcgagccaggactaagtaaacgcttgagacgcggcatgatacttcctattctacaccctagtaggctcccttcccctactcatcgcactaatttacactcacaaaccctaggctcactaaacattctactactcactctcactgcccaagaactatcaaactcctgagccaacaacttaatatgactagcttacacaatagctttatagtaaagatacctctttacaggactccacttatgactccctaaagcccatgtcgaagcccccatcgctgggtcaaatagtacttgccgcaagtactcttgaaaactaggcggctatggtataatacgcctcacactcatttctcaacccccttgacaaaaaaaatagctaccccttccttgtatatcccctatgagggcataattctcacaagctccaatctgcctacgacaaaaagacctaaaaatcgctcaatgcatacctcttcaatcagcacatagcctcgtagtaaagacattttattcaaaacccctgaagttcacggggcaagcatctcataatcgccacggcttaatcccataatatttgctagaaatacag

SEQ ID NO: 676074 - DNA, 2674 bp, Homo sapiens
  misc_feature (3)..(3): n is a, c, g, or t
  misc_feature (6)..(7): n is a, c, g, or t
  misc_feature (11)..(11): n is a, c, g, or t
aanacnnatcngtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggggagcagatgtgaactgcactcatggcacactgaagcccttgcactgtgcctgtatggtgtcagatgctgactgtgtggagttacttctggaaaaaggagccgaggtatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaataaataaaaccctttttattggcgtctgggaacaaactttagggaaattcccaattttcggttaacagccaattgtggtgtctcccaaagattgaagacattcctatataaccctcaaatgtggttgcaggatctcccagaaaactgtgggcactggattgacaactcccttacgtgtgcccagtgtcttccgtgggggccattttggccaagggaccgggaacctcttttccccctttcatccgaagggggacaccacaggcaaggttctatggccctcctattatctgtgtttggggttttgttcgccccacaagggggtctcaccaaggttaggcctcctggagacattaccccgaaaggagcgctcctgggtaaactacaccgcggtgccatacagataccgtctccttgagatcttacaacagggtccctgaaagagactctccctctttagaaaagtactccctgtggaagacaaaccctcttttctcgctgtggtgacaatgatggccaacgctgattttgattacaccatcagttctcgctgtggtgaagaaacactaccagagtggtggtgtgttccacattacaatggggggagagattaccacccccaagggcgccagaagtgttcgccctatatagacaccatttaaagcgggccttggttggtgtgtactacccccaagcactaggtgggtaagaagagaaacgactcattatagtggagggacctgatgcgaggcttgacccgcatttatctgcccccccaaggtgtgggagatctcattgctacaaatatccccccaggggttgtcacataggatggtttaccacaccttgtgtgagtttaatgatgtaggggaaagatttaatgatttttcttcctgtttcaccaattgaggttccgtggcgaccacccatgttggggcatgttctatattgggagcattttatatacaccaagtcaaca

SEQ ID NO: 676075 - DNA, 858 bp, Homo sapiens
  misc_feature (42)..(42): n is a, c, g, or t
  misc_feature (68)..(69): n is a, c, g, or t
  misc_feature (102)..(102): n is a, c, g, or t
  misc_feature (105)..(105): n is a, c, g, or t
  misc_feature (175)..(175): n is a, c, g, or t
  misc_feature (192)..(193): n is a, c, g, or t
  misc_feature (206)..(206): n is a, c, g, or t
  misc_feature (455)..(455): n is a, c, g, or t
  misc_feature (490)..(490): n is a, c, g, or t
  misc_feature (581)..(581): n is a, c, g, or t
  misc_feature (607)..(607): n is a, c, g, or t
  misc_feature (832)..(832): n is a, c, g, or t
  misc_feature (834)..(834): n is a, c, g, or t
ttcccagcgcccgcggcgcccgaggactgcgcgctgcggccnttcccgcgcgccccacgcgcccacgnntttcgcgggacccggcgttgctacgggctcccntgnggagcgctcagaccgcccccccgcgcgccgctcgctggcctgtactacgcaccctgggcacgcccggccngtaccccggcccgtgtnnccgccgcccgagnccccgccgctggagagcgccgagccgctggggcccgccgccgatctgtgggccgacgtgacctcaccgagttcgaccagtacctcatactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggctagngccgccggcgccgccccgggtccctgcagcgcttncctcccgcagcccccgcgaccgatccgaccgcgacgctgccgctctgctctctaacatacgcgtgtatgtttggttccatgtcacagcccncctaggagccagtgatgctcggcctngcgcccgttccacctcccaggccacccttcctgggcttctgggccacctgccctcggggggcccctgcgagggtgcctggagttcccacgtgtcccggggcttttccaggaagcccgagcccaggacctgttggcagagttgccagggtaacatttttgaagcacctgctccttttcttgcagtgtattttctacaaccagattgtattaatattttttactttncnttttaaaaaaatatacctaatacg

SEQ ID NO: 676076 - DNA, 2812 bp, Homo sapiens
  misc_feature (3)..(3): n is a, c, g, or t
  misc_feature (6)..(7): n is a, c, g, or t
  misc_feature (11)..(11): n is a, c, g, or t
aanacnnatcngtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggagcatggtggccatagaaagtggattgctggtccagctttcctgcctgatgataaggtttccagtgctttgatacataagattgtcttcagtgatgtccgggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaataaataaaaccctttttattggcgtctgggaacaaactttagggaaattcccaattttcggttaacagccaattgtggtgtctcccaaagattgaagacattcctatataaccctcaaatgtggttgcaggatctcccagaaaactgtgggcactggattgacaactcccttacgtgtgcccagtgtcttccgtgggggccattttggccaagggaccgggaacctcttttccccctttcatccgaagggggacaccacaggcaaggttctatggccctcctattatctgtgtttggggttttgttcgccccacaagggggtctcaccaaggttaggcctcctggagacattaccccgaaaggagcgctcctgggtaaactacaccgcggtgccatacagataccgtctccttgagatcttacaacagggtccctgaaagagactctccctctttagaaaagtactccctgtggaagacaaaccctcttttctcgctgtggtgacaatgatggccaacgctgattttgattacaccatcagttctcgctgtggtgaagaaacactaccagagtggtggtgtgttccacattacaatggggggagagattaccacccccaagggcgccagaagtgttcgccctatatagacaccatttaaagcgggccttggttggtgtgtactacccccaagcactaggtgggtaagaagagaaacgactcattatagtggagggacctgatgcgaggcttgacccgcatttatctgcccccccaaggtgtgggagatctcattgctacaaatatccccccaggggttgtcacataggatggtttaccacaccttgtgtgagtttaatgatgtaggggaaagatttaatgatttttcttcctgtttcaccaattgaggttccgtggcgaccacccatgttggggcatgttctatattgggagcattttatatacaccaagtcaaca

SEQ ID NO: 676077 - DNA, 2578 bp, Homo sapiens
ttggacattgacataatattaatagaaaaggaaacaggaactagcactgtatctataaaatagtgagagttagaactctctgtcccctggactcagttctgaattctgtcctgctgggcaagccagagctgaacacactgactgaagttgtcttctgcccacagggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaataaataaaaccctttttattggcgtctgggaacaaactttagggaaattcccaattttcggttaacagccaattgtggtgtctcccaaagattgaagacattcctatataaccctcaaatgtggttgcaggatctcccagaaaactgtgggcactggattgacaactcccttacgtgtgcccagtgtcttccgtgggggccattttggccaagggaccgggaacctcttttccccctttcatccgaagggggacaccacaggcaaggttctatggccctcctattatctgtgtttggggttttgttcgccccacaagggggtctcaccaaggttaggcctcctggagacattaccccgaaaggagcgctcctgggtaaactacaccgcggtgccatacagataccgtctccttgagatcttacaacagggtccctgaaagagactctccctctttagaaaagtactccctgtggaagacaaaccctcttttctcgctgtggtgacaatgatggccaacgctgattttgattacaccatcagttctcgctgtggtgaagaaacactaccagagtggtggtgtgttccacattacaatggggggagagattaccacccccaagggcgccagaagtgttcgccctatatagacaccatttaaagcgggccttggttggtgtgtactacccccaagcactaggtgggtaagaagagaaacgactcattatagtggagggacctgatgcgaggcttgacccgcatttatctgcccccccaaggtgtgggagatctcattgctacaaatatccccccaggggttgtcacataggatggtttaccacaccttgtgtgagtttaatgatgtaggggaaagatttaatgatttttcttcctgtttcaccaattgaggttccgtggcgaccacccatgttggggcatgttctatattgggagcattttatatacaccaagtcaaca

SEQ ID NO: 676078 - DNA, 2948 bp, Homo sapiens
  misc_feature (3)..(3): n is a, c, g, or t
  misc_feature (6)..(7): n is a, c, g, or t
  misc_feature (11)..(11): n is a, c, g, or t
aanacnnatcngtgcgcaggcgcccatcttagttggtcttctagtccggtaaacagagggcctgcccccgacagcttctgcttccgggtcacgccttgacagcggctttcaacccccacctcagcccagcaattcgtaccggacctaccgggattgctgcgatctgtttagagcccgtgcagaaagtgacaccgcacgtccttgcgtttcgtgcccttgccccccgccccctagcctcagcgagacagctgccgcgggccctcccgcagcaggcagtttggagcatgtgaacaccttgagccttgatgagttccagtatgtggtatattatgcagagcattcagagcaaatactctctctccgagcgcttaatccgaacaattgctgccatccgttccttcccacatgataatgtagaggacctcatcagagggagcatggtggccatagaaagtggattgctggtccagctttcctgcctgatgataaggtttccagtgctttgatacataagattgtcttcagtgatgtccgggagcagatgtgaactgcactcatggcacactgaagcccttgcactgtgcctgtatggtgtcagatgctgactgtgtggagttacttctggaaaaaggagccgaggtgaatgccctggatgggtataaccgaacagccctccactatgcagcagagaaagatgaggcttgtgtggaggtcctattggagtatggtgcaaaccccaatgctttggatggcaacagagataccccacttcactgggcagcctttaagaacaatgctgagtgtgtgcgggctctcctagagagcggggcctctgtcaatgccctggattacaacaatgatacaccgctcagctgggctgccatgaagggaaatcttgagagtgtcagcatccttctggattatggcgcagaggtcagagtcatcaacctaataggccagacacccatctcccgcctggtggctctgctagtcaggggacttggaacagagaaagaggactcttgctttgagctcctccacagagctgttggacactttgaattgaggaaaaatggcaccatgccacgagaggtggccagagacccgcagctatgtgaaaaactgactgttctgtgctcagctccaggaactctaaaaacactcgctcgctatgccgtgcgccgtagcctgggactccagtatctccccgatgcagtgaagggccttccactgccagcttctttgaaggaatacctgttacttttagaatagccggagaagatgtttgcaccatcgtgcaggcagctctgggtgaggttgtccctgcagtactccttgtcacagaaaacagaaaaacagttgttcctgttgtgtggtttatagatttcgaagcaacatgtcacaacaataacctccatagcacctccccttcccaaaccaaacaacccaacaaaaaaaatccctcacttttgttttctgtttattgcttacctggctttttatattgcattttgcaaaagaagaggtctccctcaatcctcccctttagggaaggagtcaacagtgtaactaaatttctctaggaagatggaaagtacttaaataatgtgtgtgtggttttcctttggggacgtggttaacggtccagaagaatcccttctagaaagcattttaggccagccatggtggctcacgtctgtaatcccaggactttgggaggctgaggcaggtggatcacctgaggtcaggagttcgagcccagcctgaccaatatgatgaaaccccgtctctactaaaaatacaaaaattagctgggcatggtggcatgcgcctgtaatcccagctactcaggaggctgagacagaagaatcgcttgaacctgtgaggcagaggttgcagtgagccaagatcgcgccattgcactccagcctggacaacaagagcaaaactgtctcaaaaaaaaaaaaaaaaataaataaaaccctttttattggcgtctgggaacaaactttagggaaattcccaattttcggttaacagccaattgtggtgtctcccaaagattgaagacattcctatataaccctcaaatgtggttgcaggatctcccagaaaactgtgggcactggattgacaactcccttacgtgtgcccagtgtcttccgtgggggccattttggccaagggaccgggaacctcttttccccctttcatccgaagggggacaccacaggcaaggttctatggccctcctattatctgtgtttggggttttgttcgccccacaagggggtctcaccaaggttaggcctcctggagacattaccccgaaaggagcgctcctgggtaaactacaccgcggtgccatacagataccgtctccttgagatcttacaacagggtccctgaaagagactctccctctttagaaaagtactccctgtggaagacaaaccctcttttctcgctgtggtgacaatgatggccaacgctgattttgattacaccatcagttctcgctgtggtgaagaaacactaccagagtggtggtgtgttccacattacaatggggggagagattaccacccccaagggcgccagaagtgttcgccctatatagacaccatttaaagcgggccttggttggtgtgtactacccccaagcactaggtgggtaagaagagaaacgactcattatagtggagggacctgatgcgaggcttgacccgcatttatctgcccccccaaggtgtgggagatctcattgctacaaatatccccccaggggttgtcacataggatggtttaccacaccttgtgtgagtttaatgatgtaggggaaagatttaatgatttttcttcctgtttcaccaattgaggttccgtggcgaccacccatgttggggcatgttctatattgggagcattttatatacaccaagtcaaca

SEQ ID NO: 676079 - DNA, 376 bp, Homo sapiens
agagcatcccttccagcgccatccttccatgggttaaccagtagaatcattaccatgtcctggttttccaaggattttcccaatggagtagtgaccattcaacatcccaggaaaccctttagtcctaggcataccagacatttggtcaccccaataaccagaaccttgacttcccacagaacagactcaggggcacctctttctgaagtttgtatgggtggaagcacatggggatgtacattgatgacatgcttctgtccagctgctttggctccatgcccagttggtgtaggtcatctatgtgttgcgcatagttgcagaccatacattctcatcatgtaggcttctgctgagtggatatacccggggagggggg

SEQ ID NO: 676080 - DNA, 463 bp, Homo sapiens
ccttccatggaaagacctggagagattggctcactcctgaggacacgcttttctttctagctggagtgaagactgggacatgcgtggctacataaagatggccaaagaccagaataacaactgcagaatcgccatgctggccagccttcctattgtgtgagctgatggatggtgaagaggaaggacttgactggggatggcacatacatgggaggaattcatctgaaatctaccagcccctgccatgtgggatgcacactggaatcactgaagattcaagtgtgatttgaattctgtgacgctttcataatggtaaatgttaccactattttgattactgctataaccagctttgcattattgattcactgaatgactttagattttttttttgctttaaaaggatggaaaaaattttacctgtttaaataaaacttaatttcacttggagtggaggggcttc

SEQ ID NO: 676081 - DNA, 828 bp, Homo sapiens
  misc_feature (61)..(61): n is a, c, g, or t
tgctacttgccgataatatacaacagaaagccggccgcagttttatggaacagagatgggnctagcgtggctacataaagatggccaaagaccagaataacaactgcagaatcgccatgctggccagccttcctattgtgtgagctgatggatggtgaagaggaaggacttgactggggatggcacatacatgggaggaattcatctgaaatctaccagcccctgccatgtgggatgcacactggaatcactgaagattcaagtgtgatttgaattctgtgacgctttcataatggtaaatgttaccactattttgattactgctataaccagctttgcattattgattcactgaatgactttagattttttttttgctttaaaaggatggaaaaaattttacctgtttaaataaaacttaatttcacttggagtggaggggcttctcacccgcagccctcgctaccccctttactactgcgtatcaaaccaccacccccccctccgttcacatccaacgattattggccgtatacccgcccgccgcgtgctatacgcgtgtcctctattctaccgccgcctcgcatcgtaccatgacgctccgccctcttccttccgcgtcctctcgacccgcgacgccacccgcacttaaccgcccgcccgcgatacccccaccccccctggaaccctctccctcacccactctctcctcaccttattagctccgccccccgttacacacctttgtcggcgcacttcacccctaccccctaaccgtacccgatcgcccaagcaccccgcccccgttccttatccccagatatatat

SEQ ID NO: 676082 - DNA, 599 bp, Homo sapiens
ctcacgagcgcagaggagtgccttatccccgacacttgactgggctgtggtagggtgggcatgtgggcccctggtgcccgggctggggacagagcccttgtttcgtgacttaggattttgatgtcggttcccactggttctctatacgagggccaagctgagacaggctagcaggccaggaggccacacggtgtagagctaataacgagatctgcgcacattgcagagagtcataatatctacggcctgtcgctactagcgggtcggcatttaacataggaatctctattttcgaaataagggatggtctatgaggcatactaggtacgactttgatgtgatcctttgctccctcccttccatcaagtggatcgtggtctgtgtgactgaacccacacagagtgtcatgggtgacagtccctggttgaagtagctccacgcctggcttctgtggacagtcagattcttgtccttctcacaaggggctcatttagcatttggaggctgggtgctgtggctcacgcctgcaatccctagcactttgggagactgaggcgggcggcatcatgaggtcggagatcgcgacctcctggctaacg

SEQ ID NO: 676083 - DNA, 451 bp, Homo sapiens
  misc_feature (53)..(53): n is a, c, g, or t
  misc_feature (60)..(60): n is a, c, g, or t
ccccgatgctaggacatatctgacgggacgacacaacaaccgccctacttggnatcgaanctgggtcttgcgtggctacataaagatggccaaagaccagaataacaactgcagaatcgccatgctggccagccttcctattgtgtgagctgatggatggtgaagaggaaggacttgactggggatggcacatacatgggaggaattcatctgaaatctaccagcccctgccatgtgggatgcacactggaatcactgaagattcaagtgtgatttgaattctgtgacgctttcataatggtaaatgttaccactattttgattactgctataaccagctttgcattattgattcactgaatgactttagattttttttttgctttaaaaggatggaaaaaattttacctgtttaaataaaacttaatttcacttggagtggaggggcttc

SEQ ID NO: 676084 - DNA, 947 bp, Homo sapiens
agagagccgcggggtctgcccgtggttactatgaatgtatgctgttggaggacatctcgatccaaagaacagccgttcctgtgcggcccttcgtgccctcctgctttcattttttaaagaaatcttgagtgcttgagggccttggaactgattttttttttttggttccagccaaattagcagggtataaatggcacctaggtaagagcagagctgcggctcggtgacttgatactgggggcagcccgatgctgtgtgtggggcaggggaggcatccttacgggagaggcaggcccagccatggggcacctctgggaaggggaggggaccatgaggcagccagcccctggccaggggcgactgtgcccaccgcaggcagcgctccaagtgcgggaatggccaggatggcgccctctgtgggagtctaagggttagctttaacgtttcttctccacccaggggccacaggtgataaaagtaggatcctagggcggagcttaaaaattatgccagaaagccaaaggtttcccctcgttggggcctgccttaacatttgccttggttgggtacatctttggccggatgaatcaagaaggcaatctgtgacaaagtctgagggtctcctttatgtttgcccctcacacactaagagaagtgggagtctccctctgggaatggttggcatcactgcatcctggaacggatgggttaaattcactcgtgtccgcatcggaatcggatctaccagtgtgtggaacccaggggctaccggacacgctacaagaagagacgaggggtgggagcgggcacggaacgtggccgcgggacaagagcaggcaaggaatcggccggcacagtccagaagcaaacagactagcaggaagtggaaagagcatacagaacagcggcaagcacaaccaacaacaggcgctgttgtagccgtcacg

SEQ ID NO: 676085 - DNA, 375 bp, Homo sapiens
tatcccaggtgtatataatgacatctgtctcgtcaggttaacccttctatcgcaggccttgttatcaatggtactgattggcctccctctatcacaggccttgttaccaatggtaatgaataacctccctctatctcaggccttgttaccaatggtactgaatgacctccctctatcccaggccttgttatcaatggtactgattggcctccctctatcccaggccttgtcaccaatggtactggataacctcccactatcccaggccttgttaccaagactactgatggacctccttataatatctatttcaggattgtttactgtctccagtttgtttaataaaatgttaaactttaacttttgggtcgacgc

SEQ ID NO: 676086 - DNA, 765 bp, Homo sapiens
gaagcttgctaaagtgtccgtgggaacgctcggtccccagtcaggatatgtggatcattgtcccttggctgttgccatagaaggatcctggtcatcgagtagatgctaagatattgatcactcatgttaacccaaactacgccgtggcggaaccggcgcgatagcatgaacaaagttccacgcatagtgctgctcgaggatcatgacctcgtgtcgtatcactcaggagtcagatgcgagagctcgaatttccatgattgattgcgcacgagccactggaaaagactatctttctcatggcaggacagaattcattcagaacatcagcgaacaaattgaaaccattaagaaagaaaaggcaagacggacggcacagcatcaacacagtgcgatgatccctgagggggcacccccgatgtccagtacggaacctttggcaagaagattacttgatgaacaattcgtgccaatcgttgtctaccattctgtggcgctcagaacaatacgtcaggcattcttctcatttgtagacaaggatctgctgggaaacctgcttgctccggtcctgcttcaaccacaagggtgcattgccgtgataaggggtgctgatggtatgaccacggatcccctggtcacaggtgatgaacggtagaaaaggcccccaggaagacctatgcaggatattgggggggttggacaacaaaattcaggaattcaggaatctgtggagccttctctcacaccatctgaatatttgacgagatg

SEQ ID NO: 676087 - DNA, 809 bp, Homo sapiens
  misc_feature (809)..(809): n is a, c, g, or t
ctcggtggctcacgcctgtaatcccagcactttgggagactgatgcaagcagatcacttgaggtcagaagtttgagaccagcctggccaacatggtgaaacccccatctctactaaaaatacaaaaattagccagactggtggcacgcgcctgtaatcccagctattcaggaggctgaggcaggagaatcgcttgaacccagtaggcagaggttgcagtgagccaagattgtgccactgcactccagcctgggtgacagagcgacacgctgctcaaaaaaaaaaggctggggtggtgactcacatgcttaatcccagcacttggggaggatgaggcgggaggatcaccaggtcaggattgacagaccagcctgatcaaccatcgtgaaaccccatctctactaaaaatacaaaaattagcaggcatggtggccgcacaccttgtaatcccagctattaggaggctgaggcaggagaatgcttgaacccaggaggcagaggtgcagtaagccgagttgcaagcaccactgcacctccagccctgggaacagacgcaaggacctgtcctccaaaaacaacaacacacgacccaaaaacaacccgtgctcgggcgcctcgacctgaaaaagctttacgacaccaccggtggcgcggggggcccagaggtaagcacaccgggtcacggcgccccagaagacaccggccccacacacgcgcggctctccccaaaaaaaccccggggcccggcggtcgtacaactccagtgggtgggggccacggcccaacggtccggagacccacggcgggggn

SEQ ID NO: 676088 - DNA, 408 bp, Homo sapiens
aagaggcagagctcttgcacgtacagctgatgggagaagggtaagctctgagcctagaagggtgcatgtggaatacaccccctcatacaacatacctgtctaagcataaaaaatagtgaggagtcacaaaatatgtctaaattatgaaatgactgccttacatgaagcataggaaactgtgacgttcttataaagcagcacatttaagctattcttatttttaaattagaaaattatatccatgcattaccttttataagaaatgtggatagtaattccgtgttctacaaccacatccaggaagagcttgcatataggaatgaaactgtcatcttgccagtcctgtgctatgttatttcacttaatcctctcagaaacctataagacaggtgcacagcaggaaaccag

SEQ ID NO: 676089 - DNA, 870 bp, Homo sapiens
  misc_feature (59)..(59): n is a, c, g, or t
  misc_feature (65)..(65): n is a, c, g, or t
  misc_feature (74)..(74): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (86)..(86): n is a, c, g, or t
  misc_feature (88)..(88): n is a, c, g, or t
  misc_feature (94)..(94): n is a, c, g, or t
  misc_feature (121)..(121): n is a, c, g, or t
  misc_feature (180)..(180): n is a, c, g, or t
  misc_feature (182)..(182): n is a, c, g, or t
  misc_feature (186)..(186): n is a, c, g, or t
  misc_feature (201)..(201): n is a, c, g, or t
  misc_feature (203)..(203): n is a, c, g, or t
  misc_feature (208)..(208): n is a, c, g, or t
  misc_feature (213)..(213): n is a, c, g, or t
  misc_feature (220)..(220): n is a, c, g, or t
  misc_feature (230)..(230): n is a, c, g, or t
  misc_feature (236)..(237): n is a, c, g, or t
  misc_feature (266)..(266): n is a, c, g, or t
  misc_feature (274)..(274): n is a, c, g, or t
  misc_feature (345)..(345): n is a, c, g, or t
  misc_feature (416)..(416): n is a, c, g, or t
  misc_feature (419)..(419): n is a, c, g, or t
  misc_feature (621)..(621): n is a, c, g, or t
  misc_feature (624)..(624): n is a, c, g, or t
  misc_feature (656)..(657): n is a, c, g, or t
  misc_feature (664)..(664): n is a, c, g, or t
  misc_feature (669)..(669): n is a, c, g, or t
  misc_feature (681)..(681): n is a, c, g, or t
  misc_feature (688)..(688): n is a, c, g, or t
  misc_feature (694)..(694): n is a, c, g, or t
  misc_feature (702)..(702): n is a, c, g, or t
  misc_feature (728)..(728): n is a, c, g, or t
  misc_feature (773)..(773): n is a, c, g, or t
  misc_feature (776)..(776): n is a, c, g, or t
  misc_feature (786)..(786): n is a, c, g, or t
  misc_feature (798)..(799): n is a, c, g, or t
taccaaataggcatcatggcgcagatctggctgctagtgttttttttacagttggtttnttaacntcttttttnttcntanttntntntcaatnttctctggatgatcaagaaactctttntgcctcaccctaatcactgaagtaatgaaaggagatacccgcagcaaggactgcaactntnaatnctgcaatcacacctntnttttnctganttttcantaacattgtngttttnnttggttgttttggttgttcatcatctgtnttgtccantgaagcttgactattcatagaagaactcatacaagctgtgtttgtttcctctgcaatttccaaatcttctntttgaattgtgtgatccaacatctccataaaatggtccctgatttcttcagctgactcatcgtcaaatttntantcacacaacattacagtggatccaggaaggggaacaaagactcgataagggaggacgtggaactctttttcagaatctttttttttctggaatttcattcaaaagcagatcctcaaatagcatttcacaacgatcagcaactgtgttcaatatatccctctttactgcctgcacagcatctttaactttgggtttactgctntgnatataagctctgcatttcacagcacccttaanntttacanaaccnctacatatcttnacttttncttttnatcttttntcttaattcattatcaacttctttanactcttacatcaaaataattactattttctttattatttccctanaanattttttctntccttctaatanntcacaatcttcatctttaacttttccattaatcaaataaacaccattttctatttccttttcccatctttt

SEQ ID NO: 676090 - DNA, 170 bp, Homo sapiens
gcactgtagatcgctcttcaccgtgatagaagaaattcaaagtgggcttatcttcagtaaacgggtttagaaatcctttgggcaaataacgaattctcaattcatatttccactcctcggggggtgtgagcaatgctctatacttctccctcgacacgtggagacgccca

SEQ ID NO: 676091 - DNA, 217 bp, Homo sapiens
gctgccgcctactactactaagttcgcggccgctcgaccagactttatgaatacacaagtgcttgcagagctcatactactgcccagtcttttttcttctttcttccttcctttcttcatctcttcctctctctctttgttaattagttaaatcctatctgcacaataacacatttccccagagcaagacgaagagatgaagaaaggaaggtcgacg

SEQ ID NO: 676092 - DNA, 936 bp, Homo sapiens
aaaataagcgtaggagtaggcctcgggttattcggacgaggggtaccgggagcggataagcggacccagagagcctgagcagcccactgtcgcccgcggactagttacacatcacaccccgggaggagcctgcagctgccgcagccggccccagtcaccatcaactgcaaccatgagcatgcgaggcctgagaaccagcagccgacatgaactgcaagacacagagagagagaagagagagacaaagaagcagtggagagaacacacaaccacagggaccacaagagacacgacaggaagacaaaagtagcagcaacaagcagaagacaacaaggcacacaaaaaagaacaggcaagagagaacaaaagaaacagaaaacaaagacacacaacgaagccgccgaataaccaccacaccaaacgcaacgcagaaaacggccgaccaacgcacagaccaccgaccgacgagacgagatccgacaagcgcgacacagcaacgcaccccacccccacacagcacagagccccacacaaagcacccgccaaccagtagcgaccctccaccagcacaccgcaaccgagccacacacggaacggcagccgcaaacaccaccgggcaccacgacgaccgcacagcggcaaacggcacagacagcgagacagaccgcccacggcacgaggaacggacgaagaaaaccgcggagacaaacgccgacacgaagcgacagcacaacgcagcagcgcatggcaaccgcgacgaacaccgcgcgggaaggcagagccaaggagagcgaagacgacagaggacggagagcgcgcgaacacacacacaaccgacccgaccaccgaacagcagcacgacgagcacgaagacacgagagcacccgcccgcaccgaacacagagcacacgcaggaacaccgaaacgaacgacaca

SEQ ID NO: 676093 - DNA, 240 bp, Homo sapiens
gtggttgcaatgctctgggaaatgagtactgacgcatcacagagtgagtcaggagtaaataaatatcctgaacaaactaataatgattagttaaattccaacagttatataaaatctctcaacagaaaagcctaggaccagatggattcatagctgagttttaccagatgtcaaagaggagctggtacaaatatttctgaaagtattccaaaccttgaggagaaaggctcctccttaatg

SEQ ID NO: 676094 - DNA, 2159 bp, Homo sapiens
ctggacctgtccatgcccctggaccagtactcccccagctttcccgacatcgcggatcactacgtaagctccgtcagggcgaggattccgtcttctctcatgagaccggctgaccgaggagccctgcctgtcccgaacacccagttccatgcttgccaatgtgcggactctaaagcgccgtgtgacgtgtacagcttcagaacgcccgcatccccaggactccagcacgtacaggcatgtagacgcgcgtcgacccagcgagtccacgtgactgaggcgccacgcgacctgttcgcgttaacccgtgctaccaccattatcactgtctggacaggcagaccggacatgactatccacggggaccattccttgtgctgggccgtgctctgtcaaccacacaacatcaggcatcagccgtctcgcgcgtccacactactctactccagccgtgactggatgaggatggctgacagaatggaggcaggaatcgtttggctagtcccatgcccgatcgttctattcgcacctacgcgcaggacttgtttcggaacgcgaacaagcgccctaccccttgtccacctcgaggcgaacttgaccctggagcgtgcctggggcacggtggggggacgccaaaatgagaacagggtcatgcctaaagttgcaagaagcctatcgcttggaggctgttctcctgttcgggttgggtctggttttgagccctttcaacctcgataggggccctcgtcgcatgtctgtgttggccaggtgactttggtgctcaaggggttacaggcaaagtacgtggaagggttcaggtgcatttcggtgcctcgaggtggaggtggtgaccttctgccccattattaggagtcgatgcccaagtggggatagataatgtcccgagacacagaggtttgcatcacgttggtgagcaaatagcctgtggaccagaagggattggtgcgggaaagccaagattggtggacctcgctgttggtaccagggggaccagaccccaaaaatggggatcctggcatatgtgcttaggcacagcccatgtgtcacaagcagaaaaattcacagcctgtgaaagggctgtcacaaacaccgctagagcactgggacacagtattatcacaaacacgcgctgtcgccatgctattctctctgctgcgctcgcatatgtcgtgtcctgctcgtacgatatacagaaagaaggatacgcaacccacgatcacacagatgctgagcacaacgacaaaaaacacgcacgactgacacaacacacagaggaacaccgaaacagagcaaggagagacggaacgacaagagagaagacaccagaaggcagagacgagagagagagcaagagaagagacgcgtgcaagacgaagagacaatcgagagaacgcagaggaaacgatcgcaaagcaaaaggagagaggacgaggacggcagagagaggaggacaacgagaaacggacacggaagaaggagaggagagcagcctgaggaacagacggccgcggccgagcggagagaaagaggaagggaaggggagagagcgaagcagctggcgaggcgagagagcagagcgagagaggaaaagagagccagagcagaacgaggaccgcgcacggagagagggggcagaaatcgaagaccaagacgtgaagcgcgccaagacgacgagggacgagagagagcagagagacgagggaggaggacagagagaaggagagagtcagaggagaaacggagaacagatagacggcaagcagacacggcaagggaaacgctgggacggcaggcagaaggaaagcacgagaaagagaacagagcagaaagaggagaagacccggcaggagcgaagcgcaggacgtaggagaacgagagcagaacagaagaagaatgcacgacgagagaagacgaggaagaaagacacgagacacagaggagccaccaacgacgacagcaagagcagaacagacacacgagacaagacgagaacacggagacagcagaagagagaagggagcgaaggcagcggaagcgagcagagaacgaaccacacgagggacagcaagacggaagaacgagacacaaaacacaacacacagaagaaagagcacccagcaacagagcgaacgacaaacaac

SEQ ID NO: 676095 - DNA, 935 bp, Homo sapiens
gcccggtgcggggtccagagggtctcgtcgtgtgagttgcgcgtgtgttgaatgtgtttattgagatcgggcgattgtttccggttggggttcttagtaacgctcccccgtcgttgtctgtcgggggttctccgcccccgtaggccccctaaggcctcatgccagttggcaagatctcctgtgcctccttgctcccccgtagctgggtcgagccgcttgtgcccttctccaaggaccggcgtctctgtcctggcccccctcagggcgcccctgtgttcttgctggtgaagaacccctctccagccgcgcttggatttgcccggcccccgggctgtgataacagccagcgtgggggctcgttggtcccccccaccgtggaagccccccagttgctggctgactgatcgtgtaagatacatgtggctcccgccagagggggcgccaccccccagggggtaatctccacattcttctggacacactgtgcaagaaatttccttttttataagaacaagacggtttctggacacctcatttggtcctaaaaccttcggcgctcactgatgactagctctttcgcttaagccactcgatgacaattgtggggctgcccctttctataaaagcatgaggtggtggctctctccccatccactgattcgacgaaaaatagtgcacgcatgctgttgtcggccccaagaagttcgtgcggtgcgccgcaaaaaaccaccacgtttcttgttttataaagagggcgtccacccccccattgtccgatgggtgtaatagcaatccagaggtagactggctactgcaacaagacgataatgtgtagatgacccggcgggtccgaacaatgagatagttacgtgtgggggcgccacgcagaacaaacacgcgcggaacaaaaccccttatttcccccaaacaaaaca

SEQ ID NO: 676096 - DNA, 210 bp, Homo sapiens
cttttttactgggtttttaaccaaatggttgggtatggggagccccactaaaagtttagaacttccagtgtttttcggaatttttaaaaaaaactgtaaacaaaaaggctggggtttttgttttgttttgggggtttgttttgtttggttttacaattaggttactgaacccctccaaggttatgtaaaaaaaaacctttttttgtccca

SEQ ID NO: 676097 - DNA, 183 bp, Homo sapiens
aacaaggcgctcgtaaacccttccaaaggaaaggagaatgttttggggacccctcttggtttttttttttggggggggcagttttaagttattagtttttaaaaacaggcctttttaatggaaacaacttgaccaaaaatttgtcccagaattttgagaccccttaaaaaagtttaatgggga

SEQ ID NO: 676098 - DNA, 876 bp, Homo sapiens
  misc_feature (7)..(7): n is a, c, g, or t
  misc_feature (366)..(366): n is a, c, g, or t
  misc_feature (428)..(428): n is a, c, g, or t
  misc_feature (506)..(506): n is a, c, g, or t
  misc_feature (640)..(640): n is a, c, g, or t
agcggangagaagagaaatgaactgtggcatcgctcctgccttctgaacagctctactccgattaaaaaaaaaaaatctcactgtgttctttgtaaaatggtactgcatagtgatgaatttcacccattcatcgaggcacttcttccacatgtccgtgcaattgcctatacttggttcaacctgcaggctcgaaaacgcaagtactttaaaaagcatggagaagcgaatgtccaaggatgaagaaagagccagtcaaagatgagcttctcagtggaaaagcctggaaatcaaacagaaggtgggcatcccaggctccttgtccaaactggcgcaaaggatattcggccagggagtatcgagcaggnactttggtgctccaccggtggactgtgcaagaaaggcacccggtgctggtgttcttatccanatcccgaaccagaaagggtaacgattaggagacatcgactgggctgtcgacagggcagacacaagtcctggcgtctgngatctaagtcatggctgatccttgttccaaaggcatcccgcttggacaagtacccgatggagagcgggtcatgagaatccccgacattggccacaaaacccagcacttttgtggttccagccacatcatatcancagtaatcagttaagggagcttgatttgtttttgggcatactacgtgcaggagcaagattcgtggacaatcaggaagtcccaagccacaatgatcctggcaagaatcctccagggttacctttgaggatagttttgtacaatcttggagtcttcaatggttcagaacttgtaagaagtatccagaaacgcgcataacccagggaactggagtcaattcccaattgggaaaatccaa

SEQ ID NO: 676099 - DNA, 206 bp, Homo sapiens
tggtaaatgctattaaatcaaccaggaaaaagttctcgtgattatgccagctaatagtggtaatcctcactgagtgataaaaatagtttatgaattgaaaatctaccgctgcatggtgtatgatcaaatagttcatcaaaatgaatctttgctcggtggactgaattcttaccatgctgccattaaaataaatgtgccaagtggta

SEQ ID NO: 676100 - DNA, 344 bp, Homo sapiens
ggccctaagggttgacccggaggccagtggaattgcctggtgtccccgggggagggccaaggcctgttgagttgattttccaggtggggccccagcctttcccccttgcccagcacaaaggtggtccccccagggacagccaggcccctgctccttttgcccttcctgggggaagggagctgccttttgtccctgtaactgctttccttatggcccagcccggcccctcagacttgtttgaaactgccctggcagcttttttgtttcctttggggattcccaccagccaggggcttgatttttatgttttttaaacccccttaaataaaaagtttgttgcctta

SEQ ID NO: 676101 - DNA, 407 bp, Homo sapiens
cggcacgagggttggtctgacttatttttagagctctgtcctggggcagggcttggctactggcgaggctgctcccacctgtcggctacccttggagttcacaattcgctgctgtggtttcgcggctcgaagccatcgctggagtcaggcccacctgctgccagagctcgttcctggccgtttccgctggattgcagagggaggacagtgttggacctaggcgtgggttccctgggcgtgtcccttggggtcttagctctctgggaggagggttctacttattcgggagagcggtaacaacgtaatcccgtcacctctcctggcgctgagagagcgccccccaaagtaagatcagcgtcaggcccacgccctatttggtgaataaataaaagcaaactaggaattga

SEQ ID NO: 676102 - DNA, 561 bp, Homo sapiens
  misc_feature (418)..(418): n is a, c, g, or t
agattcagagagcaaatgtgcaggtttgttacatggctataatatattgtgtgatgctgagatttgggcttcaactgaacctgtcacccaaatagtgaacatagttacccaataagtagtttttcaacccttgcctccctccttccctttccctttttggagtcctcagggtctactgttcccttctttatgtctatgtgtacccaatgtttagttcccacttacaagtgagaacatgtggtatttggatttctgttccagtgattaattcacttaggataatggactccagctgcacccatgctgctgcaaaggacataatttcattctttttttatgggtgtaggtgtaccacatgttccttatccaattcactgttgctgggcacctaagttgattccacgtctgtgctattgtnaatagtgctgcaataaacatgcaagcgcaagtgtctttttggtataacaatttattttgactacatggtttgatctatagcataaaccacattcattttataaataggtattcactttaataattacatattacagtacttgt

SEQ ID NO: 676103 - DNA, 243 bp, Homo sapiens
  misc_feature (43)..(43): n is a, c, g, or t
ggtgggtgactctacaggatcttaaaaagggagcatatctggntgagaaaggggtagggacgtggagtctattttaaggctaaggagaaaggattttgagtttcctcaaggttatatcttgaaactcaagagaatgggaaaaaagtttaaaagcatgttgaagttaagctgcgggctgcattgcttctcagatacctgctactcagcttccctcctcattcactctgctccagccactctgat

SEQ ID NO: 676104 - DNA, 432 bp, Homo sapiens
aactcctacgatagccacattcttaaattcatatatcatccaaaaactttaaactcaatttgcaaacacaatctacataacactggctctagggtgtatagaatctagacccagatactaatatttcaactaaaacctagctgctccctacaaaaatgaacagtaagttttaaatatattactagagtattaaccaaatctaaacacacacaaatgagttagccaagagaacagggataactgtaggaaaaacagtatgtgtttctttttaatgtctgatggcacctataattatataaactaattcagactccacaacttcaacagctacagcaattttaagaacccccgaggcatagtatataaatcaggcgaatttcacacctcttggtggcaccgcaaaatgaaaagtattgaggtaatccgtgaggg

SEQ ID NO: 676105 - DNA, 339 bp, Homo sapiens
gcacgagattgaatgaaggctcattgttattttatgaaccattaagacaaattagaccaggcatggtggctcacacctgtaatcctagcactttgggaggccgaggcgggcagatcacgaggtcaggagttcaagaccagcctggccaacatagtgaaaccccgtctctgctaaaaatacaaaacaattagccaggcatggtggcagtcgcctgtaattccagctacttgggaggctgaggcaagaagaattgcttgaacctgggagccagaggttgcagtgagccgagatcacgccactgcactgcagcctgggtaacagtgcgagactccatctcca

SEQ ID NO: 676106 - DNA, 137 bp, Homo sapiens
ccttctactttataattcatcccaaagtgtataccaaatatccttcactgggtgcatggctcacacaaacatatacagaatactacccagcaattaaaagaataataaactatttagctgttcccagctagttcaga

SEQ ID NO: 676107 - DNA, 224 bp, Homo sapiens
aagccgcactgtcacgaatggcaacctccgccaggcccacttcaaaactgcggttgagcaggtgtaggagttctggatcgacacggcgcgcggcaaccgcgggcttcggccaggcgaggaatttcatggcgccccacggcgtttcgttggacaggccaatgtggcggatcttgccggcctttacctgttcatccagggcttcgagcgtttcctccagtacgcgg

SEQ ID NO: 676108 - DNA, 381 bp, Homo sapiens
  misc_feature (20)..(20): n is a, c, g, or t
  misc_feature (108)..(108): n is a, c, g, or t
  misc_feature (249)..(249): n is a, c, g, or t
tgttgttctttcattagagntgggctggcgacggcggtatgtaggctgtgctggcaaggggtggttgggtgaatcgtggattatcgattatagaacaggctcctctangtgggtttggggcaccgccaagtccttagagttttaagcgtttgtgctcgtagttctcaggcggatacatgtgtgatgggaggtatctagatttagggctaggcatagtggggtatctaatcccagtttgggtcctagctntcgtgggttaaaattaatcgttgaggctaagatggatttgggttgggtttaggtggatcttaggcttatgacagcttggttgcattttaatcttagctggtgcagataacatgtggccactctttacgccgg

SEQ ID NO: 676109 - DNA, 296 bp, Homo sapiens
ctatgcactgtaatggaaatcacgagacgaaaacgccctataatcccagcattctgaaaggccacggagggaaaatgcttgagcccaggagtttgaaagcatcctgagcaacatgtagagaccccatctctacaaaaaatataaaaaattagcaaggcatagtggcatgcatctgtggtcagctactcgggagactgaggtaggagaatcgcttgaacctgggagatggcggttgtggtgagccgagatcgcgccattgcacaccagcctgggcaccaagagctaaactccgtctc

SEQ ID NO: 676110 - DNA, 889 bp, Homo sapiens
  misc_feature (883)..(883): n is a, c, g, or t
gatagaagtaatcaggagacaagcggggggtcgattcaacagtctagatatctttttatcgttacccttgccctcaagcctttgttatgtccaaaaatagtccttgcgtaatgtggtgttcagaacggaattgatagctggtaccccagtctctttgaaacatctggtacattggctgaatgctagtgctcaatatcattatggtcagtttgcaatggtgctgatctgggtgatcaagcctcagtccccttcataagttagccctctcctttttaaacaattacgtgtgcacagagaggtcaccttgttcaggacattgcattttcaggcttgtggtgatagataagatcgagcaaggcaagtgttcataatgagtttccaatgtggacctgatgttctagcatgtgattacttcactcctggactgtgactttcagtgggagatggaagtttttcagagaactgaactgtggaaaaatgacctttccttaacttgaaagctactttaaaaaatttggggtctggaccaaaagaagagggatattcggttgacgttcagatgacagataaggtgggagtatgactaatccaaaagatgggttacttgagaaagggcatgtaaagattttgacaatcctgtcggaagattccagaggagtctaattgtcagtagcagtaagaaggtttctgcgaagagtcacgaacgtgcctttggtatttacgtgggggaatggtaatgagagttggcctttaaaaatctttgggggaaggaaacaagtgggcggcgaaatatacaatggggcgaaatataactcacaggtatggtgtacagggggaaatattgtaaaagagaatgtttatatgcgtttgttttaatatgggngcaagc

SEQ ID NO: 676111 - DNA, 107 bp, Homo sapiens
tgcacagtgctccagaatcctccaagatagagggacaacaggtcgcaaataaacacgaccaacgaagcagcagcagagaccaaaccatgaggccagacatagggtcc

SEQ ID NO: 676112 - DNA, 708 bp, Homo sapiens
tctctctctcacacaacacacacacacacacgacgagggtgggcggtggggcgagagagacaagaaagagaggagggggagagagagagagagagagaaaacaaaaactgggggagagaaaaaaaaaaaactatatctataccgaggaagaggggatgcttctctctctctccccctcttttttttttttctctcacaaaaaaaatatttctctctcaacacacacaaaaaaaaaaaaaaaaaaaaaaaaaaaaaaacaacaaaagaaaccgcgagagagaaaagagaaagaaaaggaaaaaggagggaggaagacaacaaatggcggggcggcaggacagaggccagagagagcaacaaagaacgagggagggggcaagcaacggcacggggggggagaaataaatttcttttataataaaaagagaactaaccaccttctcaccaataaaaacaaaaaaatcaaacaacaaacaaccccccctataattacatcaatacaacaaaaaacacaaaacaccaaaaaataacatagacgagacacaaaacaaacaaaacggaggggggggcggcacaacaaaacacaaaagacgccgcggaggggcgccacagaaacagagaccgaaccggccactccgtcgacttgtgacacgaacacggggcgccacaaaacaaaacaggcaaccggccacagaagaaaaagccgcc

SEQ ID NO: 676113 - DNA, 312 bp, Homo sapiens
cccgtactagccctgacaggaggctgaggagtggtgagtggggacatggcagtggctgagctgatgctcagctgactccatgagaagggaagtgaccttcacatgtgggtgatacttggacagcaccgctctaccgtgccttcatgcaaccgactgagtaacaccctggggcacacactgtgtggcagtgctcgggccagtgttagtacttgtgatgggagaccgcctgtggaatacctgggtgctgtcgggctagctcgggggcttgtcggggcttgtcgggcgcttgtcgggccttgtctggggaccttg

SEQ ID NO: 676114 - DNA, 873 bp, Homo sapiens
gagatgatatggccttgtggtaattgaaagtcggacggggcgtcgtgggcgactcgtgtgttctacgcgtgtaggaaaaagtaagcatgagacatctatgtggcgataatggatgattcctagaagtaagccggagatggcgataacatgtgcagtcggatgatgcattttctccttgtagctaaactctagtactgggagtgatgctataaagtaatgatagcacgccagaattgtttcgatgtacgaatgtttactctagagttgaacgtaatgcaagatggctccagtagatgggtggacagcaaccatgttcatgcatagaatgtagaagtggaacaatttgttgaaagagtcatggcgcaataaagcagaggaatggagggccacggtgtattggaaggagagtaagaatgaataagcgtacgatcacgctttccacgagaaggggggagaatcgatgtacacgagagttcagaggaatcccagagtggcaccacgcgaagggagagggctcctatcggccctatctgtcctgcttactgtctgctgagatagtcgtcgccataaaaagtacaacagagatgagggcagtgccgttggccttgtgccatttgggtcgagttgtttgcccgaaggaaatagctgtgggaaggagactgtgggaaatgatagcactgacttgtcgttgattgaacaaagctagcgctttatcgagcacctgaagggctgatgacatgttgacacggaatgaaatattcgaaaacaggatatttggatggtattaatcgaggctaagagtgaaagcgccttgaatgccaggtaacaacaaaggggaagtttgtacaaggggttgaaaaaaaggcatgaaga

SEQ ID NO: 676115 - DNA, 108 bp, Homo sapiens
cttcggatggggggggaggcgatatcctagaaccagtcgtcggcgaggtagcaaggatgacggagcgggggaagaatcaaagcacggttaaacatgcatacaagttcc

SEQ ID NO: 676116 - DNA, 1153 bp, Homo sapiens
gccgagagggaggaggcccaactggtgatgctagctgctgctgctgctgccgccgccgccgcctctattgctgatactctagtggggctggaatgggtggttcctattcgcaccatctgccaaccagagacagaggtgaaaaaaaaaaccgtgcagccactgctgcctgtaagggttctggcgtgctgcatccggacatcaggtcacaaggaaaactgtgcttcagatatggcactcatctccactcctttaaaccagcattactccgaggatcatcagacactggtgctatccacgggacacagcagactggaagtgacgaccatataccacaggcagccacccaccccagtcagcatagctcgcagcaccatcagaactccgaggaatcaagcaacacagataaccacggccagcaccctgcctcagaacacgaaaatcaaaaaccaacaagcactccatatagcacaaggacacaaggtccaacgaaagtggcagacctacagggcagagaagcaccagaggcactcactcggatgccctaacacgcatgccacatagaagaccctccaggcaccaacgctcacagacatacagataagcagctagcatccaggagcaagacccaaggcatcaacagcttgacagcacagcaacatcaagcagcgcacagcgatcagagcagccggcgagccaggcaagcccacgggctgatgacacgaaacaaaagccacagctcacggcaagcgacacgcccgcgctgcacgagccgcgacacgcgacacaatactcacccaacacgagcccgcaacgcaagaacgaacaagagaaacggccaaaaccaaacgcacagcagaccaagcagcacccgagaccgccaacgagcacaaccaaggcccgcaccaccaaagaagccggaaagaggccaaaccacaacgccccgcacacgcacacccaccacggcacaaggaccccgcaacagaacaacacgtcccacccagcacgcgccctaaccacacgctcgtctgcaactgagacaacacacaacctcacaagagaacagataaaacaacaaaaacagaaacacgacacaacacagcacaccacagccagcaaccgcgccaaccagcgcagaaacccacagcgcacaagc

SEQ ID NO: 676117 - DNA, 117 bp, Homo sapiens
  misc_feature (98)..(98): n is a, c, g, or t
ggaggtgggagccctgggccaaaatggcggcctacctgcagtggcggcgcttcgttttcttcgacaaggagctggagatccctccgctgagctatganggggccgctcccggggcca

SEQ ID NO: 676118 - DNA, 137 bp, Homo sapiens
agcggacagcactgtattggcgtacagaatctttgcggatgtcactgtacacttcatgatggagttgaatgtgtagttctgctggatagccacaggagtccatgcccaggaaggaaggctggaacagtgcctcaggg

SEQ ID NO: 676119 - DNA, 330 bp, Homo sapiens
  misc_feature (23)..(23): n is a, c, g, or t
  misc_feature (26)..(26): n is a, c, g, or t
  misc_feature (52)..(52): n is a, c, g, or t
  misc_feature (81)..(81): n is a, c, g, or t
  misc_feature (83)..(83): n is a, c, g, or t
  misc_feature (122)..(122): n is a, c, g, or t
  misc_feature (186)..(186): n is a, c, g, or t
  misc_feature (191)..(191): n is a, c, g, or t
cttccgcactcgggcgcacgggntgngatctcgagcagcctgtctgtcgtcnttttggcgcccccgctccccgcggtggtntngcacaccgatcctgggcttcgctcgatttgccgccgagngcctcccagacctagaggggcgctggctggagcagcgggtcgtctgtgtcctctctcctctgcnccgcnccggggatccgaaggtgcggggctctgaggaggtgacgcgcggggcctcccgaccctggccttgcccgcattctccctctctcccaggtgtgagcagcctatcagtcaccatgtccgcagcctggatcccggctctcgg

SEQ ID NO: 676120 - DNA, 770 bp, Homo sapiens
atgaaaaaaatgtagtacctctaaaggtattcaagaaacaatgtttatgaatctcactagtccattatagttgggtaccataattattttaggtaacaaagcaggttaggttttggttaatgtatctgtgcttaacaaacatcagttttggtggtggtggttgtggtgtggtggtggtggttttgagacggagtctcgctctgtcgcccaggctggagtacagtggtgcgatctcggctcactgcaagctccacctcctgggttcacgccagtctcctgcctcagccttctgagtagctgggactacaggcacccgcacacgggcccgggctaattttagtattcacagtagaagacggggtttcaccgtgtttagccacaagtgctctccatctcctgacctcgtgatccgcccgtctcagcctcccaaagtgctgggattacaggcatgagcaaccgcgccttggcccaaaacatcagtttttgaaagtagggctacagggtgacttaatattggtcatgggtggggcaccttattaatggtgaacggctaataaacacattgaatccgtataaagctccttttgagggcaaatcctcctaaagtggcctagggctcccgtggcgtaaggtacataattcccagcccccaaggtttcttgaggtctttataagataccaagtgagcattcttaaagctcacaaactattttccagaaaagaggagacccaatttttgttatgttataacaacctttggttgtaacact

SEQ ID NO: 676121 - DNA, 1403 bp, Homo sapiens
  misc_feature (470)..(470): n is a, c, g, or t
  misc_feature (798)..(798): n is a, c, g, or t
tgtttggaaagggattctcactctgttgcccaggctggaatgcgggggtacgctctcagctcacgtgaacctccacctcccaggtatacaagcagttctctgcccaaccctcccgaggtaggctgggagattaccagggccgccctgccacaacgcccgggatattgatcgggtatttattagaaagaagaatgggggtcgttcaccatcttgaccagggctgggtcttaaacgtcctagatggtgttgatccaccacacctcgagggctcccaaaggtgctgtgggatttacagtggcattagagcatacctggtggcctgtggcccccctttttctttaaactatattaagagagaaaataagtgttaccaccctttaggtattcagagactatataaatcttttcattacagggggtcacaggggcgaaatttaaggtattttacaacaaagcgcctcttgtgctcncatgagaaagttggggtctcccgtagggaaagtgtgtggacagtgcaatgaaaattgtgtgtcggcgagaaattgtggccaacacacaccaggggggggtgaagttacatccgagtggggagaagaggacatcactctaaagataaaaagtttttctttgaaaggtatatttaaacaaaggtgtggggcttttagaggagcatatacaacaagaattgaaaaggggggggagacaacacacatttcttacaaacagttgtgcgcaaccactaaatttgttgtaccccacttccgtaaaagtggaacttgtgtccgcgttcaacgaggnatataatgttcgtttcgtcccccaacagatgttgtttcggtggtatagttatgtacgcccccccccacaaaagagagagccccccccccttattaacagacatttgtggcgtgcctactctaataatgtggacgcacatatctcgcgctcaaaaggataaccgattttattctacaccaaatcattgtggtgtagttccttacaagagaggcccctctcactattagtggggtcggggggaaatagaaagccatccctcgataagagtaaataacagccgtgtgtcgttttaccaacagcataacaggctgctcttgaagaaaagtccccgcggataaattctgtcgccaagtgtagagaaaagttgcccccgattagaagtggttgaagatattatcttttccccgaggtcgtctaaacccactgttttcgttcgccgaagcaaaacatcacttctaccggtggaacttactcatacttgctgtgatataaaatagagggccacacataaatattgacgtggtgtagggtcctggtggggaacattcacaaacaccgcgcgggggtatagataatcctcgttgatcgacggagaactgacgaga

SEQ ID NO: 676122 - DNA, 188 bp, Homo sapiens
gcagaagatcacacctgtcctcccagctactcgggaggctggcgcatgagaacgggacagcacttactattccccacactcttgcccggcttcacaggcaacttgcaagaacccacataggatgtgctggtaattatcagagttcagcaccatggccggctataaaaaccacatacaaaaatcactgc

SEQ ID NO: 676123 - DNA, 1008 bp, Homo sapiens
  misc_feature (382)..(382): n is a, c, g, or t
  misc_feature (703)..(703): n is a, c, g, or t
agcggggcgccggcgcctgacgcggagggaaggagctacgagtagccgtcgagaggccggggagccagtcgaggaccgacccagtgctgagccaggcagccgccgcacgtcgcccccgactggtcggacgtccaccggtacatcgttcatgagtgaccacttgatagcttcctacctgatgagatacagcacgaagtccaatccactgaaccatcagctttgaggccacatagatttcttctatctctggagtcataggataacattaaaagcactgggagagaaggatgcaagcaggcaacgtttgtgtacaaatggcggcgccgaaattgctgactccgcattgtgcctgctgcagtgaagccgatctcccagaaatggnagagggcgtcgaaggtgcactggttgcagcgctctcaagctctcgtgaatgccacaaggtcagaagaggggtcgccatctcgcacttctcgtcatgccggaaggggaacgaaagtacctattgcacagatcgtgatgcctaatccaacgtacattctactgtcctgattgattggaagctgtaaggcacctaacgacaggtgtaggcggaccgagtgtcgctgagggtactggaaactagccacccacgctttgacttcggctcgtaggagtatgcccccagatgcccaggtagtctgcttggccaattcccgcctttccnttgaatgctgaggaatgcaccagacaagttcaacaaacaaaggtttgaacgaattgcgaggaacaggacgaatcgaacgagagagacaacagaccagcagggatcacggcacacaaatgattccatgccgcatacaaagtgggccggcaaagaggctaggaaggctctcttcgggtgaaagggaaggagaaccaagggaggggatgcctgagggaggaagccaattaagatcgtccttattttaattttcctttttcctcttctttcctttccttttttttaacacaacttttaccctggcccct

SEQ ID NO: 676124 - DNA, 215 bp, Homo sapiens
gtgtgtgctgctgcgtttgtgtgtgtgctgtgcccgtgtgtgtgctgtgttcatgcgtgtgctgtgtgttgtgtgtgtagctgcagggtgatgcataacagtatgacgtgctttttcaggatgggaacattgcagcatgtcaagatttgccgcaggtggcagcgtgtggtccgcagctcgcaattcggtaatccatggtccatagcttgtttccc

SEQ ID NO: 676125 - DNA, 694 bp, Homo sapiens
tctggatataggatacactggtctcacagaatgaggtgtgaactgttcccctcttctttttcatagtttgtgaaagttagacctatattattcttaaaatgttaacatagaattcatcgagcgaagctgtctgagtctggagttagccatttgtgagaagtttcataaattaataatccaatctctttgttacagatctattcaggtttctatatctattcgagtcagttttggtaaatagtatctttctagtgaatttgtcaatgtcatctaagttatctaatttggtggcctacagttgttcataatattcccataatactctttatcaagcgtagggcctggtacacaatatcatttccttcattcctaatttcataatttgagtgttcttcattttttcctggtcagcctagttatgggtttgtcacttttgttaaatctttgcaaaaaaacaagcaaattggtggtatcagtgattctctcaattgtttttctattctctatttcatttatttctgctctaatctttattattttctttcttcactggctatgcaatttattttcctcttctttacgttatataaggtgggagtctaggttattgatttaggcatgatctactgtttaacatatagactttcagaagtttaaatttctgtcttagccttgcttagatgcatcctaagtt

SEQ ID NO: 676126 - DNA, 130 bp, Homo sapiens
ggcacatctgacccagtcgggagggaggacagggagtcggaaggaggaggacagagtgagggcacagagacgcagagcacgggctggcaaggatggagaccctgtgtgggaggacagacactcgtggaga

SEQ ID NO: 676127 - DNA, 680 bp, Homo sapiens
  misc_feature (148)..(148): n is a, c, g, or t
ggagtatgagggagatgctgagatactccagtaaaatgtttatttccttttccaaaacaagagctgaattctttcttctgctagcagctctgaggggtaccgccaaccggtttgggggtctctgctcagctagttcctggctttgctnttgactaattacttacttccagggtctcagtgccttgtctctaaaaagaagccgagttcaagtctacagacccttatctgaaacccttaaggctagctgtgtctcataggtctgatgttttggactttagaaatgcaatccagcagataggccatatacctagtgatgcccacagcaaggtctagggcagccacccgtaatcacagtgatagttaccacagtgggataaagagaccagaactagcctcatgatggttccaattagggcttgctctaaacgcgtgtgtcaaaaataaatgtaggattttagagctttttggattctagaacggaggataaggggccgtaaacctcactgttgaactcagagaagctcctaaataaatgctaattatgatgagtactgttgttatttttttttgttttattttacttgccgagacagagtctcactccagcttaggcaacaagagtgaaactctgtctcaatcaatccatcaatcaatcaataaaatagaggtcatgctgacta

SEQ ID NO: 676128 - DNA, 93 bp, Homo sapiens
  misc_feature (15)..(15): n is a, c, g, or t
  misc_feature (86)..(86): n is a, c, g, or t
ccttttaaacttttnactgattttttttttctttcccccagagttaagcccaaaggaaaacctttcaataaaggatcatttgcccnctggtga

SEQ ID NO: 676129 - DNA, 383 bp, Homo sapiens
aagttggcacatctgcactgattccccgcacaggttgcgcttccggccattttaccacagaatggcgttcctctggtgtgttctgtgtaagtcccctcattcaatgtaggccagtttggaaaagtccaggcccagcttgattttttcttccagcctgtggcttcgtgtcatactcagaagcgtcccccttcgtgtacttctttccctggaagcttaagtcgtgtgtattccagaaccaggcgatatgaattggccacatctgggagaaatggccccacagctcgggctcagaatatggaggtgtccctctctgtgtcgcctctcccgcgtgtgtcacagtaccacagtgtcatgcgcatggttctggtctccgctcgtccctt

SEQ ID NO: 676130 - DNA, 103 bp, Homo sapiens
agtagcctggcccaacattactcgcccccgcagatgacgccgatcgtcgagcgcgccgacgccggaccagagcgaaagcatttgccaagaatgttttcattaa

SEQ ID NO: 676131 - DNA, 174 bp, Homo sapiens
cgtggtgacatgccggcggcaaggtcgcttcctcggcccgggctcgatgccgattgtactgctcgcccagaaagccggacgtgaggttcttgaccgagctgtccttggggaacgagtagcggcgctcaaactccagacgcacggttgcctggtaggtcttgtggtcgaagccga

SEQ ID NO: 676132 - DNA, 138 bp, Homo sapiens
tgatggcgctgagccactctattgcagcttgaagcgcggatgggggtgaggctgttcaatcgcacaacccgcagtgtgtcgttatctgaagtgggtgcagagtttgtcgagacgattactccagcagcagcgccatca

SEQ ID NO: 676133 - DNA, 186 bp, Homo sapiens
gacgtctcgtgagatggtacatggatcccacgaaaagctcggaaaaaagaagtgtccattgtcaaagaaacttgtttgccacctacttgtccttttaccaggtcctcccattgtacctgtgcactagagcgttagtcttaagagagcatctattctcatgacacccttgatctggagtctcacgga

SEQ ID NO: 676134 - DNA, 516 bp, Homo sapiens
acatcaaaaaccctactttattttttgttttgcaataccatttaccttttaaataacccttttatagaagggtttggtttagtttaaacagaaaaaaaagggaaaaattttaggtttcaaaacccctccccctggacaaattttaaaaaaaaaaaaaaagcccccttttttcaaatgggtcaatgggaccaaagttttcaggggctaattatgtctaattccttttgcccaaatgggcaaggggattaaaaagaaaacccaccttttacaatcactggcttaaagaaataacacatgttggatttttttggaagggaaagaagggttttggttcttcaatacacagaaaggtggattcacattttccccacaaaaagggaaaaaaactttgacggggttgaaacttgaaaaaaattagctttatttgaaaatataaaattttttggtttttttccctagatacaaagtccccggaggggctttcccccccccaaaatttttacggtttaatggttt

SEQ ID NO: 676135 - DNA, 215 bp, Homo sapiens
gtaaaactaatggtccccacaattatttttctacccctgacatggctttccaaaaaacccataatttgaatcaacccaaccccccccagcctaattattgggatcatccctttacttttttttaaccaaatcaacaacaacctatttaggggttccccaaccttttcctcgggccccctaacaacccccctcctaattttaactccctggctcca

SEQ ID NO: 676136 - DNA, 379 bp, Homo sapiens
tgagacagggtcttgctctgtggcccaggctgcagtaccgtgggacgatctcggctaactgcaaccttggcctccccggctcaagcaattcttctgcctcagcctcccaagtagagaacaaagaaaactgtaatcaggctgggcacagtggctcacacctgtaatccagcaccttgcgggccgatgcgggcagactgcttgagcccaggagtttgagaccagcctgggcaacatggtaaaacctgtctctacaaaaaatacaaaaattagccaggtatagtggcatgcacctgtagtctcagctattcagaaggctgaggcaggaggctggcttgaggttgcagtgagcggagatcgcagcactgcactccagcctggg

SEQ ID NO: 676137 - DNA, 786 bp, Homo sapiens
  misc_feature (6)..(6): n is a, c, g, or t
  misc_feature (669)..(669): n is a, c, g, or t
agaatngttttttttctttttgggtgtcttaggatcacacggtgcgtgattctgcagctggctgtcagtgcatctgggaggtaatgctgtgtctgtacagaactgcttccttctgtttggtggctgtgtggatatcccataacgagggtgtgcctgtgtgttccttaccaggccagtgtggctcctcctaatgaaccgaacaatgtcttggtccacgtgccttttaactggtgtctgtagttaagtacctggaagtgatatctgggctgaaggatacatgtgtctgtaacaggtcattggataggttcaacccaatgggtctccaaaggggctgtgctgattttaactctctggtagcataggaggagcctgcctgttgccgtgtagctttgctacggtgcgattccactatattaattgatggtgtctggttaccagtgaggttgaacatttattttttttaggaggtagggtcccccaggtgtgggagtgctggggctgcaaccccagtttctgggtaccttgaagccttgacctctggggcctcgggtggtccaaccaactatcgtccccccaggtgtgggaataacaggcagttgccacaatgcctggtaactgggcataaaatggagaaggggaatttgccgtgttgcccaggttgggccttgngcttctgacgtaggggaaccgcccgtttggtacccaggttctgaaaatggcaggcaatgacattgatcttgttaaaaactctcttaattattggtgccatcatacaattcattttag

SEQ ID NO: 676138 - DNA, 108 bp, Homo sapiens
gtgaaattgagttcaccatatcccctcctctttctccctcctcctcttcttcatctggcgcttccacctatttccgggcaactttagcaggacccttatgcaccatca

SEQ ID NO: 676139 - DNA, 1651 bp, Homo sapiens
  misc_feature (1151)..(1151): n is a, c, g, or t
tgggcttggatcgggtcctggttttatctggccgaggtggtacaaaactgctgcctgaggtgagactgggcgtgagcctcagtgaccgggatggctcctgggccccgcctgggctggtggctggtgtgctgggagcctgttgggctgagtcgtggatctggggactgtctgccctgatgagctgtgtggactgatgtgatgtgtgtctgtggctgctgtgtgttctgatgccctggtgtcggtgctgtgctgtgaacttgttctgccaacgactgtgctgcttccttggagcttgttcacggctgtgaatgattggatgtgatgtgatgcatgctgtgcatgctgtgcatgtgatgtgatgcctgccccctgtgtgtcctgcatgctgaccctgaccatgtctgtgcctgcctgcctgctttgtgcccctgtgtgtgattccgaagatgtgaatgtggctgtgtcctgtgtgctcacacagctttagctatctgttggtgcaaaactgcatgatgtgctggtgaaacaaagacgtaaagccccttcgaatggactggggtgaattacgctaagccgaaaggagatggcaagaaaggacttgtgaggtggattgacgtgtaatttagacaaatgtaaaatgggttgactgctgttgtgtgccagatgttaacaattgtgcatggaaggttgaagaagatgttacgaaatggctcaaccaatggttgctgtgtatgacagattgattaaagactctgtgccccatgggttgaaaatttgactggcccacttccacgccagcctttgcccgatttgtgcccttgtgtggacccttcctacttgacggatttgttaacattaagcttaatttttaagaattggcagggacgtggccatagatgtgcattgaacaggaaccattcacccttggacgaggtgtacttttaaaaagagccatgataggggaaaacacccggaagggaatatgccattcaccttgacagtcacctgatgtgcacctgaaattttctttccgagtgtgaacactatcgtattataattaaagcccattaatgaagacgcacttttgacccttccggattgaaaggaccttatcagattaagaaaacgaaagagtggagtatataacattntgttaccaccgacacccacatatatatcaaacagcgtcacctcaagtttcatacatacatagaggacaacgttatacgataggtccgtttcccatcgtttttcattcgaaccaccgttacagttaacccattccgcccgttttaatagccgaaattcaacagcatcattaagggggagagagctgtagagggcaaaccctttgtaaacatttagatgtgcgatgaaagaaataaaataaatatatagtatagatatgagtaaaattaaataatatgagaagagtaaagaagataagtatagaataagagtagataagaataggagcagaagtaaaaaacgtggagaaagtgaagaagaggagcaagacaaaattagatatcgacaagcaagagcgggagtagagggagagaatggagtgaagatagtagaataaagtagcaagagtagaagagggaattagaaaataataggagggcatagatgtattctataagaggtc

SEQ ID NO: 676140 - DNA, 145 bp, Homo sapiens
cgggctatttctcccgtgcccggaccatcacgagacctgcacggcagatctggcgtgtgccgccctccgagctgcagatcccgcccctaagcatcccccgggactgggcacaccctgctttgggcgggacctgcgggcatttgtg

SEQ ID NO: 676141 - DNA, 281 bp, Homo sapiens
  misc_feature (186)..(186): n is a, c, g, or t
  misc_feature (225)..(225): n is a, c, g, or t
cccatgcgaagtttccactatggcttccagcactgtcccggtgagcgctgctggctcggctaattttttgtatttttagtagagacggggtttcaccatgttagccataatagtctcgatctcttgacctcgtgatccgcccacctcggcctcccaaagtgctgggattacaggcgtgagcaccgnaccctgcctcaactgtctgcatttctaccatttttgttnttttatatgtacgttcccacaacaccagtatttttcaagggtaaaattttacataa

SEQ ID NO: 676142 - DNA, 993 bp, Homo sapiens
tcctctccatgatggccccagagcacccgaatgctcatggacatgtccctcgcccaggccaacgcggttctccctttacttccttgtacttccttgcgtctcgcgggttattgtggcgcctaaaatgatcagtcccgtttggcctcctcccaaagctaggtccttctggcactcctcgtgtgtggagccgaaccctcgagtcgggcaaacattgaccctgcttcgtccaagctgaattcttgtaagtctccctggctctcgttgagctctctgcggtgcacagtcttctctttccttgtgatggatgttgtcttggtgcgagccttgtacagtgggggcgaattgccatcagggcaagagctcagtgatccaagtgttccagcaggcgtgggctgtgcggtgatagacgtggagcgtgatggcccggcacgtcgtgcagccaggataccctgcccaccggcgcatcgtagaggtcttcggcacgtgaggtcttgctggagaacggcgacattagagatcgcaaggtcctgggggacctgatctttaaaacagcctgaccggcggcaagctgctcaacgaccatcagcccaccccgagattcggaaaggagatgatgaaggagacgttcaagtacttcctccggggataccgctacgtgattctggatatcacccctgctgtagagacaaagaagttggctcaaagtacatgaaagcacaccgggggtaggtataacctgggcaaccggggacacaacaggtggcacggggtggatgcggaggaaacagcctggaaaccgaagaacgcaaaagcccgcaatccaatgcccaggtgccctgacaaggagaaagcccgcatggcccgccatgtctagaaaactcggggaaatggagtgcacccaaaggcacaagtacaacactggccacatgagcggaaaggccggaaaacgccagaaagatgggacaaagcggggcaagaaacctatgaacaaca

SEQ ID NO: 676143 - DNA, 257 bp, Homo sapiens
  misc_feature (60)..(61): n is a, c, g, or t
  misc_feature (99)..(99): n is a, c, g, or t
  misc_feature (112)..(112): n is a, c, g, or t
  misc_feature (123)..(123): n is a, c, g, or t
  misc_feature (159)..(159): n is a, c, g, or t
  misc_feature (164)..(164): n is a, c, g, or t
  misc_feature (199)..(199): n is a, c, g, or t
  misc_feature (206)..(206): n is a, c, g, or t
gacggataggcagatctgtctcaaaaaaaaaagaaaagaaagatacttttctttcctttnngctattaataataatactttatactgccaatgagtcantatcccttatgcnttcctcttatntttactactccccaaatgtcgccttactctatgatngtggngctccatttattttattcagtcaaacttactagtngcctgtngatctagaaatgccctccacccttcagaattcacgggatctgggcctcgtg

SEQ ID NO: 676144 - DNA, 782 bp, Homo sapiens
  misc_feature (246)..(247): n is a, c, g, or t
  misc_feature (334)..(334): n is a, c, g, or t
aggtaagtagtagatacgccatatatagggaaaagatagtatactacgtaccgtaaggcgcacctaggcgcgggcgaacccctatacaacacgccacatactagcagctaggtagcacgataggtactacggggacctaccgcagcagctaccccagggcccacgggccagccccgccgccctacgcaacctaggcagccgccgccgtaggaagagtaacagtatagtagaatatataggctaccnngcgaagtaatataatagcactagtagtaggctattaggtaggggtactataaagtatagtaggtactagacacacactagctagtanggtatacccctagggatatataagtagaaatagccgtaatagcaggtaggacccccaaaagtaacaagggcatatattaaacggattactacagtaaacactataaaagaggataggtagtatacgtaggtatataggctaaaaggatagggctaccgactatatacctataggctaactaccatagcagggactactagcaaagtatataggctataatatagaagtactatataaaagtactaagtaataagcaataatagctaaagggagagggagaatactataatactactaggcggcacataactaataatatataggctagccctatagccagtagctagaataactaatagctagacataagccccttagggctacctaataggaaggctagcttaaagggtaaggaattaaaaaacccgaggccagggttatagccaac

SEQ ID NO: 676145 - DNA, 173 bp, Homo sapiens
  misc_feature (1)..(1): n is a, c, g, or t
ntagccacagtttcagtgttcatatcatctatccttcccagctttccacccacagtgctcaattcacacagtcacccatttcaagtccagtttcttcatttggcagtcatgcagggtgtctcatcaccatttctcatcacatttcaagcattttgggtcaacgcgttccatca

SEQ ID NO: 676146 - DNA, 906 bp, Homo sapiens
  misc_feature (287)..(287): n is a, c, g, or t
gatggcgtgatgtctcacggaaagttctccgttctcagacatgggtccctcgtgcattcctgcctcggcaagcgcaggatgtagtgcatcgtttgggcaaggtgaagacgcttcctctaacggatgacccagtccaatccgcggtccagctcacagacttcctgggatacaaggctggtatgaactcaacatcgatgacgcgtgacagtccgaatatggcccgcagaatccaatggtgaaatccagagaaaggaaggatggtcggacgggacttgtagaccatttgntacgactagcaccgataccactgtgatgggctgtgttggggctatttcgttggggcgtaccagtgtaacatacactgcttcgcatagtctgggcgaggaccgctctcacacgtaacgtcggtactattgactgcagtcacaactctatgctcgaattgtaatgttaagtagagtcggttttactaatatacgtaactttgggtaacttgaaactcattacacgtaaggaaagtgcgcttgttacgcacatgtaactcgcaagcacataaagggtaggcaatgacgtgtacttgggctaggaactcagtatgtgagacaggaattaaagaatagtgtagaccaaacgattctaaggatgacgcttatttaactgaatgatgtaatatagagcccagaccccaattgattgccgctatagcagggggcgtcccttgttcgtccaaagggaaccgtaacacgtggagactggaacccttgcactgggggacgtaatgccccaagggtttggaattgtgcagcgtttacccagtttgcgcactgaaagcagacttcctcgtgcaactagcgttaagcgcggcttgaacgtaagagggcttataggaaagcgaacgtaagaggc

SEQ ID NO: 676147 - DNA, 473 bp, Homo sapiens
  misc_feature (155)..(155): n is a, c, g, or t
cccggatgtgcggtctactaacaataaaaaattgaaaattaaaatgacagattgttgctacatatctgatggagggtttaaaatgtaaaatgtctgtttaaaaaagtctacgatttagtgtggtcaagtttatgaggaatgggtattcacatacnaagatagagatgtgattcagtataacttcagtgatcagaaacgggaaagttcaaatgaagagcattaagagtgttcttttactttcttactcacagaatttatcctaaggagataatcagagataatactattagaagagcaacacgttggtaacaattcagtgtccagtgtagaccgtgccaaacgtctaagtggattgcttaagcaaagatgggcaccagtgtgtgaggaactgtcttgcatcattaaggcatataaagaatataaagaaggagtccctgtgtctcagtgatttagaaccagtctctgaacagcaa

SEQ ID NO: 676148 - DNA, 266 bp, Homo sapiens
gtcttggaagaactgcacagtatgagaatagtgggtcagttttctccaggatccagaaagtatatcaagcagcttggggtgaagaaaggacccggcttctccaacaacacacaggcctgcagtaagatggggctggggctggtttggggtggaggataagtgacagccaaggtttgtcagcatgcagaagggtggctgactcatggactaagggctgcggaagccagtggttggccttaattcttggatcctgggaaacttctgga

SEQ ID NO: 676149 - DNA, 150 bp, Homo sapiens
agccgtcacgagcgtaatgctaggcatctttccacaagaaaatctgcgcaagtgacccaaggcatctcccagggggtagaacatccttgtgcacaagacactcttgtagcactaaatgcgcatggcgttggtgtgtgcttcacatcctca

SEQ ID NO: 676150 - DNA, 176 bp, Homo sapiens
  misc_feature (117)..(117): n is a, c, g, or t
actattagtgtggtacttacttccaccaatattatttgtctctaggatacacgtgtttaccgaagtattgttcgataggaataactaggcaggggaggtacagacaaactggtgtangatcaaaaggaccatttcactgtttacttgggggtgtatgtgtggccaaccttgatcgt

SEQ ID NO: 676151 - DNA, 438 bp, Homo sapiens
cacatgcgtataatatagtaaaacccagcccatgacccctatcaggggccctctcagacctctctattgacactccggctatacatgtgatattactttcacttcatatacgctcctcatactataggctactaaccaacacacttaccatataccaatgatggcgcgatgtgacacgaggcacataccaagggcaccacacaccacctgtgcagggctttgacacgggataatcctatttattacctcagaaggttttttcttcgcaagaattttctgagccttttaacacttcagactatcccctaacccccaactatagggggcactgggccccaacaggcattaccccgcttaatcccctataagtcccacttcttaacacattcgcattactcgcatcaagagtgtcaatcacctgagctcaccatagtcttg

SEQ ID NO: 676152 - DNA, 179 bp, Homo sapiens
agcatgcacggtattctcatggtgcggggcacagtgcgatgctgagtcctctactcgcagcgttgcgtgtcaccatgtctatgcgtccggaatacctctttaatctggcttgacgtttgtctagtggatccaagtttgttcactgtcagtaatacagacgacctaacttgtggaagcag

SEQ ID NO: 676153 - DNA, 381 bp, Homo sapiens
  misc_feature (357)..(357): n is a, c, g, or t
gtcgaccggggtgttaagcatatcccagtgtaggtcacctaacagaacaaactctgaagctagatggggggcgatcaattcacaaatggtgtccagggcacagctgggagctgaggggggtcggtagcaggcggcaacagtgagagacttatttctggagagagtaattttcaaaattagtagttcgaactgtttgggtatggacctggaaagtatgacattactttgcaggctatctctgcagtagactgcatatcctccccctttggcagttctatcttgacggaagatgttatagttgggtatggaaatctctgaatttttggtggccttcctgagccaggattcagacacgtngacgcgcccgcgaatttagtagta

SEQ ID NO: 676154 - DNA, 521 bp, Homo sapiens
ataatcagctcggtaccgtctgagcagctggagttagagggcgtctgtctgtgcggtaagggagagggcagttccggccgctggacgactcatgccaggtctgtggaaatgctggtgagagcagacgtgttggcagtgtagctgtggcggatgtacacagggaagttgatggagccctgcctcgtgtacccgatggatcatccgatcccgaacatcctggtacccttctgctgatgagagtaggagacaaagtcctcggatgactctccaaggctctgtgtctcctgtgtgtcatcatagcccgaaatgtagaaaggctcattaggtaataagatctggacgtccattgtcataaattgccttgaccttcggaaatggttgcaaactccttgtaaaccagggatctcatttgtctacttttgcatagatagtatgacctggttgagccaggaatactggaggctggcctagaataaatacttgccgaggatgtcctggtaggccgcagtttaacctcggtc

SEQ ID NO: 676155 - DNA, 332 bp, Homo sapiens
  misc_feature (5)..(5): n is a, c, g, or t
ggcantatatatcaaatatgtagggacagattagtttaatcagaagtaattcactgtgatgacatctgtgtgaccttttaggtaaaatatctgtgtttactcaatataaactatgtctaaaactgacatactcaactagaactcatatgaatcctttaaatttcaagtggagtaaaatcactggtttgaatatctaacagctcccatttgaccacaagtatccttctgatcactattttggggacatgcagaagcagcatattctaaggtattgttacgtcaagacagaactaagagtacctactaaagcttgaagtaatctgtctttagaa

SEQ ID NO: 676156 - DNA, 203 bp, Homo sapiens
cttctaggagtcgaacctgcaagagtgaggaccttgtctttcgactcgctcgatcccagactcgatgttgactagggatgggctttgtagttcggcatccatttaatttgtattgctttagccttataccctttatacctgaattttatttaaaatagtgagaaaaaattcaagacatttttgctatcatagcaaactgcaga

SEQ ID NO: 676157 - DNA, 330 bp, Homo sapiens
tccgggctctcatggataccgggacggtgcgagtagagtgttctgaggacactgctggggcgggtgcggtggtgggagggcattggttgggcagactgcccaaaagtccagcttcttaggtcagagctctgttgcccatcctgcggtggtcttgcgagggaatgcccaggcatccttggttcacagagcctccctctggtgggccccaatgggcttgctgctgtccatctatccatgaggacccgggggtcctcatgatttagggggctgtggttccaagggaagctgtagggcactaaaaatgacggggtacggagctcggaattttcg

SEQ ID NO: 676158 - DNA, 841 bp, Homo sapiens
tccttggtccagaaaaattatttttattattggatagtgagtgaagtaaagatgtgagttattcactatagaggtttaatcacccaaggtggccttcattatggtataaaatataaccttatatctcatctggtaatcctataaactattatatccccagtaagaaaggaggtcactattttctccttccttttttggtgtctttcttggcctggttatatatccacctatatataaagtttatcatatggaatataagtcttcttactatatatcaagaggaagaaaaagtaaaagcaccaaaaacccaaactatgtgcccaacagccctatagaccaattcccacatctccagccagtgtggctgtgccctctccgagaatctcgtgtgttttctctgtggggctctctctctctccaaccccaagccacttgtgggctgtggccccctgcggaatctctatatgtgttattcctccgtggggctctctactctctcgcctctcgcccccccaagctctccccaattataaaagtatataagcgcccccgccgacaaaccccccattctcctatagctgtgtgtgtgtcatcgaggggtgtgccggagcggtctccacacccaaattgtgatggtggggcgctcttgtgtttcccagagaaagcatgaaacaccatcttttttatgtgggctccaggtgtgcacatgtttgtggaatctaaggaaagggttcacccaaaatgcgggtgtgggaagaaggggcgcgtggcccctttctctccttttttaaactcccactctaatacagagaggggggtttaaaccataaaaattacttca

SEQ ID NO: 676159 - DNA, 323 bp, Homo sapiens
ggtggcctaccaagcagatgttctgaaagactcattatggtactggactaatgcaaatccatccttagaccagatgtgcaccaccttcttggaggaagatctggctttattggtggtgagcagggtaatctctatttaaatgtggacgctcatggaagcaattccctaatggtgagtgcatgggtgccttatatgaggggtgtctggcggtgtgttggcacaaatgcacaagttcatgtctgcacacactcggattggacagtccaggagtcaaagacatccaaaagtcgggaaacaagtacctcaggtagagagccgggcaa

SEQ ID NO: 676160 - DNA, 258 bp, Homo sapiens
tgagcccagcgccactacatacatgagaatattataatctgaagaagaagaagttgaattgatcagtgtgcctatttccagtagttcgcagatagtgatcctgcgaatagttgttcatgcactttaacagatgaaactgtacagccttatttagactctttgcctgagattgagtgctatgttgatcgcctctgagactacttccatttgcttattgccagctctagaaatgccgtatctggagtttgctttagttaa

SEQ ID NO: 676161 - DNA, 470 bp, Homo sapiens
agccttaaacctgcaagttcctcacccccgtctgcctgagggacccaatggaaagaagcacagcatgaaggagacctgtgccaaacccaaaaactgtcttctgtttagactgtacagagcaacccttgctcacggtgcatgatggaaaatacacaacaatcaagccgaggtgaactgcaccagaatcaccatccatcaagacccgatcacacacacacacttcaccccgatacaacatcatgtttagtttttcttaaaaaaaaaaagagagaaagcttctgataaactttaatccttgtcgttattcatgcttttgtgggcagattggagaagtgctttgggtgttttatttttcagtgtttagttatttaactggaagagaattgtaactgctgggtacagttgtatgtgaataatgtaaattggacaatgggaggagaggatctgtgaataaaacagaatacaaggga

SEQ ID NO: 676162 - DNA, 499 bp, Homo sapiens
attctagaggccgaggcagccgacatgttttttttttttggaatcttccttttttttggaatagcttacaatacgcaaacttccacacggggtggtgaacgatgccgctgggagtaaatcgtgtgggtcccatatggtccaggcggggaccagacatggcacctagggaagaactgccaggcaagagacaagagtagcgcaccagcaggcgaccacacacaaacggggcgagggagacacagggccggccacgcacaccaacccccaaacggcgacacccccacgtgtgcggcgacaacaacttgggcgtacccacacccctgcgtcgcgccgcccataaaagagagcttaggaaaaggagcagggcgggacgaacaagcgggcggtcgcgcacagcacgcacaccctgcgcgaccacaaaaccagagaaaaaacgagacccggaacgactcacctgccaaaaagcagacgccgaaaaaacaaacaacccggggacaag

SEQ ID NO: 676163 - DNA, 752 bp, Homo sapiens
  misc_feature (26)..(26): n is a, c, g, or t
  misc_feature (85)..(85): n is a, c, g, or t
  misc_feature (113)..(113): n is a, c, g, or t
  misc_feature (119)..(122): n is a, c, g, or t
  misc_feature (131)..(131): n is a, c, g, or t
  misc_feature (134)..(134): n is a, c, g, or t
  misc_feature (141)..(142): n is a, c, g, or t
  misc_feature (144)..(145): n is a, c, g, or t
  misc_feature (147)..(147): n is a, c, g, or t
  misc_feature (151)..(155): n is a, c, g, or t
  misc_feature (160)..(160): n is a, c, g, or t
  misc_feature (163)..(163): n is a, c, g, or t
  misc_feature (167)..(170): n is a, c, g, or t
  misc_feature (176)..(178): n is a, c, g, or t
  misc_feature (190)..(193): n is a, c, g, or t
  misc_feature (196)..(197): n is a, c, g, or t
  misc_feature (199)..(199): n is a, c, g, or t
  misc_feature (215)..(216): n is a, c, g, or t
  misc_feature (227)..(228): n is a, c, g, or t
  misc_feature (233)..(233): n is a, c, g, or t
  misc_feature (239)..(240): n is a, c, g, or t
  misc_feature (242)..(243): n is a, c, g, or t
  misc_feature (248)..(251): n is a, c, g, or t
  misc_feature (254)..(254): n is a, c, g, or t
  misc_feature (257)..(257): n is a, c, g, or t
  misc_feature (259)..(263): n is a, c, g, or t
  misc_feature (268)..(269): n is a, c, g, or t
  misc_feature (271)..(271): n is a, c, g, or t
  misc_feature (274)..(274): n is a, c, g, or t
  misc_feature (281)..(281): n is a, c, g, or t
  misc_feature (301)..(301): n is a, c, g, or t
  misc_feature (317)..(317): n is a, c, g, or t
  misc_feature (326)..(326): n is a, c, g, or t
  misc_feature (422)..(423): n is a, c, g, or t
  misc_feature (428)..(428): n is a, c, g, or t
  misc_feature (432)..(433): n is a, c, g, or t
  misc_feature (458)..(460): n is a, c, g, or t
  misc_feature (462)..(464): n is a, c, g, or t
  misc_feature (467)..(468): n is a, c, g, or t
  misc_feature (470)..(470): n is a, c, g, or t
  misc_feature (472)..(474): n is a, c, g, or t
  misc_feature (476)..(478): n is a, c, g, or t
  misc_feature (480)..(482): n is a, c, g, or t
  misc_feature (485)..(485): n is a, c, g, or t
  misc_feature (493)..(495): n is a, c, g, or t
  misc_feature (558)..(558): n is a, c, g, or t
  misc_feature (569)..(569): n is a, c, g, or t
  misc_feature (575)..(575): n is a, c, g, or t
  misc_feature (583)..(584): n is a, c, g, or t
  misc_feature (587)..(588): n is a, c, g, or t
  misc_feature (595)..(595): n is a, c, g, or t
  misc_feature (628)..(628): n is a, c, g, or t
  misc_feature (668)..(670): n is a, c, g, or t
  misc_feature (751)..(751): n is a, c, g, or t
cactatataacaattttttacaaaanatcattcttttacctttccttaattccctttatcttcatctttttcctccttctcctcntcttttctttcttctacttctttatacncaaagnnnnccccttctnccnccatctnncnnantaannnnnctccnccnccannnnatccannncttatccactcnnnntcnnancaaccatatcataccnnccttctcattnnatttncctccnnannaccannnnttncancnnnnncttcnnanacnatttctnatccaataacctcctatatnctttccctttaccttnatcttcatncatcatataaccatcccttctcactccattcccgccccctccttccctcttccctcttccctctcccttcccagccctcccttccttcctcttccnncaatncatnntacccacattttcttccttcctccnnnannnaannanannnannntnnnttntttttatnnntccttcctccatttaattttactctcccattccccataatatctcctttacccaatcccaagncccatcctttnacaagnctcctatnntcnnctttccntatctatttttacctccctcctccctttcttgncccccacctgacgtcttgctgcagagtctgacactggatnnncccccctcaccccgcccctggtcccactcctgcccccgccctacctccgccccaccccatcatctgtgggacactggagtnt

SEQ ID NO: 676164 - DNA, 172 bp, Homo sapiens
cgtacccaagactgtactggatgcaggttggttgtagactggtcaccgtctctgggctcaccctcacgtactccaccaggatgagctctatggagtgccgacagaggcaccagaggttcatgctgaatggacaatgggcaaggcctattatgatccatggaggacatgatta

SEQ ID NO: 676165 - DNA, 162 bp, Homo sapiens
gttccaaactagaatcaaccccagttattctctcacatcgattcacgcacagggacggttttttttctcagaccagaaatattcccaaaacggcggcccaggcctggtccaagcgctgactgatactaccaagtcttctgtggggtggactgagcacacatc

SEQ ID NO: 676166 - DNA, 573 bp, Homo sapiens
acaaaggcaggtaatatgcaatatagaagccgagaaatacatgatagaagttcacaaaacacatatgtcaacagaaagttgtttggatggtgtctgtgaagttagaatatttaaaaacataggtgttcaggaaagacatacagactggtccacgtgggcttgttagcaggcagaggaaccctgctttccaaacactgatatacgtccatgagtcacggcatgtgggaaggttgccatggacacctgtatcttaacaggatgctatagtgtttacgaaagctacacacacagagaaagcccagggaagcctgtaggctaggcgctatgcttttaggagggctgcaggaaccaaacctagtgtaatcctgttggttagctccatgcaagacttcatggaagagtccccagagtaggctactttaggcaggcttccatgaatggtcctcagatcatgtgatgtctacggcatagatgacagctgccctatttacacagaagctgcagaagtcgagaggcatgtggatttgctcttgggagttcaatgttgcagggtagagtagtcttggttgataa

SEQ ID NO: 676167 - DNA, 391 bp, Homo sapiens
cggattggcacgaatcagtcaggcacatatgagactctgtctcaaaatagtaatacgtaggtcataaagcatttaagtgagatgtctttgggctggagtgaagcgtagcacttaagcggtggctttgcatgtcttgataaaaagtaatgagtagtttgcctcaatacagcttcaactaaaattcggattttgagctcaaaaaatgttatgcccttcatagaaattaaggggaatggaaatcttttcttaacattttacacctctaccccttaaattttaagaactgtactttacaaaaatgtgcaattttcatacagcatcccagtgttgatcatggaggttaatgattctttattgttagggacctatcttgtaattcccgagttattta

SEQ ID NO: 676168 - DNA, 840 bp, Homo sapiens
gagcaattgagatttaagaaatttggtcacagatcctagcactttgggagactgaggcaggagaattgcttgacccaggctggtttcaaattcctgggctcaaagcgatccgcctgccttggcctcccaaagtgctgggattacaggcatgagccactgcacccggccagaaattctgataagagctgacattgcagtcttgagtctttttttttttttggacagagttccagtcggggccagaagaacaggactctattcttaaaaacaaaaaagaacacagcgcaataacgggcccacaacagagaaagtccacagagaaagaatgtgacaaagatgttgtgggcacaaacaagagaattagcggcggccccagaagacatctatctgagggccacacaattggcgacacgacaagaagccccggggatgaaaaacaaccacgaagaagcaagagagcaacgagcaaaggttgcgaagacacaagagaggagttaccgcctatgtgacacacccccgggtgggagaaaacacccgagagagggaaacatataccgacaaagacgcacgaggaaagagaggggaggaaagtcggacgcgacaaagagacaagaaaagcgataggagaggacggagcccacaaaagaagggccacaagacggacaacggatcgccaaaacacacgacaaagacgaaccaaaggcgggggccgcagatatcaagaacggcgggccgacccctacccccgaccagggtgcggagcaaaacaagaagaagacggggagatcacagcagacggggctaaccacacacacggagagaggagagggaagcacaaac

SEQ ID NO: 676169 - DNA, 91 bp, Homo sapiens
aagtacgtttttgctcagttcatgcgtgaacaatttaaacatcgccaccataagggtcaaatgtagtgtttttaataaactgtccaccaaa

SEQ ID NO: 676170 - DNA, 440 bp, Homo sapiens
  misc_feature (173)..(173): n is a, c, g, or t
  misc_feature (235)..(235): n is a, c, g, or t
  misc_feature (261)..(261): n is a, c, g, or t
  misc_feature (292)..(293): n is a, c, g, or t
ggtgtttcttatgagcttggaagatttctagtgctttccatgcactagcttatttgttctttatgacagttctattttattctgattttaaagatgaaaaaacaaacacacacaagttaactgtacagaatgaactcggtggcacaactcagcggggcagagccatgaatcanaacctcagcagctagtgttggaacactcatgtgactgtaataaccttgggcaatgttacttnagacctttctgtgcctcatgttttcntttacccgttaagtaggggatcgtatattannataactacctcgtaaaagtttctcgtgaaggactaaaaggagatattgtaacatgtcttgaaatatgtgcctcgcatgtagctacgtcctctgggtaattatagactaaaagctggccttcatcttctacagataagttgaaaaatg

SEQ ID NO: 676171 - DNA, 323 bp, Homo sapiens
tttatttaaaataaattatttgggatacaggcacaggcatttacgcctgtaatctcagcattttgagcattgcttgagcccaggagttcaggaccagcctgggtaacatagcaagaccctgtctctacaagaaattaacaaattagctgggtgtgatggtgtgcctgtagtcttagactgctcagcaggctgaagcaggagaatcacttgagcccaggagttctaaatttcagtgagccatgatcacaccattgcattccagcctgggtgatagaccaagaccctatctctaaacaaacaaacaaacaaaaaatgaataaaaa

SEQ ID NO: 676172 - DNA, 127 bp, Homo sapiens
gcacggaggccttttccgcagacagagcactggggccttcccgagccccggtggcgtttccaaccccccgcccgaaaacccggtcaatcgtgggacaaagcacaccccccccttggaaccccggaac

SEQ ID NO: 676173 - DNA, 1268 bp, Homo sapiens
  misc_feature (111)..(111): n is a, c, g, or t
  misc_feature (1268)..(1268): n is a, c, g, or t
cagcctcatggatattaacatacatatcgctcaccgcaaatctaagaacataataacgcatactgtgaataaagaagagcactcgacaactactcgactagccgatcctantaaataataaagagtacttacacacacttcccgacgtatgatacatacagtacattatacccacacacaccacaccacctttaagataagaaccagtagagtgatcgtgccaatccgacactgtgatggaatgaatacgcgcacatcgcgcactgataggaaaatgaattacagtacaatcacatctctccctcgaccattctatatgtaaccgcaccactaacacaaacctaccaatcacatgagtatctagtagatccgcgtgcccccctcagaatacgctcaatacctggtgttcaccacactccgaagcacgcaccgtaccatatcgccatactatccatacagagtccaacccgatctgcaacaacataacgccctctcagtttcgttacaccgcgtgccctatctattttcaaccatcaatactcctatcatatatgtgactacacttttttctatatacgcaccgagccaccactactggccgctttatgttaattgtgatgtagggtcaactgacacctaataccaccattatcgcactctccttacccacttaacctcacccattcacgttaccccacaccataccacaacaccacgttcaacaaatgatagaacttactgtattcgaccaagcatacatcctcataccgagcagtaacccgttcacatagcattttcgaaccatatacagagactcgatcgacgatcaaacacgctagtctagattaattatgcccgatatagcatcacgtctaactcaacttctccgacctgctaccctgtgtcggacataatataccctacaccacataactcatcaaccgcacacatttcgacccacccattctcgttaaaaatataaacaataagtaagaaattcgccccatctctcgattacttaagtccagatccgaataaactaacagacatcgcaccacccccttcaacacaattattacaaaagtaactccacatcacatcttcataaccagtaataagtagtatcgcagccgctagctctcacataccacatgtagactcgccgcgatgaatacaaattcactataccatacataatatgacgatcgccctcacactcgacatactatacactctaaatgaaacggatctattaagctgcaccaatn

SEQ ID NO: 676174 - DNA, 373 bp, Homo sapiens
tcggtccgatcgtgaaataggtaggtgcgtgtctgtgtagaaagaagtagacatgggagacttttcattttgttctgtactaagaaaaatccttctgccttgggatcctgctaattggtgaccttacccccaaccctgtgctctctaaaacatgtgctgtgtccactcagagttgaatggattaagggcggtgcaagatgtgctttgttaaacagatgcttgaaggcagcatgctcgttaagagtcatcaccactccctaatctcaagtacccagagacacaaacgctgtggaaggccacagggtcctctgcctaggaaaaccagagacctttgttcacttgtttatctgctgacctacctatttcacaatcg

SEQ ID NO: 676175 - DNA, 958 bp, Homo sapiens
gcgggctacacgttaaaaacactaatggggagcgcgcgaagctgaacttgtgctgctctgatgtgtggtgcctgttagcctgccctagatgctgcgctggagcctgcagatgtgctgtagctgtgactacaactgcatgtgcatctcgtggaggccaactctgactgtgacttggtgttgagatgtgacatgagtgtgtgctctgactgtgtgctggccctgaactgtgccaggtggaattactgtgctgtggaatgtgctggtgaccaagaccaagggattcatgacaactgcagcacagaaaccagtactagcgtcgtctaaagacgacacggagaagacagagagcagcgagataaggcagaggagaaagataagaaggaagcaacgacacgaaaccatccgggagaaacgcaacagaagccggaacaccagcccgaaatgaaaccacgccgaacagcacacaacacgatacagatggcacacgaacaaggcaagaaaagacgaaagggaacaacagacagagacgaaaagcggaacgtgacgccgcgaaaaagacatgcaggagacataggagaacatgccgcaccactaacagacaagacgaacaaagaacgagaaaaaacgggggcaagaaacacagggacacacagaaagccgcagcgcaacagacgaaaaggcaccagcaggacacaggagacaaaaagaacaacacaacagagaaacacacgcaacaacgcaagaaggaaagaaagcagaaacaacagacgggaaacggacgcaaaaataagaaaaacaaaaaacgagcgaacggagacgacacgaggaacaaaggagcagcgaggaggacaacagaggacagaggaggaaagaaggcagagacagaagaaaacagaaggccgagagaggaaaaccaaagagaacaaggccagaaagaggagaaacgaagacagagaca

SEQ ID NO: 676176 - DNA, 282 bp, Homo sapiens
cgaacaggacacgcgcgagttgccgcggctgctccaactcactgctcaccctcttctgagagcaggaaaagaaccctactgacatgcatagtttaacttcctcatcagaactatgcccttacttgtgtgcttttgcgctttcaaataactaacacgaactgccagaaaattaacatctgaacttagctgcacattctaaactgacctttccccgtactaacggttggttcccccgagtggcatgattcctgagcgttcctactataaagcatggaacatgca

SEQ ID NO: 676177 - DNA, 347 bp, Homo sapiens
  misc_feature (345)..(345): n is a, c, g, or t
cagcttataactgttgaaagccagacaaaaaaagaattctaaaatcaataagagaaaagtgtcaaatcacatataagggaactcccatcagactaatagattcctcagcagaaaccttacaggccaggagagaatgtgataatacattaaaagtgctaaaggaaaaagaaaactgtcacgcaagaacactatactcggcaaagttgtccttcaaaaattaaagagtaataaagtctttcccagccaagcaaaaactgagggcattcatcaccactataccagccctacgagaaatgcttaacatgttctacattctgaaagcaaaaggctgatatttgcatcatnga

SEQ ID NO: 676178 - DNA, 335 bp, Homo sapiens
atgagagaaatcaggtggcttctctctcatcttactgttctctgctgagatgggtccctacctagaacattccctctgttcagcactaatgttcactcggatgtagtggaagtgcaagaaactcaattggtgtctgtgtacaggctctctctcctcactgctcacaggaaggggttctggatcgggggatttcattgtgtagctgctgagatgtgaaggcaagcctcagcatctgcccccgctgggtggacatggctgcttcctcgaggagaagacacagagtccaaggggcaggtcttgaggttggcttccactctgccttagaagttaatttt

SEQ ID NO: 676179 - DNA, 820 bp, Homo sapiens
tcacgatcgatattcatcagactgtagatctaactatcttcccacaaagctttcctcgagctatccggaatgccccgtacgtgactcggactaaccccgatgtatacaccatatgaatacactcgtatcatctgtggctcactcatgactctaacagcgagtaaatattattatctttcatgatttgaagaagccttcggcttcgaagcgcatagtcctaatgagtgagagggaaccctccataatgctggtagtgactatctgtgatgccctcccagtcctacacaccacattcgagaaagcccggtatatcatacatctagactaactgccaggaatcgaaccccccaagagcttgttggcaggccactcccatggactcaagtgacgtttgagcagcaagaaaaaaacatgcacatgaggagtgccagcagggcgactaacttgaccccagtatggaaacaaaaacaaaccagatgggggccgagacctgctgcgcttagatcactgcagcttctaggaccggaacttggactgatcaaagagcggaggacacccccccataaaaagctgggggcgcacgacgtcgctccgacacccacctgggggccggccccgggcccggggtcttcaacgcaggccggcgccgcaaaagaccccgccgggcaggcccagacccgctcgacagcgatccccaaacagcggggacgcccgcgacaacagacctgccacagcgcaacggccgcccaaccacggagacaacaacgcaacacacagcaagacaccaacacacacacacaacgcccacacaccacaacat

SEQ ID NO: 676180 - DNA, 166 bp, Homo sapiens
gaaaagaagaagtcgcgatcccgatataaaccattaaccttccctctacacttatcatcttcagcaagttctaatgctactgactatcctagaaatcgcggtcgccttaatccagagccgtacgttttcacactctctagctaggcagtctaagatgcaattcagg

SEQ ID NO: 676181 - DNA, 559 bp, Homo sapiens
  misc_feature (204)..(204): n is a, c, g, or t
  misc_feature (206)..(206): n is a, c, g, or t
  misc_feature (225)..(225): n is a, c, g, or t
  misc_feature (235)..(235): n is a, c, g, or t
  misc_feature (241)..(241): n is a, c, g, or t
  misc_feature (247)..(247): n is a, c, g, or t
  misc_feature (251)..(251): n is a, c, g, or t
  misc_feature (265)..(266): n is a, c, g, or t
  misc_feature (269)..(269): n is a, c, g, or t
  misc_feature (277)..(277): n is a, c, g, or t
  misc_feature (286)..(286): n is a, c, g, or t
  misc_feature (292)..(292): n is a, c, g, or t
  misc_feature (294)..(294): n is a, c, g, or t
  misc_feature (297)..(297): n is a, c, g, or t
  misc_feature (299)..(299): n is a, c, g, or t
  misc_feature (304)..(304): n is a, c, g, or t
  misc_feature (306)..(306): n is a, c, g, or t
  misc_feature (310)..(310): n is a, c, g, or t
  misc_feature (315)..(315): n is a, c, g, or t
caggtcaccagcgaaaagatttattctggctctcaccaccggtgctgaaagactttataataatatatttcaatttcatcaacttcggcagattgccaaagaactaaacattcagggtgctgattttgaaaatttaattggatcactaaatgaccagggttacctcttgaaaaaaggcccaaaagtttaccagcttcaaactangnaaaaggacttcaccaagtnagggcctccngggttnatgcanaatnaaagccatcccagnnaanaaaagcgngcacgccanacagcngnccncncaccncncacncaccncacacacacacacacacacacagtcaaatactgttctctgaaaaatgatgtcccaaaagtattataataggaaaaaagcattaaatataataaactaatttaagaagtgataaagtctccagatgcagtggctcacactgtaatcacagtgactcaggaggctgaggtgagaggattccttgaggccagggttcgagaccaaccttgggcaacatagcaagaccccatttcttaaaaaaaaaaa

SEQ ID NO: 676182 - DNA, 923 bp, Homo sapiens
  misc_feature (63)..(63): n is a, c, g, or t
  misc_feature (67)..(67): n is a, c, g, or t
  misc_feature (96)..(98): n is a, c, g, or t
  misc_feature (100)..(100): n is a, c, g, or t
  misc_feature (105)..(105): n is a, c, g, or t
  misc_feature (108)..(108): n is a, c, g, or t
  misc_feature (110)..(110): n is a, c, g, or t
cccagatcatccccgcgatttcctgtttattgcattaaggcgccgggttctcgcgctcctggnccgnttattccgcgggggtcggcggggtcggcnnngngccgngcngnctgcgctttgtccgctgggcacactgcttctgggaggggcgggcagacatggtggcggcgccgcccctcctcggcctagcatgccgcgggcgctcgcggtacccggttgccgggtccctggagcggcagccccggggtgggatggggtcgcgccgaggcagcggaggttctgcgggcgactggaggttgtgcagtgttgcgtggacgaccagaggaacgtgcaggcgcggtgggcctcgggcctctgggggcgggggaacccttggtctcggaagtctgatgggcccctgcgggctctccggagagggggaacggggcggcgagggtggcggggtcctgtggcgccctgtgcttgcgggctgagaggcgctcgggtcgcggggggatcggcggaccagaacaggttaattggcaagaacctggacaagtcccgctgctgtgggcccctgagcgagagctttggcggggggacttggcggtcctgacggggggagaaggctgccgttctgaaggctcggaattctgcccaagattcgcgcgagaactgcgtgtgcctgcttcagggaagacgtgagaattttgcaggtcattttgcagggcaaagtcatcatggttgtaggtgtacggggagtctccagtgtgttgatcaggtgctagtcaggtgtgtgaaatgaacaggatgtcggctgttggtgttccattaagttggtagacaaatctgttactgatgatgtgagattgcaagagtcaacacactttagggtgaggaaaggactcgggggaacgaacgactataatggggtaatataaaca

SEQ ID NO: 676183 - DNA, 1109 bp, Homo sapiens
agggaatgttcttgtctttggcaaaattgtcgacggtgtgtacccgcaacacgcctttctgctcgaaccacgtttcagatgtccccagcctgtgtggcttcatatgggatggcgtctccctggcccgttccagggtgccaacgatgattcgtcaccagttcgaacccaaggctttgatacgactggtggtccatagccaagtgactgcggaagttcctgggggtgcccccaggtcaaggggcaagtcgttcggggccccgaggggccccataaacggggaacaagggccttgctgatttccggaaagcagggttggcccgggggcattagactttcctaccattgtggtcttgctgagcatcaacgtttgatcttcccccgacccctgaggcacgtacatccattcgagcttggcaggcagcacgctgctaacaacccaggccatagtcttaacctttgtgcttccccacggagcagttccactttaggaaagattgaggagcttctcagctggagagaacaggggcccccattcatgctcccctaccagttccaggatcggaggagatcgagggcattcctgctatcgctggtcaggagatgccatgcggcatcagtgaactaagcaggccattcgggaggcaagatagaaggagatacaaggaagagctttctgcattctgagaagcttaagacatactttgaagacaaccctagggacctccagatgctgcggcatgacctacctttgcacgccgcagtgagtgaagcccaacctgggccatgttccttactacctggttcctcctgctgtccgtggcctggtacgccctcacaagaagcggaagaagctgtcttcgtcttgtaggaaggccaagagagcaaactcgcagaacccactgcgcagcttcaagcacaataggaatacgaaattcatgacccacagctaagaccctcctgaggttgttgggcctctattggagcgtgagcacattgtggagcacaggcttacacccttcgtggacaggggaagggtctgtgtgcttactgcacagcctgaacagacagttctggggccggcagtgcaggatactcgtgcgtggaccttc

SEQ ID NO: 676184 - DNA, 254 bp, Homo sapiens
atgtgatacagaacacggttatggaatcatagtctatcatgactgtaactcaaggcagtcaagctgcggcgagatagaattggtggtggttttggactccatgattaagggtgttcacatttcacacactaatcccctatcagttgcacgtcttcgcaaacctgcatataacccgcaaaggcctcgtgatgtcctttggtcccaattagtaacacactcccgtccgtggccgtttccggagcacgcagcacggg

SEQ ID NO: 676185 - DNA, 635 bp, Homo sapiens
ggcacgtctggagctctggctcgtgcagtagcgtcacgcggaggggagggagaactcgggaacagttaccacctatttgcaatccaaggagaatataagacagagaagaaagtgtgaatgaattctcattgtgattagcaatagatgtggacacctctagtgatctgtgcctctcctacaactctcttccacttgacctctaaatgtggaaagtgtcccaggaatggtctttagaccttcttcctttatctacatttccctctccaagatgaatctgtgatggctctggaaaagatctcggaaaagagggaatatccttctgtgtgtgtgggcagagaagatgacttttaaaaattctgaaagaaatggacagcgtgtgtgtccatgatagagaagtggtcattttctaccacagggggagaatatcagtgctatggaatatgcgtgttaccactcaggaggaccttttacatttgggagatatagaggatttgatggacagacggtgtatagttgtgcccgtggaataaaatacaaaattacttgtggcaacaggagaaggtctgttaccagtctataaacctaaagatccatcagaaaacccaagtgggtgttcaaagggaataagcaaggac

SEQ ID NO: 676186 - DNA, 109 bp, Homo sapiens
cctcataggaatgtcacaaggctaaatgctttttcatacatatattttgccatcaaaggggacatgcttctgtgatatttgtctagtcatacatttgatgttttcttag

SEQ ID NO: 676187 - DNA, 219 bp, Homo sapiens
ggagcgagctgcagtgagccgagattgcgccactgcagtccgcagtccggctgggcgacagagcgagactccgtctcaaaaaaaaaaaaaaaaaaaaaaaaaaaaaaaagccccttttccccaatttttttcctttttttaaacttagggggggcccctctaaagcccccccgggggctttgaaggttgggagggggcggggtttaaacagggcggggc

SEQ ID NO: 676188 - DNA, 147 bp, Homo sapiens
ggctgtacggaggctgagatgggaggatcacttgagccagggaggtcaaggctgctatgatcatggcacctacactccggcctgggtgacagaacaagaccctgtatctataaataagtacgtacgtaaataacaagaaaaaaatgt

SEQ ID NO: 676189 - DNA, 1182 bp, Homo sapiens
  misc_feature (619)..(619): n is a, c, g, or t
agcgggtcagacacgctgtgacggctgcctgaagctactgagtctcggtgcccctgcactggtggttgtggtcagtggcggcgccgcctggatcgggcttctttctacctgccgacggctgcctgttggcggcttccatggctggccgggcgcggaggtcgagctcgcgtgtgtttcggccaggtcgttcatgggatcttttgcccgagcgcagcagaatggatcgctcttgcgaccacctctagctaatctggatcgcggcctaatcccaagtgtgccctgggcgttgactgcggatgtagagtcggatgccccggggagaaatggcagcttttccgaagaagttcagactctggacattactacacctatggagaagggtccagttactgtgccgttgtgcggcaagacggagaccgttggcgaaaaaaaagaggaaacacatccgaagtgtacatgtttttccatgacgaggaacctccaatctgcaagttcgcttttagctcacagaataggtttttccactacatatgtagtcaagtgcttcgtccaatcaaaaaggggaagagatactcgaatcatgcttgtggtttggtggaaacacgatgtagaactaganaacgttgataggaatactgggaaatagtaagatgtatattagacctataaatattggaacgaaagagctctcgatagggtactcaaccgtaactaaaggagaaatatgatctatcactaactataacttgggagaaagacgaagacatggcttttaaccgcgaggaccatttggacatagggtgaaataagctagaggccacggacaagacatttgttgctggaaattgcacgttggagaaacctacaaaggcatgtgagccacaatttgcttcccgagttgaaagtcaccctttgatgtgtggcaggaatgaaagaccgcggataggaagagcgtgtacccaattaccccaaacgtaacctaatccgggcggtgagataagacgcccacattacagaaggagaatgtatgagccaaaattataggccaagcccaggggggccttggaagggtaacaaggactgaacgttaaaaacgtcccccgattttaaaaaacacggatatgaaagaacattactttgaagagggcacctaaagggaaatcggattggcgttccgccaat

SEQ ID NO: 676190 - DNA, 378 bp, Homo sapiens
agcctcggaatgtgtggtgttatggttgttgtaaatctggtaatgcgagcactggtgttgtgcagaggtaatctttaaactctatgaatgcctttgttgagattcagaccaaaagaattttgctttcgctcctcccttggtgacttgaatcaagggccaagtgatatgagaaaatcccaacacgaacttgcagtagaagttggcaagacctagaaagttgcagagctttgtcagagcggttggagatggccaatcctaaatgacttggatcttggctagatccagatgcacccctgttcgtcaataatgtatgccagatactgaacctgggtcatgccaaaagtgcatttctccagattggcataacaccacacaatt

SEQ ID NO: 676191 - DNA, 962 bp, Homo sapiens
ttcagttgaatgtaactgcttttgtattggagagagtgactatgaacttgaaaccccaaaaaaaaaaaaaaaaaaaaaaaaaaaaaatagtttgggggccgccgcggcccctcgaaaaagcttccaaaaacccatcgcgttgggggcggcggcgggccccagatcggctacggggaccggtgccatagcgtgtaccaaaggagaaaccccgggtccggacaacgtggctgggactctctcaccccaatataaaaagaggcccggggcggcaaatccgaggcgttttgtgaaccaaatccagagtgaagtcggaggctcatcaggggatctccatcaaagagggacgtccaggggagccggaataatacaaaattataagccccccgcccgggggaccaacctcaccccacccagcggaacgaacaacgtacacgcactcgcgacacacagctggaagcaccaccaaacaggcgacggcgtaaaaccagtacaacccgacaccacggcacgctcaagccacgatggtccaccacccctcacgcagcaaacccaagaaccacaacaagctagcaacacacgcggcgcacaacgaacaaccgaccacaccgagcacgaccgaacaaatcaacaccgccggaaaccacacccaaggatgcgccggcacacaacaccaatccgaaacccaaccccgcgcccaacagcacgcgactccagtggacgcggcggcaacgacaaactaggcgacccaaccgtggcacgcacggcaccccccaccgcacacaaccccaagcgagcaaaccggaaaagcggcaccaaccccatgccaccccgacaaacggcacgcaccgggaccacgcgggacaggaaaaggagacagcaatccagcccgaccgcaccagcacgatacaacacccgcacacgcgacggacagacagggaacaagccgccacgcacggcacgcc

SEQ ID NO: 676192 - DNA, 436 bp, Homo sapiens
  misc_feature (96)..(96): n is a, c, g, or t
tgtggatgatgcaaagaatgcgtgattgcatttcacataaaaatagattaaaataactcttcaagtattgcacagcatcttaataaaaggatacanattatacagtatataaaacaggtgacagtgccctctggaggatgctactgaaatttggcaccagctacctattcaagaatgctgcaggtaaaattgacattctttcatgtatcagaatcagtgtgcttcgaaaaatacaagtgcaatgaaagaactgttcacactggttcttcaaacttgtcctcaaaaggcagcctttgtagtactaccagcttaatgcaaggatgtagatggggtagtattggtttttataattacaggagagataggttgcaataatcgaatttatgaaaagtgttatcaattggttactaagaatgtcgacgcggccgcgaattta

SEQ ID NO: 676193 - DNA, 944 bp, Homo sapiens
cggcaaatagtaggtctggagagcgaactcctgaaggctccattccattgtgagcagactctccctctggaatggggccactgttcatgaatggactgcattgcatgaggatggacactgagataggacattcagaacatgagaaatatgccaggcatccccctcacacgggctggatggggtatccagctggctttgccactgtatgccaacaggatgaagaggtcaaaagtaccctgagcatgctgcccatgatgctgccaggcatggctgactgtagccccagatgtttggtgtcgggaggactcctcagataccaccatggcaaaccacctgcacttccacatgctcacggagtctctatcacagcacaacgacacagtggtacggacagtgactagaaaagactgcggaaggacaagccgagatagccaatgatgtgaatcaccagaacactatacagactgaggacaacgccctggatccaggatccaatacgcctgcatcaggatatgaagcctgacaatgaactactagtagtcactgtggcatttataacacacattatctacaaatccccagagaagttatactacttgaaagtatcatttagccaaatccattgataccatcttacccatgataattgggcataggttctgaaacaaccaaggaacgaagagcagaaacacatcggaacataggtcaagtctatgaagaacactagaacgagttgcagacaaggcaatgacgatcacacaggcgagtaaaacgccacaaaaactaccagccagaagacgcttgaaccacaagagtgatgaaaaaggacgctcacacggctagaactgaagcacagatgcacagtaaacgaaattccaataatatggcgcgacagacacagaaagcattaggcacacaagacagcgacaggtgagattagaaga

SEQ ID NO: 676194 - DNA, 323 bp, Homo sapiens
  misc_feature (249)..(249): n is a, c, g, or t
  misc_feature (286)..(286): n is a, c, g, or t
ttgcccttgagattctgaccggtgggaacgaacttcaggctttcgcgtcaatcatcttggaccagttaccggtatgaccctcacgacgtccctcgacacgaagttcccggttctgagatccgggagcggttgacaccacggtaagcctgtcggtgatctcgccggggatcttcggctgatgcttccacccggccggtggaagtttgatggcagcgtagcgaggatcgaccttgccctgcagccacgtgnaagactgggaagattactctggtcctgccaggtgtancggaactgggcgggatcggtcccggcgatgtcgtagt

SEQ ID NO: 676195 - DNA, 1154 bp, Homo sapiens
tggagtagccaacgtgccatttatccatgtgaatccactatcactgatataaacatcttctagctctctattactaatgtctcacctactagaatctccttaattataacattcacagccacagtaactaaatcatagttttattatctctcttcgaaaactcagttatccccatcttggcctatcatcactcggattgacggcagacgcagtcgcgagaatcgccctgagacagcaaggcagcatatctgttccttagtatctatcagctcccgtagtttaggacttgccccttgtgcctcccttagcttcgatcagcacctaaaatttcaacacatcggcagagcaacgccctagggcatccacgtaccacacatttcttacatagcgtccacaccgtctatcgtgtcgcctataagaaaccctactcaaaatcttcctttgtagaccaatagcggaatcgtgtacactatttgacctacgcttttacctatcgaactatgcttttctattagcgtactagatagtagccgtacctttttaccggggagctttctcaaccttttagtgggaacattcccctttagaaaagccccctagtggctcgaataggcacccccacgagtccggccttggggaggttccacacttaccgtcatcgtttggtcgcggtcacgatgagctccttttgaacaaaccttaccgtgccaggaccttattgcgtaattaaacttaaccggtcccatttcatcacccttcattttcgtcgaaaaccacgcgcatgtaagcctaaaacaaccacacaattaagggccctttacccacccgtatccctttttgctaagcttaggttcctccttaattgacggttcattttaatttttactctaacacaaatgatcttcccattctttgggcttaaccgaacaacacatcgaggaacccttacacaaattccggcttccaattttggacaattaaccttccttttccaagactccacagaccccaacattttaggacccactttcggtttcagatataaccccaggccccaattttcttccaattcccaaaaatagtcccccccctttacaagtcgtttctcacaccggggatcggtcaagggtccatttttcctccacttcaaattc

SEQ ID NO: 676196 - DNA, 251 bp, Homo sapiens
cacgaggggacaccaggcctgcctcgtacggtactttgcctccagcctctccggcaacttcatttaccgtgctctgcccgaccagatgaggattttacccccaatgtgtgcatcgctgacacgtgcggactcggaggtaaatttgacccccatcttctgcctaaaactgcaaattgtagaaacacactcagagctattgcagggtgtgcccgatctgacctcgcctcactgaggaaaatacttgaccctag

SEQ ID NO: 676197 - DNA, 222 bp, Homo sapiens
gccgatcttatgatgaggaacgtcactatgtttcgtgtttgttgtgtttttgtgaatggagtctcgctatctctcccaggctgagtgcagtggtgcgatcttggtcactgcaacttccaccttccaggttcaagtggttctccttcctcaggagtattatgtttaaacttcttttgttttatcacaatatatatatatcttttttgagatggagtcttgctc

SEQ ID NO: 676198 - DNA, 354 bp, Homo sapiens
cgcccattgtcctttatggtagggttgcttatacttatagatgcatcccctttgtatacatttccaacccattaaatccgagatactgtgtggctgctgctggaagggcgatatgtccagtctatagtaagcttgtcagtgacatctaaagttcccttgaaagtgcatttcaacttgatcttttctccacgcataacctcgaacatgggcatctgcacgaatctccaagaaaaagccgatatgtccaccctggaagaccagatcgctcaccagagggtagagagcgcagccgcggcttacagctgctcctctctactgcatcccggcatctcttcagatgcatgcacaccgtgt

SEQ ID NO: 676199 - DNA, 576 bp, Homo sapiens
tgggattccccaagcattattcaaaaacgggacagcagctcttttcactgggtaacctcttgtgggcaagagacaggaacttatttacagtagtcctgtgggttccgggcccatataatgaattatgtatgaaggcttgtgctgctggtggccttgaatctctcagatctgggtcttttagccttacggccaagtagcttttattctgggatgacagactgtacttttggtactttaactttctgggagtcatttcctttttcacagtcttcatttttctttggcaaattaagcttctttcacctttccggggcgatttctggagtgtagtctggtgaagctggggttaacttctccaaaatagtgtcgggaaggaggtttcttttcttctgttcgatgaacagctcctcggcgtcgcttcctcttctccttcaggagcgttttatccctggcgcagggtctcccggactcgccggtcctcttctctcggttccgccggggcgctggcgaaagtcagctcctcgggggcctcatcgtcaaactcatcgtccccttcctcgttttcctccaggggct

SEQ ID NO: 676200 - DNA, 191 bp, Homo sapiens
  misc_feature (64)..(64): n is a, c, g, or t
  misc_feature (117)..(117): n is a, c, g, or t
actacgcgcatattaaccaggctgtctcatactcctgaactgatgtgatctacccgccttccanagtactgggattacaggcattagccacataataatttaattattatttaaatnatttttaattttaaaaatttaaaaattattttataatttaaaaattccttggcttatttatactccatggacag

SEQ ID NO: 676201 - DNA, 281 bp, Homo sapiens
tgaacattcgtgtccagcagagggaagacggataacaaagcatattcacaagtagagatgagttgtgtcaggttatcctattgtcgtgctataacacattaccacagatctagtggtctaaaacatcagaaattcattctgtcccagttattgacgtcagaagcccaaacaagtcttgcagggctgaaatgacggtgtgagcagggctggttccctctggaggctccaggggagaatctgtctccttgactttctcaggtctcggtggacacgaatgttca

SEQ ID NO: 676202 - DNA, 139 bp, Homo sapiens
ttgctacaaatatagaaccccaggaattactgtgtgcaaccagtcagagtttcaatcagtgaccacagaatgataactatttacccagcttgtcaaggtagccagtagttcctgggagcttctcacctgatctggaact

SEQ ID NO: 676203 - DNA, 450 bp, Homo sapiens
cgtgggccctagttttagaagtatcactagcatcacgcatagccgtctgctgattgaaatcttcctggatagcgttcccccacgagtttcgtaaggcgttgagatgctctgtgtactttcacacatattctgtcaatcatctgctgggtggtgctggtgacaataccctgctgcaggtggtaggcctgctcttgaaggtatttactagtctcgtgatttcgtagcaggtagtgtactatcttttgcagagcgtcatctgttgataccgggtttgtcttacgggcttgagaagcatcatacataggacttgggataaatcttaatgtgtagttctttgccaaagcaagaggtatatgctgaaagccttgtgccgtgatgtagttcttgtcccatattacagtcctgagcttagtgttgatcggcagtgctatcgaaagttctaaaactagg

SEQ ID NO: 676204 - DNA, 483 bp, Homo sapiens
ctgccctgtctggaggagctgagcccagcgccactgctgcccacctgaggtccgaggtgctctgtcagtggagcaggagtgcagggtgtcccagaggtggagaggaggagaagcccggggaggaccatcccaggaatgtaccccctcccctcacccacatccttttcctctgcttcctgcctggagcggaaatcagctcagatttggccgaggaggtgagcggaagcctcgggcagcaggggcctgggggcgggctggggagaagcagccgcctctgcccagagtaaggagcaggcttcgggtgcgaaggccttgggcatccctggactgcccagtcggggcctcctgtgggtcccgaccacaccagggctgccactgcccctggtacccctaaggactgcagcccaaccccttcagcccccagcaaccccagcaagggtgtcatttcacagatggggagggggaggctgagacggggaggcc

SEQ ID NO: 676205 - DNA, 352 bp, Homo sapiens
ccccagttacacagcctgctcatggctcgtgatcatattaccataggataggagcatacagtataaatcgaaagtgacagctagataattcgatacccatagccatataaagtgacagtactgtgcttgctaagttggactctaggatttccggcgcgtaggtggtcagcatttcatctcgataagcacgtgctgtgtacaacctgtaagcacttccctgggcctgttctcccagctctgccacctcgttgctttgcctgatcctgcgaaataggcgtcaccaccatgctgttcaatccctgtcttgtgctgttctactgaagctgtcttacttgtggcgctcctctcccat

SEQ ID NO: 676206 - DNA, 1093 bp, Homo sapiens
ggctgccatcagccgcccgggagatatccgccgggggagaatagggttgcaccatcccaggaagctgctgttagctcgccgtgtcctcgtgcacgccgcaccgttcgcccctgctgctgtcctgcccttcccctagctgttacttccgtgtccctcgctgagtggtgtgttcgtgctgtgctcccagtgagtgctgtgaacctgctggaccatgagcgtgggcttcatcttggggccggccagctggcctatgctctggcgcggtggcttcacaggccgcaggcatcctgtcaggctcacaagataatagcccagaatccccagaaatgaacctagcccacggatgtccgcgctcaggacagatgggtgtgaacctgacacgcagcaacaaggagacggtcgaagcacagacgacgtcctgctttctgtgctgtgaagccacatatcatccccttcatcctggactgagattggggccgacgtgcaagccaagacacatcgctggtctccatgtgcggcctggattgtcaaccagtcagactctgctggacgaagaacgcgtgatggcactatccagagccagaaccccaaaacgtgattacgcaatgcagtgaccaaacaacaccctgtgcgtacgtgacacgcgaaaggcggcatacagcgtacagccaccggagacacacccaaatagcccccatggcctgcgacacggcaatgcagggcaacgcatacacctgcgaatctaaaccatcaatgaaagccaaacagatgagagcaaccgtcgcaagcagagagcgaggcaaaacaaggacacaacaaaaccgaaaataaccagtacacaaggagaggtcaacaacgccgcaccaacaacactgagcacccttgcccccatattgcaccatttacacattggagcctcatgggtcacctgaccacttgggaccatcacactgagtacaggactggacacacaatctgcgcgatatcagaccaccactggtagtcccacagtggctcaccaccacaactactccgaggcagaccaccaagcagtcatctcacgcccaaggtaacaagacgtagcccagaaaag

SEQ ID NO: 676207 - DNA, 383 bp, Homo sapiens
atataatggacattctgaaagcctaggctcatggaggattttgcgactgtacattaaggcatgtatatttgacacaacacggggatacgaatactaacagctgctgctcttggtacactctgatattgtcatatagattttatgctattgctgtttttgaaccactaattgcataacccaatgatgtgacgatattgacatttttgagacactgctataaagtgtttgacctatcagggatgtggcagatgtaagtgatcactgggatgttttcacttccttgacctggaaggatcagttcatgttggtgctgagctgaataggattcattactatgggcaccatggcattcccatgcagttactgttctcaggctgccatgt

SEQ ID NO: 676208 - DNA, 1219 bp, Homo sapiens
  misc_feature (273)..(273): n is a, c, g, or t
  misc_feature (291)..(291): n is a, c, g, or t
  misc_feature (300)..(300): n is a, c, g, or t
  misc_feature (607)..(607): n is a, c, g, or t
  misc_feature (931)..(931): n is a, c, g, or t
gactacgcgtatgctggtacgacctgctggacctatggactggatgcttgaaagagtccgtgtcccgtaattgcttaaggatgtatgtctgctctgctattattcatgagacggcgtgtctccacaaggtacctcttgggaaaaacgacccttaacctgcgtggtttccaggcctaagaggccttcgatcaatgctttctacgaagataatggagacatttgcagggattgagtgtcgactcttctttaccatatgagataggctactactgnccaactatcatatagatncgtcagcgnttcgtcgagtactgatccatatcgctcacccgaatagtagaagaagaaaacgagacctatgaagattgggtattaaggacgtttgtatttctcatagtacatatgacaaagagtaaagccaaaggacaagtgaaaaaaagtactcggcatacagggttaggttcgcatagtggaatataatccccaagcaatttttggcaatggagtatatggataagatacttctaattcgttaagattgacacgttctatgaatctaaggtaaggtgttcgattgcgggtgcggtatctgatagagtgattggtnatgctcgtaggacacgtagactggaatggttgtggcaccttacttataataaatgacctagcgatagtggaagatttgggcaccgaagtggcagtattaatatggttaggtgattcccaaacataaaaatgacatggaaagtaaaacgaaaatgagagcgattgagactaagagtaacatttgaggaccacattgaatttttttcctttcaatattcttaatcagtgtcgtaacttaggaataggataacttttgaactaggaaagttggaggtcgggcttcgtataaattataaatttaacctgagcttggggttatagacantaaagtcaaatttttacttaacccaaagggggagtacaattctttacccttggtcatcctaagcgtcgatgacagcctactattgtggacctccccgtttaaaggcgtcgttactctccacggatcaagttaataagatcaacgcaataactttaggactttgatccaagggccttctattaattgcgtgagactttccccaagctaactctccatgcttgtgcttacccgaaagcacactttaacgttcactttgccggagaataacaaatttccataggagaagaa

SEQ ID NO: 676209 - DNA, 771 bp, Homo sapiens
atccctcttgtgctgagatgatagcaagtggcctgagatttaagcaagctcctggagtctgatgcttctcgcagtactctgatcgcaactaaacattgtctatgttttattagaaactagtgaaacaaagcaggttgtcccacatgtataaaatacagggcgagctatttagttttctttacagagaagtgatcctgtttaaggtcttgtaaggccctctggtttggacaaaaaccctcagtagagacgaagcgggaaggactagattagctgaaagctatgatgatataaataaaaacagctctctatcccaatacgcacctttgtatttccaagaactctgtctatgttattaaggaaaatgtcagattgtgatgtattaagccagtacttcaattgacgggttgacttgggatgacatattacatgctgtagtataaacatttataattctttttccttgtcttgagtattctctgtctctgagataaccttttactgggctttatctagatagctgttatttgattccgagtggcaaaagatgttattcattacggtatggctataagctgtatgatacgagaactctttttggcataaatatttgtgtccccagtacctcactgttcggatttgactgcctgaatatgtttgcggacatggtcctgtttgggggtcggtgaccgtggcctctagttgtaatgttaattaatcttggttctaactgtgtgtgcatgttgtgcgacctggagcttagctggggagacc

SEQ ID NO: 676210 - DNA, 553 bp, Homo sapiens
aaggctgatctagaggacccccaagcagtaatacagactcaataagatcactgcacttggatcttgaaatagcctattagtttccttatctgatatgtcgaccagacttaaactagtgggatctaggcatatatcttttataaaaacctggtgctcattaaggaaaggaaaatattctgaaataatcgaaataacctttagggcattggaactccattttaaattaaaaacatttgtgcctactattatacttatgctaaattatacccaggtaatagtaagtaaaataattttgaagttactattgtactaagaaactatagagattcttggcagtgtaagacaaagtccttaaatcacatatatataacaattgagacttagtaccttatgacttaaccattttacactgagatattaattggacatatgagtgtacatggcaatcacgtgatccaagtatttgagacgtgaatatctaaagtaagagaccaatttaaaacataactaatgagcatcatctcataatttggtaatactcatgtaaaaagct

SEQ ID NO: 676211 - DNA, 93 bp, Homo sapiens
ctagaagattcagcaaagtacttttgtgctcttgggggaccacccgggcttttacgttgggggatacgtttgacctacaccgataaactcact

SEQ ID NO: 676212 - DNA, 127 bp, Homo sapiens
atagaagccatgcagtagacaagatccaaaatacgtggcatggtggtggtgtcaccgattatagagatgggacagatactaattattactcagaaaaaggatttcctaagagtggctgtaaactgga

SEQ ID NO: 676213 - DNA, 898 bp, Homo sapiens
  misc_feature (897)..(898): n is a, c, g, or t
gccccactggctgctctgaaaagccatctttgcattgttcctcatccgcctccttgctcgccgcagccgcctccgccgcgcgctcctccgccgcgcggactccggagtttatcgccagagtccctgaactctcgcttctttttaatcccctgcatcggatcaccggcgtgccccaccatgtcagacgcagccgtagacaccagctccgaaatcaccaccaaggacttatacggagaagacggaagttgtggaacgaggcagaacaatggaagagagccgcccctgctaacgggaatgctactgaggaaagtgggggagcaggatggctgacaatgaggtagacgaagaagaggagaaggtggggaggaagaggacgcgagcaacgaacaaggttgatggctgaggacagaggatggatgagtgaagatgagtgaagctgaagtcagctacgtgcaaatcgggcagctgaagatgatgaggatgacgatgtccggttccgaggaagcagaagaccgacgaggatgactagacagcaaaaacggacgcgtaatctaagaaaaaaaggccgcgggacctatacccttcaattcccgtctcaaaaattaaaggtggtgctttctataggagagtgcgcctccaccgtggtggtgtccccgcagatgaaggggctctcacaaccaccaactgtaattgccacgggtggaatagaccaagttccggcccgctttttctaagtgtgacaggattgtgtgactcatactattttggcactgtggcccccttatagttgtgtacagactcgggtgacatcaagtggggcgttaccacgagagactataaagaaacctccctgttgttagtgtcgcaccttttttctttataacacaatactgcctnn

SEQ ID NO: 676214 - DNA, 206 bp, Homo sapiens
tgtctagagatcctgggtgatgattggatatctgtaagatattggattgtgaagtgtcctggtcatctgagagtatctgtgacatcttagtgtttgtttgttttttcctcctcttttttgggggggagtgtgtgtggggatggaaaaaagcgtggtttttaattcattaaacagtggttaagcccttaatggggaggacggacgga

SEQ ID NO: 676215 - DNA, 125 bp, Homo sapiens
gactctacggatgcttagaatcgtggtgctgctgcccttccagttactggggacagctgaattccagcacaccatggctaatggagctggggccttggttgatgagctcgatagacatggtggac

SEQ ID NO: 676216 - DNA, 173 bp, Homo sapiens
agctcccccagcaccgaagactgcgatgacttctgcactgacccaggggctggagcgaatcccagaccagctcggctacctgggtactgagtgaagggtcaggtccttggcgtcaactggggacctggggaatgattgaccaggcagccaagtcccattctttgaggctggtc

SEQ ID NO: 676217 - DNA, 542 bp, Homo sapiens
  misc_feature (54)..(54): n is a, c, g, or t
  misc_feature (78)..(78): n is a, c, g, or t
  misc_feature (128)..(128): n is a, c, g, or t
  misc_feature (176)..(176): n is a, c, g, or t
  misc_feature (187)..(187): n is a, c, g, or t
ccccttattcaaggcccattgcaaggttcagaactggctttaagacccctgttnagtcccatagtgatatagaccccntaaaaggcccaaccaagccaccattgtccatggatgccaaaattttaggncagccataatccaagacccaattgacaaatgtgtacctctgtggcacncaataatttancacaattacaattactgataacgttcactaagttaaatcagaattacaggagtttcccatcattttggaacacataccaataacatttatacaaatatagcccaaagaaaaccaaacatcatttcatatttgacaatgctccctgtctaatttttataccaaataagccaaattatgtcatttttggactttaggggacctaatatcttaaaggattaattaggtcaggaaaagacaatttataaattgattttggaaagtttgtaaaatatcaaaggtttaaaagacttgataccatgaaataggatcataggtcattgtaaaataagtcattcatttaaccaaagtgataagg

SEQ ID NO: 676218 - DNA, 340 bp, Homo sapiens
ggtcaactttcctcaaatcaaaaacaggcagggacaggtagtgggctcccaacgtttgcccccgcctggtttttttaagttattttggacctttttcagcagcaaaacccaactgggttttcagctttatccccgtttcttgcaagggaaaagcccttatacaattgggcgccttttggtttttcccccttgagaattcaaatcctcttttggattgtttttccaataatttgtaaacaaatttatttttccccgcctttttttttttttttaattttcagggcaagttttttatactgcccttatttgtccaaataaagattttcccctatgccggtta

SEQ ID NO: 676219 - DNA, 364 bp, Homo sapiens
  misc_feature (35)..(35): n is a, c, g, or t
  misc_feature (333)..(333): n is a, c, g, or t
  misc_feature (343)..(343): n is a, c, g, or t
acaccacacactcggacctacctgagagtagcggngtgggaaaacggagaggttgaggaaaagtaactaatgggtactaagcttaatacccgggtgacaacataacctgtacaacaaatccccatgacacgagtttacctgtataacaaacctgcacgtgtactgctgaacttaaactaaaagttaacaaaaggccaggtgcagtgtttcacgcacgtaatcccagcactttggggaggctgacatgggtgggatcgcctgggggtcgggagttccgaggaccagcccggaccaacttaaattgccaaaaggtttagcttaggatgttgggtnggcaggttantccccagcttcctcttggggg

SEQ ID NO: 676220 - DNA, 390 bp, Homo sapiens
cacacccatgcttataggaagattgtgtgggacccgcattgaaacgctggccttgatacatggaggaatatcattgccagcaactgcactcaggagcccgaattcaggagtgaaattgccacttctagtcagccccttatttcctatggaaacgacgccttccgcccctgcgccatgctgtcctcacataaagctgaatcagggtcgccgacactgttcacgttggtccatcttcttcctttgctgctgcagtgagcatccttccacgccatcaggaaccacttgatttccaacagcttcagtccactaaccttctgaggacttttttaaatgtagtaccacaaagtgacaattatggcaggcctgccttgaaagaattgtcatttttac

SEQ ID NO: 676221 - DNA, 835 bp, Homo sapiens
ctttggccgggcgctgcttcttgtcccttctcttgggtagtccctgaatctttccacggtgtccttcgtgtccccttctctgtctctgcacatattggggcttctttggctgccggtatcctctcgctcttgctctctcgtcctgtcccttctggctgcatccctggcccccctccctggtgtgattcctctggtcctgggcccctccattgtccccctcggtgtcctgctcgtctggtagtccggatctattttccgtctgtgtgtgggtcctcggtgccgtgctgaggtcgcgtctgatctatctcccctgttccctgaaattcccccggaggtgtgtgaggtctcgtgtagccccggggccgcatgactgcctctccgagcggtagtctgtcaccgtctgtccgtctctccatcagttcctagaactcaagcacagctcccgccgatcctggggcggcgcctgcctctccacccgcagcctgcggaggcggggacttgggtgtcggcttattctgagggtgatcttttgttttccgagtttgggattcggctgcttgggaataataagaaaatcgcgtttgtacccttcttccgcctccacacgatgacgaagctgtttgtaatcggatttgtactctattcataatgcttatgctattatagacggtaataataagaaccaggtaagaaactgcttgcttcgtagttatcggttggaatgtgcagtttaaaggcgccagatcgcttctcgagatccccagggtttactttgtcatactttactggagaaaaccggtcaacgtttgtccagcgcatctgtgagcccccataa

SEQ ID NO: 676222 - DNA, 701 bp, Homo sapiens
atggcacatgcagcgcaggttggtctacaagaggctattcccctatcatagaagagcttatcacctttcatgatcacgctctcataatcattttccttatctgctcctagtcctgtatgcccttttcctaacatcacaaaaaattaattaataatacatctcagacgctcaggaaatagaaaccgttctgaatatcttgccggcatcatcctagtcctcattcgccctaccatccttaggcatccttttactataacagaggagcgtcaaggatccctccctttaccattcaattcattgtgccaccaatgtacttgaacctacgagtaccaccgattacgggggaccttaatcttcaattcctacatatttcccccaattatatccttagaaccagggcgacctgggatcctttgatgtgtgacaattcgaggtagtactcccgaattagaagccccccattcgtataacttattacttcacaagaggtctggcactacaattgagcttgtccccaaattagggtaaaaaaccagatgcaatccggagttctaaaccaaaacattttaacgcgttaaaggccggggttatactaggggcagtgtctgaatctgtgagcaaacaagttcatgccatctgtctagaattattccctaaaattttgaatagggccgtttacctatagaccttacctttagagc

SEQ ID NO: 676223 - DNA, 899 bp, Homo sapiens
aggtttgtctggaggccactgagtatgagacacctgcaggccctgtcttccttccccagtgccccgaggaggagcacagctctcttccagtgctacatcaggtgccagtggtgacgtcttttcagttgactgataaaatggtcttcctcttcctctggctccatacagggatgcaggtgctactctcttcttgcaaggcagcagcagaacctagctgggatgataaggatgatagatagttagccgttcagatcgtgcctcaaactcagagccatgcccatcgtgcgcttgggtggtaaacacacattcgactgttcgtgagatccgatggcgctaggaggtatggagcacgcctgttgagtgtgatcgctactttcctaaggccgcctgcgcgaaagttgtgcccgcctgcatgggcagggcgctcgtctggactccgtacgtggccgctcgacggtgtcgagacgcatggtcacttcgatgtgttgctcggctctgccgtgtagcgcagccctgccctcaatggaccgatgcctgcccgacttcacgcggccctgcctttcgtgttgcctggactggtgagatacagaatggtttgcttgaagacaacgacgtgacatcatatgccatactggaggtccgtccaagacttgagcacaggtacttataccatagctgcttacacattcggagcctgacttggaatggctccgagtaaaatagatgccagtgggaagggtgagcgtttccagtctcatgggaagctcccaatgcatgctggcttgctggtcaacaagacttgggccacaggccgggagagtgcacgtaccaagctgtgtgatctggaggacagccacgggcctgagatgggtttcatctgaaacctgaccgtggcttgt

SEQ ID NO: 676224 - DNA, 110 bp, Homo sapiens
ccaatctcctctttccggacgttgtctgcaggctctcagaatggtccagcgtttgactataccgacgtaggccttcctacaattacatgcctctaacataactaggctgt

SEQ ID NO: 676225 - DNA, 173 bp, Homo sapiens
taagttggcaaaacagcctcacatttattataccaacaatcaatgtatgtggggagatcaaacatattcttctcataggggaaaaatagcaaatacaactgggagaaaagtgactttgtgaacgccacctcttcctcttccctgacttctccccaaccacttagtagcaacgc

SEQ ID NO: 676226 - DNA, 1328 bp, Homo sapiens
ggctacttccgggaggtgcttgtgtgccttgggtgcgggagctacaggggcccagggatagggttataatggtaagtgactatctatcaagcatgttccgtgggttccaggcgccgagttcttagaacgccaacattaccaattgtgtttcagccagagggctcagtgactcataccaagatagaatatcgcttatagaggctattaataccagggtggccttacatacagtaaggctgtcgagtagggggatacagacttgtgtccagtcaatttgtgcaccaacagcagagaaaagttagcctggacagaattgatttggtattcctagcgacagtgcactcgacttgattcaaggatgagactgtatgaatacttggtcttgtaggtgtactgaccctggaatactgacaagctggtagcaggccaggattccactaatttgttacacgcaatggtgcgaccggcatcaatgcatgggctacgagtaaaatctggcgcacatattatcaaacggcttaatgggcgtattgcacggatttccctggtggtagcaattgcttggtgttaagagaagaaactttgtcccgtattaatttatcctacgaggggtcctaaccaagcaacaggaaatgcgtgcagcacattggagggggccatccttgtgggagatgggatggtgctaatgaatgtgctaaatcttgggtaattcagcagttgaccgtagtcagaaggggcccttccagcggttattagtaaacggtggttgaagtgcgcgttgacagtgttttcacataacttggtgggggtttctgcccacccgtccgcacactgggcaagtcggggaaaggttttcacagcagagaacctgggagtcttgaaacccatgtgatccgcctttgtgaacgtggaataaggggtgcaaaggcacgcacaacggttggaatcttgggagcaatttcggccacgacaggactgacgatgggagaccccttgtacacgttttgaccagtttgtcccttggttgttgaggatggttacgtaatcaaactttggactttgtcgaagaaggcgtttttcggacaaaattcggaacagttgtgcgaggtttatgtgtgaacagggtttgaaaaagaatcgtttagagagtttcagggtgaatttgctctatcgtgatgaagacaagaagaattgggatagcataagatttgtaatgggatacaaggtgaaggagagggggaattaaaggaattgggtgggagtgagtgaaccggaagatcacgggagatgtacaatataactgtggtggatcggggtacaaaggaaac

SEQ ID NO: 676227 - DNA, 885 bp, Homo sapiens
cttctctgctgaccctctctcgtagccgcctgccggcgccgcatctgccaaaatgtctacagggtccaactgctgccactggccgtaatcgaagactcagcagacacacaatcacgtagatgcggtgggtggaccataatgcgagtcccgtggacccaggttctggcaccagagaccagaagctctctgagtcagacgaccgttgcatgacgccacttgcaggcagcgcccttctcaatttgaacgcgagcgcagccaagtctgacgcgggcaccctatggctggcaccgcaattgcaagaatgtggcgccatcgggcattacttgttcatgagtcctctacatacatcattaatcatccggtgggtcgtctccttcgattgaagaaccagcgagaacctcacaactgctgtcacagacacacctccttcaaaagactctggactttacaccctggctcatcatgatcaagcttacctacgtgtcactccctaacaacatctctagtgtgttaactgtcaccgctcgacgttacataggacacgtgccctttgttatcactatgcacctccaaatcagacggcggcccgtccaattttgacagggcaccaaccggcatccacgcctgcgccgcttgaccggcacccacgtacagaatgccaacctgaggtacgcgtcccactagggccaggcccaaagacccgggccaggcaacggacgaccactcgaactggaaagagccagagtcgccacaaaaacaagccagccacggacaacggcccggcacaagacacaaaacccggacaacaacgcgacgcggacacgcacagacggagcagcccccaaagccgacaaaacccgcaccaaccgaccagactcgctcacg

SEQ ID NO: 676228 - DNA, 771 bp, Homo sapiens
gcttagggctgtggactacctctcccgtgaggtagtgcgcaactccaccctgttcgcggggtcttcgaacgcgccgtggagccatgtggacgtggtcagcacaggggccggcaccacggggttatcgaagcagctgtcaagatgcttggggtccctggtgttgaggagaaaatgcactggctgccactggtactcctccggctgctcaggtccccaatgctccggggccatggaggtgcttcctggccggaatgtgactacttgggagtctcggggagcctgcatgtggctgagggtagccaccggggggcgcccttggaacatcgccggcacttgttctccgagacagtggaggcagccacgcggaggggcgcccaggggagggacgcttcgataccaaattgcctcgacggattgccacttgtgggacgccttcctggtcccgaagaaacactccccaggacaggacagctggaaacggggtccccagcagggccggacatgggcaatgtgcagcactggaccgcaagacgctggtgcgttcaattgctacagcaacgagtacagtccaacaaggatgcacggacctggtgggaaaggtgccccgtggccaacaatattgcaaagacagtcaggcagggctgacggtcacgaaaggtgcagaatgtcacatggaaaagccacagactgggctgggcacacggcactctatggtggaacggcagacagccgaaaccacaagtgatgtaccgggtcgtacatgctgctgat

SEQ ID NO: 676229 - DNA, 324 bp, Homo sapiens
agcatcaatagaaaattgctgtaggtaaatctcacatttatccgcaacaaaatatagatttaatttttagcttaaactttgtttctaccttatgttagtggacctcagttatccatctgtaaatttctttctattcggctaaactaatctaacagaataatttggctggccaattagaactgccttttccagttggtctcttcaacgcttccctttaacctcttcacctgctcattgtgattcctcctttctagtctaatatcttcccagcgtcatactcgtttttaacccttcaacatttccttcctggctctgcaacaaaac

SEQ ID NO: 676230 - DNA, 357 bp, Homo sapiens
  misc_feature (19)..(19): n is a, c, g, or t
  misc_feature (34)..(34): n is a, c, g, or t
  misc_feature (48)..(48): n is a, c, g, or t
  misc_feature (62)..(62): n is a, c, g, or t
  misc_feature (215)..(215): n is a, c, g, or t
  misc_feature (234)..(234): n is a, c, g, or t
  misc_feature (256)..(256): n is a, c, g, or t
  misc_feature (299)..(299): n is a, c, g, or t
  misc_feature (313)..(313): n is a, c, g, or t
gaaaataagcaacctgatngtaataggagaaagnggtaacctgttttnactttgaattcttnccggcgcgcggtggctcacgcctgtaatcccagcactttgggaggctgaggcgggtggatcacgaggtcaggagttcaaaaccagcctggccaagatggtcaaatcccgtctctactaaaaatacaaaaattagccgggcgtggtggcgggcnctgtaatcccagctacttnggaggctggaggcagagaattncttgaacccagggaggcggaggttgcagtgagccaagatgcgngccatggcacttcngcctggggtgacagagtcgagattcctcttcaaattaaaaaaca

SEQ ID NO: 676231 - DNA, 248 bp, Homo sapiens
  misc_feature (44)..(44): n is a, c, g, or t
caggagcttcccttcccctagtccagattggcaggtggattccnaagtatacacatggcgaaactggatcctggcacgaggagacccaaacgctggtttaaagtacttttcctggagggggccttccagcatgtgggcaaaaccttcaatcagggcaaaattttcaaatgaacattttttgccatcccctaactgcctgcacctgcccttcagggaaatgggggtcattaaaggaaacttaaccttta

SEQ ID NO: 676232 - DNA, 930 bp, Homo sapiens
gcgactctcagctcgtcggggacggtaggcggcgcacccgggtggtctgctcctgtcggccttcgcctactctagatcgcctactccacatatgcgatgaggtgcagtctccatcgcagcgatagtgccgagagctggtagtcctagtatcggcaaacgcctggcgcgccagctctacgtggtctggaaacacggacatccaagcccgcatggctgcagaatgcacaagtgtagaagtgagccattggggagtgaggaggatgtactgctgtgcagtacctatcttgcaatgtgaagtaggggcgctgtggaatacgaccggtgtgccaacgagtggcgtggagggttctggtaaggaacattgcgaaaacccgcatgagctcagttggcatgcacatggtatcggcaagcgtggcacaccgcatatacgactggcattcttacacacacgcattggagaccatgactccattcacccatggtgccaatgtggacatgagttgctaaggacaatagagctagtggcaccgaaggggtcaacttactacctatttgtggcaaggggaagatacatatagacactttgttagttgtgggatcacgaagtaaacctgcaagctggccttggactcaggctgcaccgagtcgttccgagggacttctatggtgtgtatgcacatcacgactattggttgagtggcgaacctggttactgagagtgtcatcctaacccatgtattcactggactcagtactcgtcagtttgacttaatcgtgcgaaagacaagtccaaagcctgtgatgttctccaattttatccacatgataccccaaggtaatccacaaggtgtacgtatggaaggcctaacaagtccaatgctgcaagcaacgaaaaacagcctggaaggcactctgattggggccttcatg

SEQ ID NO: 676233 - DNA, 193 bp, Homo sapiens
cgcggcgcagctgcgagcaggccataccacaggcaatgctcgcctgtgttggctcctggctggacagggaaaagtgcaagcaatttgtggatgcagcacacgccccagctgctgaccctgtgtgcccaggtggctgggatgcccacaccacctgccaggccctcggggtgtgtgggaccatgtccagccctct

SEQ ID NO: 676234 - DNA, 340 bp, Homo sapiens
agctacccatcatgtcgatcggtgccttggccagcgggcccaccagggcgatctcggcggttttcttcagtggcagggtgtcgttctggttcttcagcagcaccaggctgcggcgggcaatgtcccgggcgtcgctgcggtgtaggcggctttcggcgttggtgtcggccgggtcgtcctcggccttgccgatgcgcacgtaagggtccttgaacaggcccatgtcgtacttggcggccagcacttcacgcacggcgttgtcgatgtccttctgttcgatctcgccggacttgagcagccccggcagctccttgccgtacagcgaatcgttcatgctcat

SEQ ID NO: 676235 - DNA, 423 bp, Homo sapiens
aacgcaccgagttgtatgccatgagccggattttccagcagcaggtggtcgatgcactgaagttcacctcgttcagccagccccaaggcgtaccgggttatccatgggcgaaaattccggtgtttgacccgccgcaaaaagatgacctgtaccccaaccgtgccctgaatttcgacgggctctacgagcaaccccacgacaactatcacggctggatcggcggtgacatggccgacaacgcctacaccgcattcgacccggtgttcagctcctaccacgccaatatcgaccggatgctggaggtctggatccgggccaatccggcggcgcagtacaccacccaatgcctgctccagccgttcgccgggagtgaggccagcaccgtgaccttcaccagcgccgatgcctggcgctatagtcgac

SEQ ID NO: 676236 - DNA, 392 bp, Homo sapiens
agcactgtaagttagtcgatctccgaggcaggtcctccgtgactcaggaagtagatcttataccccttctcatcgtaggctaagaggtgggtcacgtcccaatccccggaggtgatggactggatgttgtcgatagctgctgttgggctgggacgaggacaccgtgatgtgatagaatttccctcgtcctccctgggggatggctctgatgaagaaaaactttcggccatccggggagaacacaggttcttcattctgtctgtggcgccaggcctcactttcatcctcgtgtttcttcgtgcagacccccgtggtggcgtcgcagagggtgaggatggacacgttctgcgcccggttcagccaggtcacggcgaccacggtgcgttggccca

SEQ ID NO: 676237 - DNA, 165 bp, Homo sapiens
aaatattatatatatatatatatatatatatatatatatatgcttaacttccccagtgttttgccttgaaccccttagggaaaattttgtttgtttttatgttttgtaattttttaaattaagtaaagactgggtccaaataattgcatcccacctgggccgtga

SEQ ID NO: 676238 - DNA, 288 bp, Homo sapiens
tactagtaagactttcttcatgaacactaaatatgacatgatattacacatttgtgatcttatatttatacaaaataatgagtgtatgtgtgtatacacgtagaaagatactgaaagggccgggcgcggtggctcacacctgtcacaccagcactttccgaggccagggtgggcggaacacaaggtcaggagatcgagaccatcccggctactacggtgcaaccccatctctactaaccataccaccccttcgccgcgcgtggcggtgggcgcctgtcatcccagctc

SEQ ID NO: 676239 - DNA, 499 bp, Homo sapiens
ttaaaaaaccttgaaccgcgcgaattccttaaagcttttggaggctttcttaaaaaatcccggaaacttaaaattccccaatgggggggtaccctcaaacttggcaaaccccaaggggtttctccccaaggttagaacttgtttttaaaagcgggtttttttcacaaggcgggaccttttaccccggggttgccctgggggttggtccctgacccaaatttttgggggacctcagagaaaacgggttattcccaaccacttttggccggggtccaaaaatttttgcccccggggtctttaaaccccgggggggcccaaaaaggggggaaagggcccaaatggcggccccaaaacctttttttttttttttttttttttttttttttttttttttttttttttttttttttttttttttttttaatgattccaattattttaatgccatgtaagatgctattacagaaactgacagtgctccagttccagcaacacgaat

SEQ ID NO: 676240 - DNA, 130 bp, Homo sapiens
attgctatacgaggctagggctttctatagatgaaggacatgaaagaaaatgccacttccaaagctccacactccatcagattgacaagttagctgggatcagataataatggccattcaacgcctccgt

SEQ ID NO: 676241 - DNA, 1548 bp, Homo sapiens
cccagcactttgtggtggctgagtgcagtgtggattacttgagtgccagtgagattgagaccatgtgtgtgccaacatggcaaaaaccctgtctcgacgaacaatacaggaaatagcttggtatggtggcgcatgcctgtaatcccagctactcatggagtgctcaggcaggagaatcgcttgaacctaagaacgtggacgtgtttgacgctgtggccaacgactggtactacttgcagctccacgcctggtgtacaacaggacgacctccctgccttcaaacacacacaaacaaacaaacactacaacttgtcactttacaacacacctacacagttacacagattcggatccaagtgtcatcctcaaagtcaaaaagcttgcgccggagcagcacttatcaccaaaagctcaagcactacatactctcaactttgtgcacgacgtcaacatcatcgcgttcatcgctgagatatattaaccaatattagacctaccgtaccacacacatgcaccacctgacatttcacaccatacatcccattcattgcgcactgccttgtgcccacacataccaaccaagggtaatctcacccacaacatgcaaacaccttcgagcaattgttcatacactacacagttcacaccagacggccaacaatgtgcaaatgaatagtgaaacactaacactttaaaccccccatattcatttcatacagctcccacgttggaattgtcgtcccaccacgcatgatacgacggacagcaagtctaacctgggatcctattacacactaccctttcaagcatcctcatcattgaactagagcgagaactcagaacctgtaggacaacagagagtgcaagattcggtatacctctgtcaacgaggtcacatagagacacccgtgcatcaactggtccaagcttggtccttacacattggcaagaggaaaagtagaacaagtatagcaacgtaaactccccccaccagcgctccgctcacacttacaagaacagcatggtcagctattgggccacaaccgtcagaacaggcaagcacaaagagttatcacattagtcacagtgacattcagcatctgctacaccacgatcaacgcctttcagaccatacaaacacaggagaagaaaggtgaccagcaaagaaacgacaggagcccgcggaacaacaccgcggagaactcacgcaaaagctcaagtggacacagagagtcgacaggagaagagagctaaacaaagagacagggggacgggagcggcgggcaacagcaaagacaagacaggccagcaagccagagacagggaagccacgccaacaagacgaacaggaaacaaacgaaacaactacgaggagcaagcgcagcacgagaaacaagagagagagcagcgcgaccacacaccagcagcagagagaacacccagggcgacaccagcaagacgagaacacacagagagcagaagacagaacgagagagacgaagcgaacaaacgccaagcagcaccagacaagagagacagcagacaaat

SEQ ID NO: 676242 - DNA, 997 bp, Homo sapiens
aggaagttgtcctcttctctttatcgccgtctcgagggtgtctaatcctaaaactatcagcgccaggacattttagtattagaactacgccgcagtgacacccggggctctggcgcgattgtatcttctgaacagaactacgtgatgtcttgtagtgagaaaggatcctattctcgctaaggttaagaagcatgatggtttcctgtgctcctcttcgctttcccactccttctgccccgagcttctctttaatcagtttagaaagaacatttttgggcctgtgagacttctgataggtcatgaataggaagcagttctggtgtagctagtaaggggaaatcacatttgtgtacggggtaggaaagttgacgactataagtgaagatgtagattgtagtattttaaaattaggttccgtcttaactggattgggtatttgaggcagcatctcatatgtgttggacgtgacttaaacaatgtgtaaagcggctgacttggtaaatttattcttcagctctctggatcgtaattagaatactgttgtgggttgctcaacaagagcttatgtttaaaaaggagtaacttaatagaaaaagggagaccttgatttaggttgaaagggccaatattattcttaaaaagggtgggggcgtggcaaataggtatttaaatggcggcgggagggggagacatgggcggttaaggggcgcgaaaggaagatttgaaaaaagcaaggccccccgggagttttgggaggcggaacgagcggcgataaaacaacaaggtgtgggtggcggaccctagaagaggtcttctgtgagacatgggggagaacaaacgagtgtgggtggtacttcaaaagaaactaccattgaagggctgcatatgaaaccacagcctctgctggagtagtaagatacatcaggagaaaatatatcagtgagagaatcactcttgctttttctgggtaggtcggttgttttgtgtcacttgacag

SEQ ID NO: 676243 - DNA, 117 bp, Homo sapiens
ctttgcccctaccactgtgctaagattgcttttgttaatgtcttcagccagacagtcagtcctttcttgaagggggacccttcagtccacacatcttcacatctaccacattagcca

SEQ ID NO: 676244 - DNA, 384 bp, Homo sapiens
  misc_feature (384)..(384): n is a, c, g, or t
gctgaatatagcctaggtctcttagacgattacctgaagggtagcagacagttgacacataatgggctctacagagactaggcttatgataactcattctcatgtcaggacgtggatgtatctactagagcctatgacaccagcgaggacgatgtcttctactgggcagattggaaggtgtagataactgagcataaggagtgaccattgtgtgacacgagcttcatggttgaaatgtctatgccagatgaacttctgaccatggcagatctcgcgctggatcttactgactggctatgactcgtgactactatgctggctttacagactgggctgcgcgggacacttgacatataggttatcgatttccagccagatggcccn

SEQ ID NO: 676245 - DNA, 327 bp, Homo sapiens
tctggctctgtgtccaggctggggtgcatggtatgatcatggctcacggctgcttagacctaccggggctttggtgatcctcccacctcagcctcctgagtagctggtgggactataggtgctcatcaccatgcctggtcaatcttttggtgtttttttggttttttttttttttgggtttgggaaacaaattcgggctctgtcacccaggttgggaaatggtatggggggtgatctggggctcacgggcaaccttcaaccttccgggggctcaacgcagattctctgggcctcatatggtcagtttccgggttaccggagctcaga

SEQ ID NO: 676246 - DNA, 595 bp, Homo sapiens
aggcgatccccttagagtcgaccggctcgacgtgcacagctaggcgcgggcccgtcgtccaacatggcacgtgctcctgctcaatgcatctcatcaaacaagggcaattcgtcaagagtttctatgggagatcattaagcatccaccgaacccggcccatcccttcttaaagacagttacccatatggtaaactgctgattgtcgtaggggacgatgtatcataaacgtatcataaagcgtcaatgttttcaccacttcttccacttaagctctcaccacaaagttggagtgtttgttctttaatcgtagcagaattcatgttgctctgataggggctcttatcaaagcgatagttcttagtgcctcaatctagatcgtgcttagagcatgttaccgagtaagtgggtatgagttcatttccatgcaaaaaattttgagatccatgcatagtttcttcataatatgcatcttccatgaacattttgagcaccctcatacgttatctctattggataaatcctgatgactgctgattctcaggctctgtgtatattacgtcttaggctaccttccccaaacttgcatgtgtttgca

SEQ ID NO: 676247 - DNA, 127 bp, Homo sapiens
gcatgggacatcatcctcttcatcatcctcttacatcctgctgctgtacctggccatctatcatctacgccttcccgaactatgctgccatgcagctggtgaagcccttcagctgaggactctcctg

SEQ ID NO: 676248 - DNA, 266 bp, Homo sapiens
gtacaagttgtgcatcggtagaccagctgataaaaatagactcgcattactccgacacgttcctctggtgggtggggacaacgctctctacaccgacgggtggcacatttctgagattcctagagtcatcaaacttatagagacagaaagtagaacggtggttgctgagggctgggcagagaggggaatagggagttattgtttaatgggtatagggtttcagttctgcaaggtgcagagttcaggagatggatggtggtgatgac

SEQ ID NO: 676249 - DNA, 999 bp, Homo sapiens
gacgatgtgtttgttccgaggggcccccgccgacgattggtcccgcttactatgaagtataccgcggtccgtcgtgtgttgtgtctacacgaacgcgcggtgcccctcctccttgttgggtggagcacgcttttccgtttggacctgcatcgtggacacaacgactcagtaggtggtgggcgaaggaaaagacacaagcagcttttggggggcgagagcgcaccgctcattgtggtgctatgtgcacgtatttggctgtctgtctctctttgggagaggcgccccgcgctcgttatatatagagagagatggtgctctcctctgcccccccctccgctgggatgagacaccacctcactactagttcctcctctctaggtggcagagagctggtctttcaccgcgccgctggcccgtgctaggatagtgaagagagtagttcccccgccaccacccacgctcgtctgcgggggtgttcattgaccactcttcgtttcacaaaaagaattcttccgccgcgtccgccccctctctttctctcctcctggaggtgtgtatgaaacaatattgttgtcttgtctttattatttctgcggggaggacacccctctctctaattataaatcaacaagataggtggttgcccgccacccccgctttgtttctcccccgtctcttattcatgatccgcccccactagtcgtttttttagctgttgcgaagcaccgcgggggggaatttctttgatgaaacaacacaacactgttttgtcccccccccgcgttgacagaaacaagtgggtacctaccacacacaggcccgccccggtttgtttttattaatatcatcgttcgattactaaaaaaatgctggagaggggcaacacattttatgtgtccccaggccaccaacgtggctttttttttaaaaaaagaacccccgggggaattttaagatttttggaagtgtggggggaaaaaaaaaccaaggcgcccaaca

SEQ ID NO: 676250 - DNA, 210 bp, Homo sapiens
taagtgggaataatgaaggaaacctgttaaaaataattgaaaatgtgtggtggttttaaaccaaacttaatctcaaaatttgtggttcaaaaatagacgtgaatttcaaattttatgtgatttacatctccaatattttgtgaaacacatttgtggtgtgtcatcttaaaagtttcgacagattattataacacgaggtgtgtgtctcag

SEQ ID NO: 676251 - DNA, 252 bp, Homo sapiens
  misc_feature (37)..(37): n is a, c, g, or t
  misc_feature (70)..(70): n is a, c, g, or t
  misc_feature (180)..(180): n is a, c, g, or t
  misc_feature (193)..(193): n is a, c, g, or t
  misc_feature (195)..(195): n is a, c, g, or t
  misc_feature (220)..(220): n is a, c, g, or t
  misc_feature (229)..(229): n is a, c, g, or t
tcttcctcccaagtagctggaactacatacaggtgtncaccaccatgcctatttttttttaattgttttntagagatggggtcttactatgttacctaggctggtcttgaactcctagcaagtgatcttcctacctcccaaagtgctgggattacaggcatgggagcccctgcacccagnctcaatttttatntnctgttctttgatttccaaggaaatntgtttcagnatgatagtcttttttaccccacc

SEQ ID NO: 676252 - DNA, 378 bp, Homo sapiens
tattccacccaacggggtcactctgactcacagttcacgcctggctggcggaggcctcaggaaccttaccatcacagccgcaggggaagcaaacacatccttcttcacatggtggcgggagagagaagaatcagtgcccatagaagcaaggaagacccttataaaaccagcagatctcatgagaactgactcactatcactagaacagcatgcaggaactgctgatacagttaagtccacctggtccctcccatgacgtgagaattatgggaactacaattcaagatgagatttgggtggggacacagccaaaccatctcagctgtatagtagtaataataaatgaataatataacatgaactctaatttaattcttg

SEQ ID NO: 676253 - DNA, 427 bp, Homo sapiens
taaaaatggattttcgctcttattgcccaggcaggggtgcaatctcaactcactgcagcctcagcctcccaagtagctgggactacaggcttgcaccaccacacccagctaattatttgtttttttagtagaggtggggttcctccatgtgggtctcgaactccccacctcaggtgtatccagccgccttggcctcccaaagtgctgggattacaggcttgagcctccgcgcccaatggaagatatacagatttatatggccaaatatttcagttgctatctgtgatttttaattcttctcgctgtccccagcacaggctttctcagcctcagcgctactgactttatgagctagataatccttggtgggggaaaggagggcctgtcttgtgcttggtaaattgtgtgcagcagctctggcctctac

SEQ ID NO: 676254 - DNA, 171 bp, Homo sapiens
ctcacacgaattacggtacgttgggctttaacgatgcttgtggtccaatcccacatttcatcctcgtcagtgcaggacaagtagaggtgcatcttctctagtatcaatgtgaagccccacggtgttgggggctttaacttcttgcggattcccaacggtgaccggcgactt

SEQ ID NO: 676255 - DNA, 928 bp, Homo sapiens
  misc_feature (24)..(24): n is a, c, g, or t
  misc_feature (73)..(73): n is a, c, g, or t
  misc_feature (113)..(113): n is a, c, g, or t
  misc_feature (119)..(119): n is a, c, g, or t
  misc_feature (136)..(136): n is a, c, g, or t
  misc_feature (140)..(140): n is a, c, g, or t
  misc_feature (177)..(177): n is a, c, g, or t
  misc_feature (199)..(199): n is a, c, g, or t
  misc_feature (235)..(235): n is a, c, g, or t
  misc_feature (237)..(239): n is a, c, g, or t
  misc_feature (244)..(245): n is a, c, g, or t
  misc_feature (247)..(247): n is a, c, g, or t
  misc_feature (251)..(253): n is a, c, g, or t
  misc_feature (261)..(261): n is a, c, g, or t
  misc_feature (270)..(270): n is a, c, g, or t
  misc_feature (273)..(273): n is a, c, g, or t
  misc_feature (291)..(291): n is a, c, g, or t
  misc_feature (294)..(294): n is a, c, g, or t
  misc_feature (319)..(319): n is a, c, g, or t
  misc_feature (338)..(339): n is a, c, g, or t
  misc_feature (342)..(342): n is a, c, g, or t
  misc_feature (362)..(362): n is a, c, g, or t
  misc_feature (378)..(378): n is a, c, g, or t
  misc_feature (387)..(387): n is a, c, g, or t
  misc_feature (409)..(409): n is a, c, g, or t
  misc_feature (423)..(423): n is a, c, g, or t
  misc_feature (425)..(425): n is a, c, g, or t
  misc_feature (429)..(433): n is a, c, g, or t
  misc_feature (463)..(463): n is a, c, g, or t
  misc_feature (499)..(499): n is a, c, g, or t
  misc_feature (512)..(512): n is a, c, g, or t
  misc_feature (518)..(518): n is a, c, g, or t
  misc_feature (520)..(520): n is a, c, g, or t
  misc_feature (523)..(523): n is a, c, g, or t
  misc_feature (706)..(706): n is a, c, g, or t
  misc_feature (710)..(710): n is a, c, g, or t
  misc_feature (843)..(843): n is a, c, g, or t
  misc_feature (881)..(881): n is a, c, g, or t
tcttcatgaagacttaactgtccnagatgcttattttctggaaaatcttccactctgggtctgtgatgtaagnttgtcagcattcccagtttagaacgcaatgtttctagagncatatnggctgtttttttgatgntaanatgagaataagataaggcatcactttcctgtatccangataatttttaaaccaatcaantgaaaaaaacaaacatacaaaaaaggaaatgtcatntnnngtaannantttnnnttcccctnatgtggaanaantaagaggactactcagcnctntttgaagattgcctcttctacagcntctgagaattgtgttattnnacntgccaagtgaaggacccccncccccacatcccccancccaccccnaagcatggtcccttgtcaccangcaaccaggaaacngncacnnnnnaccccaccagagaccaggagggtttggttngctcacaggaccccccccaccccagaagattagcancccatactagacncatacncnacncaactaggctcatacccaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctnaatngcatcatgccaacttgtgactttgagactattcatcaagaatgaggatatagtagccatgacatagcttgagctatagcctttaattccttactttggctatgggtggagggtgagtttgaagaggttctgantttcttgtaacctgggaaagccatgaccttggcccgantcttcagattgctttggtaaaaaatattggtggtggatctgaaaaaa

SEQ ID NO: 676256 - DNA, 812 bp, Homo sapiens
gggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagggtgcagtgatgtggaagtttaaggtacatcaaaattcgggatcaatgcttgcatcctcagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 676257 - DNA, 230 bp, Homo sapiens
gatttgccacatatgccactgaggaggaggtggatgcagccacgaatgcaagggccacacaaggttggattggaggagttgtggaagcacaagagagctgtcttaaggagaggatcttaaaggaccagatgcccactttacctatggaaagagaaatttggttggtggcattacgcgagagcacattgagagatatctcaccttagagtaatatattttgacacagatat

SEQ ID NO: 676258 - DNA, 801 bp, Homo sapiens
gggcctggaggctgctgagtgccgccgcagccgctgctacccacgcagagccgggctggcttcgcgggggcggcgggcggccgagccccgtggctgcagctcgtaaggggagcccgcggctgctgggagctgcgggcgctggcctgggtggggagccctggggctgtaccacacggcagcggtggcacctgcgcgcccaggacctccacgcagagcgctcagaccgcgcagctctccctgtccagccgccgtgcagctgaccctgtaccagtacaagacgtgtcccttctgcgagcaaggtccgagccttcctcgacttccattgccctgccctaccaggtggttggagcgtgaaccctgtgcgcaggggcatgaggaatcaaagttctcctcctacagaaaggtgcccatccatgggtggcccacgtgaagggagaaagctcgcaacgaagctaaaattgactcctcttgtcatcagtcaggcgccctcaaggacctacctggttgtcgcgggcagcccctggaagagatcatcacctactacccagaccatgaaggcttgtgaacgaggcagggcaagggagtgtgacccgagttcgagcaaataagtaactgggctcaatgctcaaacggatgaagtgagggccccagcaaagtgtaatggtggcgacaagaggccacggacgggaggagattgaagtggcggcacgtgggcgacgattggctaggtgcacctgatctcccgccaagtgttgtaccgcacgcacaccgaagctctggggtccgttgagtacatgttcc

SEQ ID NO: 676259 - DNA, 581 bp, Homo sapiens
  misc_feature (581)..(581): n is a, c, g, or t
cgtaaccggacatcccagcaactaatgcatgtgagttcactccgtgggctgatattctgggaggctgagcagatccgcgcgggatgatagtgcacctcgggagagtagcgatgccgtgctgagacatagggtggtgatacatgcgtagagttgtattgcgagagagattgttgagtgtcaggacggtgtaatggtgacgccgtggactgagactttcagccgatgtgtagaatgagttatcgtgggagggcgaggggtgcgagcgtggatcgtgtggactaacttgtctagcctaataaatagtattaagggatggatcaaactcatgtgtgatggcaaggagcgtgtactgtagacatggattgcgaaataggcgtgcagagtcgtgcatctatggaagctagtgacggttcgatgcaaggatgaagcgtctgattcgtagggagttcagtagctgggcgaaggtagagcaaggtttgtataggaaattgagagactggatagatatcaatgagagtgtggagcaagagaaggcttgttgtgactattttaaagagtattgctggtggagatgattgacn

SEQ ID NO: 676260 - DNA, 432 bp, Homo sapiens
gatgagataagcactggtggtgtcgtggcgcaggggtggtctcttctaaaaatacaaaaattagccaagcatggtggtaggcgcctgtaatcccagctactcgggaggctgaagcaggagaatcgcttgaacccaggagacagaggttgcactgtgccgagaatgcaccactgcactccagcttgggcgacaggagtgaaactccatcaaaaaaaaaaaaaacagaagttttttattaagagcctgtgtctctgaagagcactgattatacccaggttgtgtttggattctgatctccttgtctattgctgagggcagcattgcagccaacatttgtgttcctgtggtgaagggtgatcttttggtctcacattgtggagaggcccccgaccggttctcattagattgatttcaccgtgctttttccatccg

SEQ ID NO: 676261 - DNA, 150 bp, Homo sapiens
ctctcgctcttcaatactcacacacagcatgcgcaagaaaggaaaatagcaacagcaaaaccaggagaagactcattttaacctacgacagtgtttcaagggttccatgtaaactgtgattttagtggcttcttcctcagccccagaaat

SEQ ID NO: 676262 - DNA, 740 bp, Homo sapiens
  misc_feature (225)..(225): n is a, c, g, or t
gggctcgagtcgcgcacaagtgtatctcggtagcgggcgatcggtgcgagagagcgaacgtcccacgcgcgtataattacagaagcatatgctgtcaggaggataagagatgccgttcagagaaaataacataatgtaaacggatcctgtagaaatgcaagacccttagtgaataaagccaagagagaccatgtggcagatagaattcgctcgagcaggtccacnattgcggcaactgtaagttcaggtgagcaagctgcactcattgaagaatcgagacatgcaccaggaccatagcaagccgcgggacccagaacaccagtggacgagccagggaccagcttcagacatcacaatctctgattatgacgatgggcgcgctcccaaaaccaggattacaatagccattaatatgccgctgcctgtcctgatgggcacgctgataaaccaaggtcaccattttgcattctcgttagcacgcgattagtggaaaaagaggactgcgtgtctaaatcctctgggtatcaagtgtatagaatggagagctaggagattcgtgcagacatagtcgctgtggtgttaccaaagtcatgccgctggtgaccgccatgtgctaccataggtaggctcatggagacaataggggtcatgagggattacctacatgttgtgcttgcctaaggaacctctggagataagcaagcaatgatcctcacgtgaaacacgaagggataacaaaa

SEQ ID NO: 676263 - DNA, 346 bp, Homo sapiens
agtcctgtttgctgaaaaaagctctggggctgtttgaggctttggaatgctctttggagggttaactctgcctgtccccagggtttgctccccctgccaggcaagggaacaggtcctcccaagggcctttgccttcatttttcctgtccccttccggggagctgggactttttagtgcatcagtggcctggttgccaggggttggggtccaggcatttgtggactcaaggagtccagggggcggtgttgcgctgcctcttgagcagcctcgggcctgtttcctttgctacatgtgatgattttgaaatccaggcagcagggtggaataaaccctgttggtttgtca

SEQ ID NO: 676264 - DNA, 1313 bp, Homo sapiens
agcggggtgttcctggagtgttctagtgtcggagttggtgtgcagtgcaggtgccatgggccctgctatgagtgcacactgatgtgggacgctggtggcttggtgccattgtgcctgagctgctctgtggcctgcctgacctgctctgaattgccatacggctgggggatcctctgagaccattcttcaggataatccatgagcagcactcagtgatgctggtggtgcttggggggacgcatgcttggaaggacgttactaccacgtggagctcaagataacacagtggcacaaggggcatgtgacacagcggtgaaccctggagcaggggcttctagaacatgtttgatgctgcaagtgttgacgaccgaatgacttgtcattgctgactccattgttatagtggcctgacgagcataccgttggttataccagatcatgttggaatttcgcaagatatgagcagaaactttgaggtgaattagttacttggttgggcaacaccagtaattactccccagtggcagagcgattacggattgctatcccattggcgtacgcataactatgacgagacaggggtacacattgaatgtcagacgggtgatgcaaacacgatagccagcacggtattagtggagagacacgctaacaccaggatatcactacagtgtgactagcaactagccgcaaaggttagtacgacgagaagtggaagctcgtagcgagttcagcagataggcagaagagagagcgaacacacgcgacgttgggagtcctctcctggttggtcttagacaatcggacaagtgagtggcaaaacggcaagcgaattatagctcccattaggaccccacatggtaacaagactatcgcaagtaggtagtaccatatatagttggtcacacacatggcacaatacaaacattattattggacagtcgagggtaacatagtgaacactcacgacataacttatcgtacaacacatgggacagcataagagtagcagaatatcaagcagcattcgcatcaaattggcgcacgctagccaagcaaaagaggagcagaacaatctcatagtaacgtacaagcacagaaactaccagcagggtagtgataggccacacgaaattagaaatagctccatatggggtgcacgagacaagtaatgaaatagagcacggtatacaaaagaagaagtagacaggaatacgacggtagagatagcaatagcaagtaagaagagtagtgaataaacacaaaaggaaccagatagttaaaacaagtagcagaacaatagagctaaaaag

SEQ ID NO: 676265 - DNA, 248 bp, Homo sapiens
gccttcccctgtgtgaagaattccatcacgaagaatcaatggctgttaccacctagcagggaatatgccaccaaaacaagaatggggctccggcgtgggagaactggccaagaactcaaagaggcagcatgggaaccatcgatggaaaaaatatttacaatggatcagatgggaagctggtttgttgctggaggggctgctgtgggtctgggagcatggtgctactatggctggggggccagctggag

SEQ ID NO: 676266 - DNA, 559 bp, Homo sapiens
ttatgggaagatttattaatatcctgggaaaatatttattttcaaattctcatttgctgggtatggaattattgtgataaatccttgcctacaacaagtctaaatcttgtttgagagccatgggttaatggtgtcctcaatacactaatgatcggctaatgatacataatttgtaacgttgggggatacaaaccaatccagtatgtatagggttgagggcgaaatcctgggggtgatctagaggctacaaattaataagctgtataggggcacacaacaaatgatgcatctccatgcgagcgagggcttttacaggcacagtcattgtctgggaaaatggtttgatatatggctgaactagaacgttccatgtttgtttatgcagggatttggcttttaatattgtggatcatgaacatcttgggtggaatcagatcctggcacatagtatgacatcggtctgaagatttgggacgaggttttcaattgaaaaggcggcttagtttgaattattgcggcggtttgggggcacgagggggaattatccgttgaatttatt

SEQ ID NO: 676267 - DNA, 252 bp, Homo sapiens
atagaggataccgacgtagcccacctgtagttctagctactctggaggccgaggtgggaggatatgtttgagcccaggagttcaaggctgcagtgagccataataacacacctgtgaatagcgactgatagccactgcactccagcctgggcaacacagcgagacttccatctcaaaaaaaaaaaaggccagggactaataattagggaagggatatcaggggactcccttgcaattcagacattacttatt

SEQ ID NO: 676268 - DNA, 173 bp, Homo sapiens
ctcagtaaatctcaaatgtagccatgctgggtagctcacacctgtagctccagctactcaggaggctgaggcgagaaggtcacttgagcccaggagtttcaggctgcagtaagctatgtatcgcaccactcactgtgactccacgtctgggctgacagcagtgagtacccatc

SEQ ID NO: 676269 - DNA, 898 bp, Homo sapiens
atagaagactgtatttttactatgatatccattttccacgaatggtgattacaatatgcaaagagtcataaatatgccatttacaataaggaggaggcaaggcaaatggatgtacagagatatatgtacaacgagattttgtatgtctagtttatttataaggtaagttttagtagaataattctgggattgagaggatctaaaagatatgttctgtataaatattattggccaaaagttgtttatatgcagaagtctgactatgatgaataaatcttaggatgcttggtttaattaaacaaacaaaaatcaccaatatccaaggacatgaggatatcagggttgcaacaaatacggtagttagagagactaactctgccacttgtatgggtgaagctacatttcactctgtggtttttcatggatagtaccaggacttcaccggaaatattctttcagccataccatggtaaacatttcgtactaaatctttctgtaacacttaaagaattcccgtcattcattaccttaacagtggtcaaacaggggaagtcttaattgggtatcaatgagctatggttgcgcttgtcaactatttcaggttccacgtccaaccccaaatggtaccaactcaaatgtacagtagaacggaggcatccagaataagaacaataatcaggacaacagacattgtgtgggcgccctgttggcccgtagcaaaaatgtttaagaaacaacgggtgggggggcgggaacccaattgtaaaggtgagacatggtctggcggcttccctaaggacaccgcggtgcacatggcgggggttccaaccacaaaaaacagccgggggagaccggagttttgcgaacaccacagggggtcgggcacacagagcacaag

SEQ ID NO: 676270 - DNA, 2393 bp, Homo sapiens
gggcttactctcgggcagatccccacccccaccactcccacacagctcttcctcacggactgctaaaggtctcccctcccacctgcattgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaacggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgccca

SEQ ID NO: 676271 - DNA, 2005 bp, Homo sapiens
gaagcaggctggtactgcctcagcgagctcttctcgcgcatgcgttctccgaacggtcttcttccgacagcttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 676272 - DNA, 1003 bp, Homo sapiens
  misc_feature (926)..(926): n is a, c, g, or t
taagctagataccgggccggggttaaatcggccgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgcaaggtgatcctcgcctttaagcacgcggacttgtccccatattccagatcttcggggcaggcggccnctctacggagggggaggtgggcccgatgcgggacctccttggcaacttccttcctcgggggcccttgtgtgaggccg

SEQ ID NO: 676273 - DNA, 915 bp, Homo sapiens
  misc_feature (915)..(915): n is a, c, g, or t
tggcgccgacggatgttgtccggtcgcaggtccagaagtccgggagtcctcgggtctgagaccgtgggaagtcgctggatctcagcttgatctctttggaagacagtaagagtaatgtcagatgcatgcgaggtggaaattagtagtgatattaccatgtgaatgcctggataggagggaatcgtgctctatgattgtgcctttccatgtgcctcaggtagagttcatcgagaggggcagattttgtattaaaagaaatggaagcggcgtaagcacttgagggagtcgacatgtgttaagtgaaatctttaaagggtcgacacaaagtgggatagaatggggcgagaagggtcattgggagtgtggaggggtccttacaattgggtggagcggattgtaggagataggctgtgtttgggtcgacagcaacgctgtctaaggttggcataaatgttttgggggagggatgcgatggataagggattggaatgggtttgggagaaaggcacaaaattcccgtgggggggaattcccttgaggaactatttcaattgcggtagtcaggaggggatattttggctcaaagtggttgggttgcccgcacccccggtaggatcgaaaacggaattttattggccgtggttgcgcaaaagctctttggatatgggaccgtgcccatcacaatctcctgtggacaggggctacacataagaggaagtttttcgagagcatcgtggacaatgggttgaggtggttcgagaccatatcaacgaactggttcaatatattaaggcccggaaatgttgatttgcaccacaaagtggtcggttcaacgtggttagggcgagtgggtaaaatcgcgaaaagaaccaagtgggtttggtgctgcggacaagagagagcggggcactaatn

SEQ ID NO: 676274 - DNA, 857 bp, Homo sapiens
gggcttactctcgggcagatccccacccccaccactcccacacagctcttcctcacggactgctaaaggtctcccctcccacctgcattgctctacaatctgtggcctcagcccttgccaactctgcctcttcccccgctgactgggcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgaaactgactgtcgacttttccggcacggtcatcatagctggcacagcgctatgcgcccatgaaacccgctgaagagggtgtaaacaaagaccctggtgcatggccta

SEQ ID NO: 676275 - DNA, 1025 bp, Homo sapiens
cgctaccgctccgacgctggcgttagtcggcgaggacagcttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgctgcagctccaaggcataccgtgcttggctgaccttggccgacattcacgtggcctggttgcctggccagggtggattccctccgcctttccagccgcgcggacacctccgtcccccaccgcttgtcccgagagcctctcgagggccccggcaacgtggccggcctctcaccggcacgggcgtaagcatgcggccccagcatggccg

SEQ ID NO: 676276 - DNA, 459 bp, Homo sapiens
  misc_feature (351)..(351): n is a, c, g, or t
  misc_feature (356)..(356): n is a, c, g, or t
  misc_feature (372)..(374): n is a, c, g, or t
  misc_feature (382)..(383): n is a, c, g, or t
  misc_feature (398)..(398): n is a, c, g, or t
  misc_feature (408)..(408): n is a, c, g, or t
  misc_feature (412)..(412): n is a, c, g, or t
  misc_feature (439)..(439): n is a, c, g, or t
ccccacaccacctgagtcaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagtnatctnaactgatatttctccnnnaccccctnncacactcaggacctntctttgggcnttancttcctttcttagttggtggagcgatntgtctggtaattccgataat

SEQ ID NO: 676277 - DNA, 122 bp, Homo sapiens
ggctgggtttgggggccaagtggcttgttcattccagcatctacatcataaaggtgggcccagatttcctgattcgaccacagtgctgttctacccacacaaaatccattcctgttttgttg

SEQ ID NO: 676278 - DNA, 1954 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 676279 - DNA, 169 bp, Homo sapiens
  misc_feature (35)..(35): n is a, c, g, or t
gaacagcgccctacaccctatcaggctgaactggntagttatccctcgtagttagtagctacaatgaccaatgcagtgctgcgcccagaggcgtagagggacagcacggcctgaatggccacgtgcatggccggggtgttagaaggtctcaacacataaatctagagtc

SEQ ID NO: 676280 - DNA, 430 bp, Homo sapiens
cattcatcagaccgaagtaatcaagctccagatggtgctgcaaactaaacaatgcaaggacacgctgttcttccaaggaccttagatcacccccaggaggagccctaatgctgttcctcatctgatgtccctttcagcaggaaatagccagaaacagtcatcacccaaaaccccctaacagcaattagggtgatatttccacagctccagaaaagtttccatgtgtgtccatgtcattttttccaattcaacgagagacaaacaaccctggtgttcctccactcatcagagccatatcactgatacaggaaatataaagaaaaaatggtaataattccacgtggataaagtggagatcttcaactgggcattgtagatttaaatgtgtatgtgaaatacagattattccacagtgtgctatggaaaaaaa

SEQ ID NO: 676281 - DNA, 2163 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgccca

SEQ ID NO: 676282 - DNA, 2231 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgcccaaaaaaagcaaagagaaagaaaaaagaaagaagagaaaaaaaaaaagaggaagaaagaaagaaaaaaag

SEQ ID NO: 676283 - DNA, 139 bp, Homo sapiens
tcagagttatgcattcttctggctattaatctaggttcaagcaactcctttatccacagaaaaggaggttgaggtatgaagatccctggagcctagagagttctagtctagacctgggcaacatacgtgagatagaaca

SEQ ID NO: 676284 - DNA, 109 bp, Homo sapiens
aaatcaaaaattagggaaatcttggagggagtcctcaaggttttatttgctttgctgtgcttttggaggagggacgaccctcgaggacacaggctcatgtgtgggtctt

SEQ ID NO: 676285 - DNA, 2359 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaaaaaaaaaaaaaaaaaaaaaaaaaaaaaaaaagaaacaacaaaaaaaaaaaaaaaaaacaggaaaacgccacacaaaacgcacaacaaggggagcggagaacgacaacaccaccagaggacaaagaagaagaaaagaagagagcagaacaaagaggaccaacagaggaaagaaaaaagaccacaagacgcagacagaaaaaacgaaacaggagaagaaaaccgaccaggaaagaagaaacagggccaccaaagccggcgacaccaacaaggccacaaccaagaaacaacacagcagaagacaacaaacacccgggcaaccgagaaaccagacctgacacaggcaaaaaaaacccggagggcgcaaaacacagcgggaacagcagaacag

SEQ ID NO: 676286 - DNA, 381 bp, Homo sapiens
tgcatcctcacatggtgcagagagcaagcaggctttctgatgtctttctgagacgtagtctcgctctgttgcccagggtggagtacagtggcgtgatcctggctcactgcaacctccgcctactgggttcaagcgattcttctccttcagcctcccgagtagctgggactacaggcacatgccactgtgcctggctaatttttttgtattttttttcagtgaagacggggtttcaccgtgttagccaggattgtctcaatctcctgacctcatgatccactcgccttggcctcccaaagtgctgggattacaggcatgagccaccgggctcagcctgatgtctcttcttataaaggcgtcgacgcggccgcgaatttagta

SEQ ID NO: 676287 - DNA, 1486 bp, Homo sapiens
  misc_feature (835)..(835): n is a, c, g, or t
gtgaccttaaaacaaaaaaaaaaaaacttgggtgtttccacccccgttctggcctgcagtggtgaagggccctgagcagaaccaactgtggtggagggtgactgctgagctgcgcctgaggtttctcctccctgtctggcctgggatgtagaactgtgcccggtgtgctgtgaacccaacggtgtgcatgcctgtctgtgtgtggcagtttgttgtgtgcctgctggctgctgttttcccacgtgagcttccagagtgggctctggtgtgtgcacctggatgtagatgctgtgtcagccctgagtgtgtgtgcatcgctagatgagatgcctctgaattgcaggggtttacttgctgccgatcaaattataccgtgtgatccctgtctgaggctggcccctgatagaatggcccaactcttgtggatcctgcacaatgagagctattgttgccaaacttctcctcatagttgcgcagaaagctccaaagagcatggtcatcctaggagggccctacagcaggcccgaggcccacttcacaaccatggagcacgccatctttcagagagcgcaccgtggcctagcacaaaggagagtacctcatatatggtgtgtgtatgaaaagtgctaggccctggtgggggaccctataaagacgggcctaaaattcgtccatttggcctggtggcttgatgaaagaaccttgggcgactccaacaggagcgctccatccaggccgaggtacattgagagtatcaatagcgaagcgatttatggcgctttgggtggagaaacagaacgtcggtccccttatgtgtgttttgggcgccattctngggtttaccccatattggggacgatgccccttagtgaagtgtacaccctttggtatttgaagtagtggctcccaagaaacgccacccgctgaggaatctggtgtgtccaacctgagtgtgttgaatcccccacattagtcttagcctacaagagcactttgtcgaattgcgtaacaaaatcgtagtcaacaggatgggcagtaggtgggcgaactttcacaaggacactatgtctgagtatcacttcctggtgttagaaaagaagcccccctcaagacaacctgtgtgaacacacagcttgtgggtctcccatgggcgcaatcccgcaaaagcagagaactgcccagaaaaactgagagaatgactctagcgatattatcaaaaagatgaggggaggcagacctatttaggatagggaggcacccctgagacggttagcacaacaaacatttggttagtgccacagaagatgatacagggggggggccaagtattgaaaacactttgaattagtgcatggaccactatatggaagacaagatgagatgcgaagctaaacatatgatgattttaagagacatctaaaggagagtaggaacaacaggtatggttgcatcatctataagtattgacgagattactcacaagtaa

SEQ ID NO: 676288 - DNA, 1765 bp, Homo sapiens
  misc_feature (430)..(430): n is a, c, g, or t
  misc_feature (1006)..(1006): n is a, c, g, or t
  misc_feature (1364)..(1364): n is a, c, g, or t
  misc_feature (1371)..(1372): n is a, c, g, or t
  misc_feature (1380)..(1380): n is a, c, g, or t
  misc_feature (1389)..(1389): n is a, c, g, or t
  misc_feature (1393)..(1394): n is a, c, g, or t
  misc_feature (1404)..(1404): n is a, c, g, or t
  misc_feature (1410)..(1410): n is a, c, g, or t
  misc_feature (1413)..(1414): n is a, c, g, or t
  misc_feature (1425)..(1426): n is a, c, g, or t
  misc_feature (1446)..(1446): n is a, c, g, or t
  misc_feature (1468)..(1469): n is a, c, g, or t
  misc_feature (1484)..(1484): n is a, c, g, or t
  misc_feature (1486)..(1486): n is a, c, g, or t
  misc_feature (1567)..(1567): n is a, c, g, or t
  misc_feature (1644)..(1644): n is a, c, g, or t
  misc_feature (1681)..(1681): n is a, c, g, or t
  misc_feature (1721)..(1721): n is a, c, g, or t
  misc_feature (1723)..(1723): n is a, c, g, or t
  misc_feature (1726)..(1726): n is a, c, g, or t
  misc_feature (1736)..(1736): n is a, c, g, or t
  misc_feature (1740)..(1740): n is a, c, g, or t
  misc_feature (1747)..(1747): n is a, c, g, or t
  misc_feature (1750)..(1750): n is a, c, g, or t
cgcgtgtcgtgctcctctatctgatacaccgtcgtgcacagtcggctcggaggtccgccggtgtgccaaacagccgcggtgttgtgcgtcgtcgctcgcctcagtcttctatcgcgccgctctgtaagtaagccgacggccctgtggtgcgcgaaatttccttcgtcgccgaggcagcgcacaactgcctgcacccagtcgtgtcgtagttgtcacccccgggtatacaccgctgggggagggtcggcccaggggcgcctccttggtggccccctttgagttgttgggggacacccccccgcggtggggctgttcccccgcgaggtggttgttctcgcccaagtggtgcacatcatcaccgggcccccgggggttttctctcggcccactttgtggcaccgggggccccccgggcgccgcgaggcgcccnctccggcaggctgttctcccgtgtgtatggcgccaaatgtccccgagaggggaattataacgggagagtgttgggatgtccccccggtgtgccacccacgagagtttggggccccgcccctctggggttccaaaaggggccatcattgtagaaaggaattccgacaaggttccccctcgtggagggggaaggaagttctttaattccggtctgtcgttgttgtcgccgccgtggcgcgttatttttaaaagggagaattccacgagagggatcccccatgtggggatatgttctgttgtccccccttgggggggggccccccttcttttctcttccaacaagagggaataggtcagaggttttatttggaacaaggaatgttgtataggcccccccagatgtgctccaagataaatgccccgaagaaaccaccccccgtgtgcccctccgggccccaccaaagctgcgcggcaaccacacaaagagggttgttcctgcacaggacgcaccaatattttggtgttggccgtaattatcctcggcgagggagcatactcaccacatggggcgcacaancgttctcgggttcttttggggtggtgtaaacaggtgggccttccacacaacaaggagaggttgggcagcaacacaccgccccagatacccacgttgggggggccacaaagtcaaaatccacctggggcacacaaaagcgttctttccccaacattctgggtctcacaccggtggcccccacagagaggccgtaaacttgttgtgggggaacaccacacagagattctcgggcacatagcgccacacacacacggtgggtctcccctttgccacaaaggtggtacccacagggcgcccacgtgtccgggcttctctgtgtctttggtgatccgccccctcaagttccctggcacaaccncaggggnncacctcgngcacttgtntgtnncgccacaccncggtgnccnnataagagaagnngtgctcacatgagtgtgctngtgatattcgagatgagactgnntaacacacctcacgncncgcggggctgcacactgccacaccctgggcacaacttccccacaaggccaccctttgaatgccactttttaaagaacctancacgctatacctgagacccccgaaccttctggaaaggaagaactgtaattcaccccaatttccctaataacagaganttcacctgaaccaccctcgtcaagacccccccccgantttccctgcaccggactccggctcccactgtggctaccanantanggtttttaanccanaaaaatnaantgaattaagccttta

SEQ ID NO: 676289 - DNA, 130 bp, Homo sapiens
cctatagtggttattacagtcagcaccactgtgaattttgtgaatttgaaaaaaaaaaagtgtaatttatggattcaggattcaaaaagaatcatttggtatcgaatttaccccagaacaaagggaaaca

SEQ ID NO: 676290 - DNA, 279 bp, Homo sapiens
actctgtaggatccccccgtctgcgctctgcagccccgtctgggcatggtccaggcctccacacacagccaccgcgctgccattggctctggcgctggcatgcggcagtcactggagactggcgttgccccgcctttggttggcttcagggtgacagttcaagcaggcagctcctcctgtgggccagtgagcttgctccaagagacagcccatttccagctgacgcccagagtgaaccacaggatctcccggaaagtacgatactcacaagggtgctga

SEQ ID NO: 676291 - DNA, 693 bp, Homo sapiens
taaggtttgagggggaatgctggaaatggtaaggggtatggaaacttgtcatataagtaatgctagggtgaggggtaggaagttttttcataggaggtgtatgagtgggtcgtagcggaactcgggggtatgctggtcgaattcataagaacagggcaggttagaagtagggtctgggtgacaaaatatgtggtgtagagttcaggggagagtgcgtcatatgtggtccctaggaagatggtaggggtgaggggtgttattataataaggtgggggtatccggctatgaagaatagggcgaaggggcctgcggcaaatcgatgttgaacgcctgagactagttcggacctccccttcggcaaggctcgaagggggttcggtagggactctgcaaggttggggagataaatcatattatggccaagggtcatgagtggcaggagtaaccagaggggtcctgtgtgtggcgacaagggcgggacgaggttaaagggagccacattattagcaacgtggacacgtacgaatgagggcaaggggagactccatatgagaatggtggggcaaatgctcgaaaaggcccgaaaaggcggaaagaggattgaatgccccgctgatcaaaaggtgagtaccggcagcaaaaggggcaaaacatggggcccagatgggtgacccgggtcggaacaggaagag

SEQ ID NO: 676292 - DNA, 337 bp, Homo sapiens
attattaagatagcaggatcttgggttctagctacaagctcacttcttggttaatccacatactgaatcctaaagatgacttacaggtaaagattcattattagcaagagattaagaacataacttcattgagaggtcaatgttaaggagaacagttcattaaccagtttctgtttacaaagaaaaggacaggcccaaatagccatttcaaggcagagcaggtgaaaggcctggaacactcctgtgcgctcactgtcggctgctgaacagggagcccaaggccagcaggatggagggtgtgaccgagggcttggaggaggtggtgttggggataaca

SEQ ID NO: 676293 - DNA, 220 bp, Homo sapiens
attttggacctggacttatggacgtgtcttaaatgagccaccatatagtgagctacaccacatacaggacgaaacacggaggggtcatcatgaccacagccaggggagatggcccagggagatgatcaaggaaaaggaggcgcacagctaacgaaagccccaaggagctgagaccggaaaagagaccccacgagagactcccacggccatggggaggcct

SEQ ID NO: 676294 - DNA, 1057 bp, Homo sapiens
  misc_feature (1057)..(1057): n is a, c, g, or t
cacgcgtcggttcctccttgctctcgcccctactctttctggtgttagatcgagcaaccctctaaaagcagtttagagtggtaaaaaaaaaaaaaaaaacaccaaaggctcggagccacaaaagggatgaaatttcttctggacttcctcctgttctcccgtaaatgatcgttctgatccctagagtacttcgtgaagtttttattcctaagaggagaaaataagtcaccggcgaaatcgtgctgattacaggagcctgggcctggaaattgggagactgactgcctatgaattggctaaacttaacaagcaagctggtactctgggatataacattacgcatggacgtggaggaaacagctgccaaatgcacgggactgtgtgccaaggttcaatacctctgtggtacacctgcagcacccgagaggatatttacccgctctgccaagaacgtgcaaggcacacattgggagactgtaacagtaattaaaggaaaattaaatggatcgggaggtagcatatatacacgtacaagaataggtcatggtacaccaaagaatccttcagatggagacagactttgtagagttaattgaactctgcagcattcacatgggtctgacagcacaggagagtgatctaggccaacatgacaccactcttgccatccgcgtacaacgtgatactcctgcaacagcactcacccaaggatacgtggaatacaagaacaacaaggaaccatactaccgcggacaatggacgaacaaaataaccatgccatatagtcaggcgcttccgcatgtacaatgttccggtcacctctctaccgggccctacgtctcagacagatagtggtagactactaacatgaacaccaaccgctgcttacaactggcaaacaaacaattcggccaatgaaacatagtcccacatcaccatttgaccactgacacggaggacggatcgtacacgcacgacgttcactcacacacgcacacacgacgaacaagaaagataaaccagagaccgacacactgacacgctacctatttggaan

SEQ ID NO: 676295 - DNA, 896 bp, Homo sapiens
ggcctcacgagcaatagtatggttgcaggaagcgacgtgaaatggactgtggagcgaatgagaaccacatagcagggtgctgcgagatgaccctggagagtgtcgagttggtcgtctcaagcatgaaagagtaccagttccacgtggcgagtcacatgatggaatgggctgagaatgtcatgcaaatacttgcatgatcgggcaagtcagatgcttgaggttgcaaattttgtaggagaatgaaggaactggacttgggaccctactattaaagttcctatgctctggggggcagcatgcagattccgagcatggaactgtacttggtgagcttgagtatgtcgatgatccatcttatcccagatgatgaatctcgtcgggtggttgtatcttgtgaggtggatcgaaaaccgtccgtggatattatgtgccgaaggtcatggtggcacttgttcacaagacatcgaatttctcacaggactacgtgattgaggcttgagaacggatcatcgaacatctgttacattatccttggacattttccttgggccaaaatgcatatcaatgaaccaaattaaggactatgtcggacgttaacctataatctaagaccttcatcgaaagacttaatgttgtcatcgggcgtgaccactcaaaaaaggcccctcattgccgtaaaaacttggcacttgaagtgcagtcaagcgaacgtcgaagacggacgagttgaccccttgggacctggaaggggacaggcctgggagcattcgtacccaggaacgcgtgcatcgcagcccacctccggtggggaagtctcccacgaggcccccagacccagacttaaactggatgcgccttaagaaaccccgagggtggaataatggaaccgcacgggg

SEQ ID NO: 676296 - DNA, 398 bp, Homo sapiens
gcccgggctgcaggaattcggctctaggggactcacaagctttatgttctccaatcgcagggtgacaggtcggcggctctacattcagctaccatgggcaaccttaatcgcaacttgatcgccttaaatccggacggcttatatcacactcttgtcctcaaaagcatcacccgcttcgagcataacgaatgctgccattacaccatgaaatcactactgccctgtcaagaacacctgaatcagcactacatagaccctaaagaccgaccattctatcctgtgctggagaatttcatgaactcatggacagatgaatgcatagtcaggctaggactgaacatggagcgtcacttgatattcagctagaccactccatgcgatactcatggcagtcctat

SEQ ID NO: 676297 - DNA, 238 bp, Homo sapiens
tacttttccacaggagtttcacctatgttaggccaggcttgtctccaactcttgaactcaagtgattcaacaggctcctcttcccaaagtgctgggattacaggtttagccgtcgtgactgtaaatctcctgttgttctatatatgatagtttatatgcaaatagggacaatctgacttcctgttgtctaatatggatgctctttatttttttctcttccttaattgtctggctgtac

SEQ ID NO: 676298 - DNA, 169 bp, Homo sapiens
taccaacaacttgaaatcctggaggcccaggcggacaagtattccaccaaagaagataactatgaatgaggagatcaaagcggttgggaggatcacttgtccgccgtgggcctccagggatttcaagttgttggtaacaattttcagctcctcctctaggtccccacat

SEQ ID NO: 676299 - DNA, 919 bp, Homo sapiens
agtgtttcgtgtgcacgtcggcaccatttgggcccgcccgtgtaacccggggcccacccacctgggtgattccctggccccattctcccaaggggttttaccccgttgaaagacatctccgagggcgtccaatgcgcttcggagttctgtcttccgcccttttttcctcagggccccctggttcgtgtgagggtgctcctcgcctcgggttcatcgggatcacccggcacgttctaacacggttttccaccgagcaaaccacgacgcttcccctggtcaccaatggcgaccccccccccaaggggggtccacactcgaatggacaacttcctcgggacaacaaacaaagatggggccccccgatgtgttggtggtcagaaaccccgggtggggggaccaccggcgattgttccacccctcgcgaggataataaggtatatcgcctgccacccaccgttgtggcagaaaaggtgtccacagcaaaacagacaacaaaaacaggtttttctcttcgcggtaaatactatggaatcctcctgaacccagtaacgatgaagattttcacaccggcctcgctctcctgaaacccgggaagggctctgaattcccagagggaattgaacgcacaagcttggaggattggggaatccaacaatgcagtggaaaatatagtggaaaaacgacaagtggacaaacccccagttgaccctaaggcggggaggacgtcaccccaatacatatcagggaggacccagaagctgggagacccatccaacagtgctgcctgcccacaaacccccccgcggggggaaatgtcctgccacccgcctcacccacgcccgcaagtgaagagacgctcccggtagtggcacccacggacattctcaacaaaaatctatcatggggaaccaaacaaaac

SEQ ID NO: 676300 - DNA, 262 bp, Homo sapiens
  misc_feature (2)..(2): n is a, c, g, or t
antgatgtggagcatgctcatgtcttgtttttagcagcattcacccgtgtctgttcactgaccaaagtccacaatttgtccaggtttgacagtttggggcagaaactctggttcctctttaaagtggtaatgcttcataccaaactttcccaaaagtagcctggtgtggtatatgtcgaggttgatccgggtggtgattgcagaccacccagcattaccgcgggcgccggggttcttccgggtgcttgcctacgcgggcggt

SEQ ID NO: 676301 - DNA, 135 bp, Homo sapiens
atccaccggagcccttcaaaaaagtctgttgcagaatcgggcaaactggaacaatagtctgtcttctcacagagtggcaaatagccgagaggtcactccaattcttgcacaaacacaaagttccgttgaagccgt

SEQ ID NO: 676302 - DNA, 267 bp, Homo sapiens
cgtatgcagctatgtggagtccaggcctaacaactagtagtaaggtggtagtagcagtggtgcacagcagaaactgctcattgttagagacggaacggcaggttatctacgtggaatcttggtgtaccaaaatggaaaacaggacattgtgtcctttattacctaagaacatggtttattggaaagaacaagagcatggaaggcagccagacagaaattcaaatcctgttctctgccacttgctgggcaaccttgggcgtacgggga

SEQ ID NO: 676303 - DNA, 140 bp, Homo sapiens
agctggacctggggaagctttgagtgaagctcttcctggggacattgagcccacattgaccccagtgaagagcttcactcaaagcttcatggtgcatttcgacagattttacttcctgttcccagagagcctggaattct

SEQ ID NO: 676304 - DNA, 1346 bp, Homo sapiens
  misc_feature (379)..(379): n is a, c, g, or t
  misc_feature (468)..(468): n is a, c, g, or t
  misc_feature (478)..(478): n is a, c, g, or t
  misc_feature (552)..(552): n is a, c, g, or t
  misc_feature (554)..(554): n is a, c, g, or t
  misc_feature (635)..(635): n is a, c, g, or t
  misc_feature (674)..(674): n is a, c, g, or t
  misc_feature (930)..(930): n is a, c, g, or t
ggttcgccgccagaacacagtgtgtcgctgaagactagcccctatagtagccaataatttgggaaaggaaatatgactcgatatcaagcgattgttcgtaccattgagacacttgctagattactgagtgcatacgtccacacatcgtaactgtgccactgctggcatctaatataagttgcgcgttgagtcacactcgaatgcgaaattatgcataccagtgtgaacatacaatttatgatggacagagacgcgactgacatggatgcaactgggaatagaggtgtcgtccgtatctacatggctagtgacactgcgtgcttgctttggaaatataccacttgagacaagactgtagtcagtagaaacctgatgcgtntcatgcacgcaactgtgaatcatcgtccctgtctgctgagctcttactttgttgacaccgacaccgaaggacccaaggttaccatatgntgtccacgtnaatcaggttgggagtgttctcctcagcgcatatccacacagttgagacacgtggtgtaactccagaagacaaancntaatgcaacttaacctaagggagtaagcgaatgcgttcagcgccatggcacccatggtgatctggttgcacgttgcaaatntcggtactgtctcgacagtagccgattgcctatcgtggntagcacaatcttcgcagaagtcgtgagcgtattactgcgcacaaggacatactgtgcgaccaagaaaccccggcagtaaggcgagttgccccgtctcgtgagtccattgtactaacaaccctatgtggatgtgcgacaagacttaaacgttagaatttgtccgcgatgtaatatccctagaagaagtggggattgcccaactgcagtaccaaaccgcttgagcagtgcgccagtaaaggagcgattaatggagcgntataacttgggtatcacgggggcagtcttcgagacagctgtgccatttttcccgaacaagtgtgtggcgtaacaaacaccccggagcggcaaggttgaggtcacttttagtaggccccagttcctcctagcgtctgtgtcacatagagttggagacaaccatgtcgtagagcaagtccctacacgtttgtcattacaaacgattggcaccttggggttaccaccaggggcatttgagtacctaggcttcaaccccagttggcctgggaattgtgggtacatagcccacgatgagaacacccagcaacgtagcatttgatgcgctcgagtgacgtgctgattccgaaagccaaggccagacttcgggtccgaaccttgaaccaacaggccccgttgatccggccttggcgttcgttc

SEQ ID NO: 676305 - DNA, 355 bp, Homo sapiens
  misc_feature (39)..(39): n is a, c, g, or t
  misc_feature (58)..(58): n is a, c, g, or t
ggaaatgcatatgcattgtaggtgtacgtagttcatgtnagtcatgtaagtttcaagnactggccactatatcaggtcattgtgcactttatataccttcagcaatctatgagcaatccagtttctctgtatctttgccagtaataagtcttgaagtaaggtagagtgattatcatatatgatacttcatttcacaaattgtgtaagtattctagatcctttgcctttacatagaaagttagaataattatgtctatatccactgtgccgtaaaggattagccttgctcaaagagaggtctggcctttgccctcagcacctgaggagtaatctcttagcccttggaatgttctgc

SEQ ID NO: 676306 - DNA, 635 bp, Homo sapiens
ggtgatgaggtgtctgtacccagcttggcggaggcatggttacttgccatggtcaagaggtacctgacctccttccccattgatgagcgcgtgcagagccacatgctccacttggaacacgatctggttcatgtgaccaggaagaaccacgccaggcaggcgggagttcgaggtcttggacatcaaagctgagttcactggacctactgtgcccccaatctagattgggagcaccaacccaggtcagaggactctctgggcacccgctgtgcatggagccagagtgcagagccccagatcctttagtaaatgcttcccctggtcctgcaacaggcccggtcacctcgaagcgggcccggggctgaggtcagcctcagtgcctgcttatcagcctcttgctcagaatcctctttcctccctcatttggccctggggctctaggggaccaggtggggcggtgtggggagctgtagcggtgctagcgaagcagtagccactcagtggactaaccaagcagctagccgagggatgggccctggtaggttacccgtgcggagagtgctctcccctctgcatcacacgtcaggtctttggtggggggacccaaagaccattctgggaagggtccagaagag

SEQ ID NO: 676307 - DNA, 385 bp, Homo sapiens
caatcaagtgcttgtcacagctgaaaggtttctggtggcttagagtttcctagcagtaaatttatgatatggtccagttctttgtacagaaaggcacccttatgttagaataaatttccagaacttagtggggagaatcaggttttaaccttgtgtgtctgtttctttgtgagtgcctttctataatattcatgttggtgtgcgtcggcgttataaaagagcgcttctgtggctccttccccgcccgggggggttgggtcttttaaattttggccttgtttccaaatccccccctccctgttgaaaaaaagacacatcaagaccaataaaataaaaagctcacaaaccaaaaaaaaaatgaagtagaatgaaaaatcaataagga

SEQ ID NO: 676308 - DNA, 104 bp, Homo sapiens
tctgttaccagacagaagtgtccctctttaccttagctccacaaacaggagaacacggttggaaaagatgagaagagcaaaaaaaatctcctctggagaatgat

SEQ ID NO: 676309 - DNA, 428 bp, Homo sapiens
  misc_feature (21)..(21): n is a, c, g, or t
  misc_feature (40)..(40): n is a, c, g, or t
  misc_feature (422)..(424): n is a, c, g, or t
  misc_feature (426)..(427): n is a, c, g, or t
acgaagattgccctaaatagnagaaaaccccccagttccncctattaaagaaccccgcagtgggttaaaatccccaactgtgccctactccctacacttgtaccttttaaaaaatgtggtttaagaaaaaatggatatcaactgggcacggtggctcatgccctgtaatccccagcactttgggaaggccccagacaggaggattacttgaacccccaggagtttgagatcggagtggacaacatagtgaaacactgtgtctgcaaaaaaattaaaaagttatttgggcatggtgcatatgcccgtagttccagctacttgggaggctaaagtgggaggatcacttgagcctgatgaggtttaggttgcagtgagctgtcattgcaccactgtactccagtgggtgactgagcctgaccctnnntnnt

SEQ ID NO: 676310 - DNA, 806 bp, Homo sapiens
  misc_feature (766)..(766): n is a, c, g, or t
  misc_feature (794)..(794): n is a, c, g, or t
  misc_feature (803)..(803): n is a, c, g, or t
aagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatatccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggccgcacagcctgtagggcagccctgctttgcaaggagcaacgcctctgctgctgctgtgcacaagccggccgcttnaataaaagtggttacaccactgggttgnccttgagtnctt

SEQ ID NO: 676311 - DNA, 387 bp, Homo sapiens
  misc_feature (86)..(86): n is a, c, g, or t
  misc_feature (93)..(93): n is a, c, g, or t
  misc_feature (100)..(100): n is a, c, g, or t
  misc_feature (102)..(103): n is a, c, g, or t
  misc_feature (106)..(106): n is a, c, g, or t
  misc_feature (108)..(109): n is a, c, g, or t
  misc_feature (128)..(128): n is a, c, g, or t
  misc_feature (137)..(138): n is a, c, g, or t
  misc_feature (143)..(143): n is a, c, g, or t
  misc_feature (166)..(166): n is a, c, g, or t
  misc_feature (227)..(227): n is a, c, g, or t
tgccctctcgtgccacggtggaagaagagcccgaagatagaacctgatagcgaccgcagaatacacatacagacgacacagagcangacgaanatgaagnannggntnngggaacagatgacgaagangatacagcnnaggantctacagctgacaaagatgaatngtaaattatactctcaccatttggatcctgtgtggagagggaatgtgaaatttacatcatntctttttggggcgacttgttttgggctgccccctaatccccttctcccctgcactgtaccatgtgggattatgggtcacaggacacagtgggtacaacagtaaaattttataaacattcctcatgaatgtaatttgtactatttaactgaaccaaagctt

SEQ ID NO: 676312 - DNA, 219 bp, Homo sapiens
agaggatctgatggtgggctgtcagtcatccatcttctgtctgtcccacgggaatgagtgccatggcaggggctccagcctgtacagctgtccgtcctgtccctctggactgtcgtgctgatagtgcctgaactcacagtacccaagaacaagaacctacgaacttcagtgacgtacaaaggcagaggttcagagaggacccagatcgggcacagcgcc

SEQ ID NO: 676313 - DNA, 110 bp, Homo sapiens
tgcacgcattatcagactgcactgtagccacatgtttgccttgagagctcagggccgaaacaaagaactccagttggggttggccagagagatgacgtcaaaacatatag

SEQ ID NO: 676314 - DNA, 749 bp, Homo sapiens
  misc_feature (1)..(1): n is a, c, g, or t
naacctgctgacgtctttatcactgggagaacagaactggatgggaggcgcaatcccccatgagaaccctgacagtgccctcgttttcggtcaaggactttctgggaataatactgggggttttgtttctttggattgtgaacggtctccaagtgttctcccaagatgctaatacaccagcctctcctgtttagcaacatgtaaaaggctgggtaggactgtcgggagactgcctgccttgtcaccattgttctccccacttccagtgactgctcttattttgctgtaccataagcccacacaccgcttgactccaggagttgcataagccccctgtgataatcggtgctgtactgcataccctgccaggctgtgacttggtatcctactatattttctaaggagtgaataatattgtccgagttgaactcacttatcttgaagagacatttccttctgtgggcattgactgtatcccacctgtgtttccccaggaaatggtaacctgtttctgagaacacctgaaatctcatggctatacattcccaacccatctgaacgctatttccttttggtgtgggtttggttttgttcattttgaaatacactttgtgaaccctgagatccgtaaactactagatctctggaagtgttattgtgaaagaaacttgcttgcagctttaaccaaatgagcaacttcccctatagacttgttcttgcaggctttaaaaaaataaaacgaaatagaa

SEQ ID NO: 676315 - DNA, 1132 bp, Homo sapiens
gctttgtgtttgttttgttgtgtgttttttgtggtttggttttgttgttgagttgtgttgtggtgttttgtgctctggtttgatggattattgtgtagtggggcgtcgtttgtatgtgattgatgatatgcatgatgtcctgacaagaaaaaatcattcaaatgtggcttaaggggccctgtgcagacggggtttccgcctatattccttttatgccgctggggaatttccgggcgcatatggtgagatttgtcctctggggcgcaatattcgtggtgttcgtcctcctcttttttgcctgtcgtccccccttccccgaagtggggtctgctcacccgggtttttcatgttgctcccctctctttgctcctccgcgaaatgtgttttccgccccctttattatgtttttggcgcgccaccccccgttgtggcccaaagacatattttggtcgcgcgaccaccgagatggaggtgtgctgcggctcttttttttttggtttttgtgtgtttgttgttgggtgttttttgttgttttgtttgtggcgtgatacctccggcgattttttaaaactgggggcaccgtgtgataggggcgcaccaccccctcgcggtggtgtggggccgggccgtctcctcccctagggtttcacacgatgggcgctgggaggactttttgtttgcgccgccgtttgtttgttttttttagtatatatgctcttctccccacctagtttgaggagggcgttgtgttttcttacggggaggtcctcctcgcgcttctctcgttttaagcgccccccccccctttcttcttcttataggaggaggagtaggcgcccccttcttttccacggcgccccaagggggaggggagtaaaactgtgctgttgtttcgaaatatatatgtgaatggcaaactttttttatatttttgccctaatatactttttatattttttttattttttgaaggaagaggcgtcttgtgcccccccctctcccctcttttgtcccccactagagaagagatatagagagattttgggtcccccgcggggggggggggggcccccccggggtcccctccccctaattggaaggcccccggtgaaaaaaaaggcccccccctcta

SEQ ID NO: 676316 - DNA, 488 bp, Homo sapiens
  misc_feature (7)..(7): n is a, c, g, or t
  misc_feature (25)..(25): n is a, c, g, or t
  misc_feature (57)..(57): n is a, c, g, or t
  misc_feature (83)..(83): n is a, c, g, or t
  misc_feature (255)..(255): n is a, c, g, or t
gtggtcnactgtgctccagtgccanttttctaagtcgaggtccaaagtttctcacanttccgtctctggattgctaagggacntacagctctgtcactaaatatggccattcctgtaatctgaaaggtcttgactaagtgcttgcaatgctccagaagtggcacattcttcctgggtctgagacctacctggcctagcatccagcaaggacagaacagtgaaagtcccagactgttactcacttccggcggccantagcgccagcctcagtgtctgcattatttttggccccttgtgccaccctctcagagtgccagagagccagggctgccacctggagctgttatgaacaagttttctctggaaatggggataggcctttgctagaagcaggagtggcctggctggtgtgctaggcagacagtgggccgacattgcccttccctgtggtttttggtgtgggatgaatctgtccctgtgtccaagtt

SEQ ID NO: 676317 - DNA, 405 bp, Homo sapiens
aatgataaaaccatcggtgttatagtaggctaacccaaatagcttacccaccaacaacccgttcaccactgccgtcaccgtgcctacgaccaaaggcacaaacatgcggatcatgccctgaatcaagatcacccaattcatgccaagaatactaccgacaaccagactggcgatcacaaagtacagcagattggcatctttcatcagcaggtgaacggtagccattacgtttgtctggaagaaattaaagtaaaccaataccgatgacaccatcaggcacagaatcgccgggccaccaatatcgcgcaacacgggaatacttttccctaactgcgccagcgcaaaacccagcgtcataatcaccgccagaccaccaatcatattctttggcaagagggtcgacgc

SEQ ID NO: 676318 - DNA, 247 bp, Homo sapiens
  misc_feature (100)..(100): n is a, c, g, or t
caggatggcctagtttaaagacaaagagtagacaatttatgggaacaatcacaaggtaaaaacagctttaaacaaagcagaggtagaataaatccagttngttatctcaggagagataggcagagaattaaatgccagtatgaggcattagaactcagcctgataagcaactagggtgtgtcactgaggtgatataaatggcattttatgaggattaatctggcagaataatacaggatctactctg

SEQ ID NO: 676319 - DNA, 1201 bp, Homo sapiens
  misc_feature (126)..(126): n is a, c, g, or t
  misc_feature (155)..(155): n is a, c, g, or t
  misc_feature (168)..(168): n is a, c, g, or t
  misc_feature (177)..(177): n is a, c, g, or t
  misc_feature (180)..(180): n is a, c, g, or t
tcccggcgctcacttctcaagaagaatgtctccatcaatacagttacctatagagtgggctcctcctgtaccagaatcaagcattggccaggcagtacatgcagatgctacccaaggaaaagcagncagtagcaggctcagagggggcacagtancggaagaagcagntggcaaagnagntccctgcacatgaccaggacccttcaaagtgccatgagttgtctcccagagaggtgaaggagatggagcagtttgtgaagaaatataagagcgaagctctgggagtaggagatgtcaaacttccctgtgagatgggttgcccagggcccaaacacaatgtagacatatctgtgaggggatataagcagccccacgcagcagatggggggacactggaaggagagaatacatgtctgagtgacgcacaaagagcatctcatatattcctgagtatatgcgtgacgaagatgagtatgagaagaatggtgacccagaccatctatgccgaaagggctggctatgcataacactgtggcacccagactatgtattacgtctgcagcacctgccatgaactcctggttgacatgattcatttttggaagaatgagaagctatactgtggcagacattactgtgacaggcgagaaaccccgatgtgctggctgtgacgagctgatattcagcaatgagtataccaggcagaaaaccagaatggcactgaacacttctgctgctttgactgtgatagcatctagctggggagataaacgtgatggtcaatgacaagccgggtgcaagaccttggctatgtgaagaatcaccgctgttgtgtgtcaggatgcaacatgccatcgaccagaaagtgcagagaggaactataacaacttcagctggcttgcatcaccaagagcatatcagggcacaggtgaaaaatgccacatagggcagaaatactggcgtaaaagggatgaaccaggacaggaagggaaaacaaggatcaaagaggaggcccaagatcgggaacaaacacccaggcgcagcccacaggaaaggcagcaacaaaagcgcaaccacgccaccaaaagacagcacgcgcactgaggacaagagaaaggagacagacagacaccgacaagacacgcccaagagaacgcacgacagccaaccgccaacagaccagagagagcacagtacaacc

SEQ ID NO: 676320 - DNA, 863 bp, Homo sapiens
tgtttcccatcttccttttctggtttactatgattggatcctatggtaatgtttctgccttacttaccttttgtgggtgctttccgggtcttctcacctttgcgcactcccccgtgtccttgtatccctttgtaggtgatccctgcacatcgagtggagttgtctacgttcagctccctttcgacatcggagtagcgaatcctggtcttgctgtcctttgttccgttggctacctggcaagctcgcctcaggccctattgcgctcacgtagatgcttctttgttttggctgccatggcataagagggccttagcggacttccctgttggcctctgtacccatctttcttcctgatgtgcacgccctggatcctttggcctatcccagttcccaggcctgcagtttcgcggtctgtccttgtccaaagcgcaggtgctagacagtctacgacccacgggtttctcaaactctgtacttgactatttggggcctacgataattcttgtgttgtgtggcctgtctggtgtatggtagcgtgctcagcagcattccttggcctctgcccactagacatcagaagcactcccccagttgtgacaaccaaagatatctccagaccttggcaaatgttatctcgtagggggaaaattgccctcaagttgagataccagctggtctcagctagacctgcactgtccagtacagtagccactaaatacatagtggctcaaaacttaaatttaagttaacttaagattacaagctcagtttctcagtcacattagtcattcaagtgttcagacagccacatgaggggacagtgcagctacaggatatgccatcatggcagaaagttctgttgg

SEQ ID NO: 676321 - DNA, 432 bp, Homo sapiens
  misc_feature (137)..(137): n is a, c, g, or t
  misc_feature (252)..(253): n is a, c, g, or t
tctcacattttttcactcttttcaccattgctcttttgggttttgtcttggtaatccaatacattctccaaagaaactttagccaatgtgccaccatcctctcttcctgtttcctgccttttttgttgtagttgctntgcttccttctgcctgtccttttcctcaagttatttccggacttcagcttctttatatcttagtttaaggctctcagagagtctttcagcttcttcaatggcttttttgatgttnncagttccaagtattgaatggacgtaatcctcttagtgcttattttctctggtttaacttctgtcttcttattgaggtcttttagtgaagaactcaggtagagttctttaggaactaaagccacagcaggcatggtgaattatctttacttttccacgttcacgatagatgctattttcc

SEQ ID NO: 676322 - DNA, 1024 bp, Homo sapiens
ggcgcccaacaactttctatgtaggcatctacatcctcatcgctgtaggcgctggtccatgagtgttcgtatgggtgtcctgggcttgtcgtacgtggtgcctagtccgaggaatccgcgagttgcctgcgtggggactgttcttcaccgtgcctggtccatcctgctcttgcctggtgcaggtgggcgtcggccatctggggcttatgtcaaacgaaggcatcgcatggatcgacctcgaaggaatgttgtaatgcaagttcatagtaagtaccaggacccttacaagcaggcctgtgtctggcatgactgacgccaaacgaacgcgcaaggcatgtggtgacatgatcgttcccatcgcaggacagccttgcactgcttgctgagcgtcctagctaggacatggactaggctttggacctacgctacagaggcttcagagcatacgaatttgtgtcccatcgagggcagcgaacagtcatctagcaagcgctctttccaaggacggaccctgaccagcaagaatgactcgagtgacccgtctttcctccagggaaagcttgataccgtcatgtcggacaagttggcatgcctatcgctggctcagcctggtgatgttcactgaactcttcggagaactcgaatacctagacgtcactgggtggcttcgtggctgggtgagacactctcggagagactaggtttcaccgtgataacgtggaaagggtcgccagacaggcgtactagggcacaagcagggtggacgcttcctagccaaggtgccaccactgaaggttgacaccgggagcacatgtcccagagaggggggcgaccaaatcagaacggatccttggatggtaattattataccgattggacccaggttagattaacctcttgcatacatcacggtaggccctttgtaacaatgacgcggagatagagggacaatgcaacgtgaaacttttcctgggaaaccccttataaggggctttgaccgtcaccattgtaggcgtaggatagg

SEQ ID NO: 676323 - DNA, 509 bp, Homo sapiens
ccctgtttcatgcacaaggacattgatgcgcagggactacaggacttgtccaaggatgcacccgagcccacgtcccacctaggttccccagtctctcccagacaatccctcagaaaacagtcctgggcccaggaaccagagctgctgagcaggcccagctacgtaatttgtggagcccagtgcaaattgaaaatttgagaccctttgttaagaaattatgaagaggccaggcacaatggctcacatctgtaatcccagcactttgggaggccgaggcaggcagatcacttgagtcctggcgttcaagaccagcctggccaatgtgtcgaaaccctgtctctactaaaaatacaaaaattagccgggcatggtggctggtgcctgtaatcccagctacttgggaggctgaggcagggagaattgcttgaacccaggtggcagaagttgcagtgagttgagattgtgccactgcactccagcttgggcgacagaaggagactctgtcaaaa

SEQ ID NO: 676324 - DNA, 823 bp, Homo sapiens
gggaaggttcttacatgatggaatgtctcacaaatgatgtttatgatgctgctttgaagctcagttactgaagaattgatagatcatgtggcttggtgatggcctgagagcttgtatgctgagggaaatatctatagaccttcagaattgagagaaatgtgggtgaccgaagaacaagctagaaatatgattgtgggtggctgagatgtaaattgttgggaggttttgataaggtacccaagtttttgggaaattaacaatgaaggacggttgtcaggaacgtgtctgtgggccaatgtgggattaagttacgtattcgaggttggcggaaaaaccaatgtggacgaggtaattgaagaggaaaacttttgcataaggattcaggaatcccagtggagggggccatccaaagggctttttggggttggaaaccgatttggtccttggtggtggccgcattaaaccggataattgtgctgggtaagcggggaagaatttcggagaaaataattcgctggggggttctatggcaggttgggaattgcactttttcggggcagaagaaatgttaccaagtcgggggactgaaaaattcatgagggaattgcgcccgtgaaatggatatggggtaggttctggctagaaatctaatttataagttgcaaattcgagtcctgagaatttgagttgaaagtctgggacgcctagtaattgggcctcgggtaaacttttggggggaggaaaaacgcgttaacggaaggattgagaccaattctggtttattctaattgatgggggtctcggtaaaaacttccagtgggga

SEQ ID NO: 676325 - DNA, 266 bp, Homo sapiens
gttccggacatgaagacaaggaacgcttggatgtgagcactaagtttgagatgctacatgcgagacactgttctaaatgtttattagcttatttaatcctcacaataatcattaaaagaattacaggtgggcacagtggctcacgcctgtaatcccagcactttgggaggccaaggtcgggcggatcactggaggtcagcattttcttctttgtaaacatgtagtatgaagtcttagcctgtttggtggaccgtgagtctgttcag

SEQ ID NO: 676326 - DNA, 809 bp, Homo sapiens
cactgaacccatctccagccgcagccgcatctgcagtccgggccgaggagctagccgcagtcagccgcaccagtgtgccgagtgagcgttagccgagtttgaggcagtgcctagcggtgaatcggggcctcagcgatgagttcctcgcctgtaaatgtagaaaaagctgaaggtgtcggacctgaatgaggagctcaatgacgcgacgcctttctgacaagggtcctcaatgccgagctcatggagcgactccatggctgcgctggacgacgaggcaggccgggggccgcccgccgttggagcccggggtatcggtggacatagactggcgcggggtgactgccgctggggcgctcgtgcacgcgaggcgctcggcgcgggcaggccgtggctggtggcgctgaactaggacggcgggaacatgaacgcggccggagggcgggttttccgctcctgtgcggcgaccatagttggggctacggcgtagggggactctgggccccgtggggtgcggcggctccgagtcccgatttggggctgatagcacgatggcccgccttaggaataccgatccatcggtcgcacgatacagggtcgtcccatgaagggccatcatgaacctctcggggctgaatcaggaagggcgcgttccataaaatgtaacgggcgtggtgttccagttacgtctagatgcggcggcgaaggaaaataccaaggtgtgccaagatgagggggggtccgccctaagaccctggggaaagagctggtggcccacctcggtataggggtgacgggtgtcccccggcagc

SEQ ID NO: 676327 - DNA, 467 bp, Homo sapiens
caagggggtcaatatccaagacatcactacccagaccagagtgtcatggagttttcgccctatgttttcttttagtagttatgtactttcaggtttatgcatttaagtctttaatccactttcagttgattcttgtatcagggtgagataaaggccctgaactagactcttgattacactgcaagggaggtgatcagtagaaccagcaaaacagaccagttgctattttactactgattgacacagggatctgttgtttgtaaaagagagaagagactaatgcattttccaaccatcaacagctctgttctttctctgtattgttaaattgctgcctgctgcctgggtctcttcagcctcatccattatgcaacacgttggtagtgatgggaccaggatgtaccattgcacaaaatgacaaacctgagcaaagtcatagaaacagaactaacatctcaaagaacatg

SEQ ID NO: 676328 - DNA, 418 bp, Homo sapiens
  misc_feature (14)..(14): n is a, c, g, or t
  misc_feature (25)..(25): n is a, c, g, or t
ccctaataataaantgtaaatattnccctgaaatccttactgtgtgcccagaatactttaggcaccttcacatgcaaactctccctaatatccttcatatcaacccctattagtgatattattgccctcccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctgacag

SEQ ID NO: 676329 - DNA, 631 bp, Homo sapiens
ctgatgttctctgtggtggatgaaaatctcagctggtatctagaagataacatcaaaaccttctgctctgaaccagagaaagtcgataaagacaatgaagacttccaggaaagcaacaggatgtactctataaatggatatacatttggaagcctcccagggctctcgatgtgtgcagaagacagagtgaagtggtacctttttgggatggggaatgaagttgacgtgcattcagcgctctttcatggttcaagccctgaccagcaagaactatcatactgaaataatcaacctgttccctgccactctaattgatgtttctatggtggcccagaatcctggagtctggatgctcagttgccagaacctgaaccatctgaaagctggtttgcaggcctttttccaggttcgtgactgcaacaagccctcaccggacgacgatatccaagacagacatgtgagacattattacatcgctgccgaggagaccatttgggactatgctccgtctgggacagacaccttcactggagagaacttaaccagtctgggaagtgattcaagggtattttttgagcaaggtgctacaagaattggtggctcttataaaaaaattggtttatcgtgagtg

SEQ ID NO: 676330 - DNA, 843 bp, Homo sapiens
cggacgcgtgggtgcctgtctagatctccaggataacgggcctgctgttgactccaccaggtctgggcttagcgtctaatatctcgtaacctagggcgtgagctgcaacaaacgtgtcagaaagattattcaactttcccatacttgtctgaaaatgagctgatccgcatctcttgtcaaacacactagacatttctgcgtctagagaatagacacataagtgctccagctcccgtttgtagaaagagatactatgaagtgggaaaagtgctcgtgacaagtccgttttgctgtcaataacagaaaggtgtaagacttgttacacgttcccccaatctcgacattttgcatttgtgactgactattggttgacgaacgtacgatccttagactgtcgagtttattcacaaaggtgccttggtaacgaactagaatatgacgctgttgtcttgacgggcaggtgcaccacgttagtgtttggcggtcctgcgtttgaagtgccctttctgccaaagatgtttgtgactggagcgctgtttcgtgcagaccaagacactaggattaccgctgttgttctgcacgccggtttgccgtgcatggccaagaggaaaacgtcacgtggattaaacatcatgtgtatatcttggctgttgtttgataacatttaaactttttgggatagaggcctcgtctcttgtcaccctaggtgtagaacagtgggatgactcatgcgtcactgccggcttgaattcctaggttcaggcaatcctccacgtcggcctctgagtagtgggactggcgtgcatgccacctttcctggtaattattttgggtaaaaatggg

SEQ ID NO: 676331 - DNA, 364 bp, Homo sapiens
cgtgcatcccccttggtcctgtctctttctgagtatctgaccagatcttcttcaagcttttctggttataccccgaggccccgcacgagcctggcaaattctaaaaggcaagggtcagcggcgagacggagctgtccttccgccagggccacgctgcagacctcgaacgtgtagacagacacggagacacccaaggcctcggccatgactcgccgcacgttgctgccatacagcgcggcggtcctcttctcctcctcagaagggctgtacacaggaaggaactcgatttccacttgtctgtcaaactgacacagtgtgagccacaggacttccagcgctccaggtccttgccacgaagggagct

SEQ ID NO: 676332 - DNA, 396 bp, Homo sapiens
gcacgagaaaattaaccagcctatttcatgacatttactactccagccccacctacttttatcgggtatatcccaaggatcaaaaacagaactggcgcgaactggcaggcatccgcgtcgaatatgccctgcctgctggcaagttggacccagaagaggcaagaaacactacgcgcgaacgcatcaccgacaccttcagcatcggcaatgtcaatttccccaccctctggacccgcgccaccccacccgacgtgcgcatcaccctgggtggcaacaatgcgggcttcgtctccctgcaagccgcgctggcctacctggaagcgcatccgcagcaaaccgtgtgggtcatgaactgggatgcgccgagccggccgaaaaccatgcagatcaatgaaa

SEQ ID NO: 676333 - DNA, 325 bp, Homo sapiens
gcacgaggaactcattagtgtttttgagtttattttatatgtacctgacaattcaatgtaaaaaacaaacatggctggcgcagtggcccatgcctgtaatcgcagcactttgggagttcgaggctcccaaagttcaagatcagcttgggcaatacggtgaaactccatctctacaaaaaatacaaaaattacccagtcgtggtagcatgcgtctgtggtcgaagctagttgaggggctgagatgggaggattgcttgagcccaggaggttgaggctgcagtgagctgtgattatgcctctgagtaacaaagtgagaccctgtctc

SEQ ID NO: 676334 - DNA, 874 bp, Homo sapiens
caatattactcaaatattgcgggaagtgacatggtcatactaaaacaaacaccataatattatataataaatacttagataagtttcgatgaggaatggcttaggagaggacattatcctccttccgtgatgtggatattccctcgataatcgcctcctcttactcccatgctgaagggagtaagtactcgtcatgcatgcattatgttatctggagagaaaaagcactaggtattgtagagacaccagtattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgacatggatcatttctacttgctggtgcatttaaccaataatctgatgaatatagaaacaacatgatccaaacatatggatatgatgcgatgctctgtacacatacatggcacgttggcaggaaatctctgaaacaatacattagattaagtcagtttcgaaggagaaggttgggctgatgcttgagtgtttgttcataactggcccgacggttggcaacatggtctcattctctgcacaaggtgtaaaaatactgaatctaagaggctatattgcccggattctggattccaaatcaggctgactcgtaacgcagagtttagaatgtttgcttgaacgaaaccttgcagca

SEQ ID NO: 676335 - DNA, 202 bp, Homo sapiens
attacaggcacctgcatcatgcctggctaactttatgtatttttgtatagacggggtttcaccatgttgcccaggctggtcttgaactcctgacctcagatgatccacccgcttggcctcccaaagtgctggggttacaggtgtaagccaccgcacctggcatctggataatttttcagttttttgtagtgaggttccatcg

SEQ ID NO: 676336 - DNA, 239 bp, Homo sapiens
ccacaaacaggggtgaaacccccggcccttggacgttacaaaaaccaccaataacacggcgcgggcgggggacagcccgcggaatcccacacgccgcttgggggggcgtagcgcccgcgagaaatcctgtcttaaatcggggagggcaacgacagtccagcaaccggcaatgcacaatcccctttaccccccccgggcccccaaaggggaaaaccctttcccaaaaaacccaaaaaaaa

SEQ ID NO: 676337 - DNA, 136 bp, Homo sapiens
gtcggtggggagtcactcctgctccgggggggctcctggaacttgggcccaccagatgtggagccgctgtcacttttcctcctcttaggggacgctgatcgggatggggacctcgagtagctctgtcacgggtccg

SEQ ID NO: 676338 - DNA, 886 bp, Homo sapiens
  misc_feature (386)..(386): n is a, c, g, or t
  misc_feature (622)..(622): n is a, c, g, or t
  misc_feature (629)..(629): n is a, c, g, or t
gctgcggcgggcgttgttctatgtttgagccgtccgtgcttcaccggtatacctcgctaccatgtcagggccgcggcaagactggcggaaggcccgcgccaaggacaagtagcgctcgtcgcgcgccggttcctccagttcccagtgggccgtgtacaccggctgctgcggaagggccactacgccgagcgcgtcggcgccggcgcgccagtgtaccctggcggcagtgctggagtacctcaccggtgaatcctggagctggcgggcaatgcggaaccgggacaacaagaagacgcagaatccatcccccgccaaactgagagtctaggccatccgaaacaacgaggagctcaacaagctgctgggcggcgtgacgatcgcccagngaggcgtctgcccaacatccaggccgtgctgctgcccaagaagaccagcgccaccgtggtggcctgaatggcgccctcgggctggcaagaaggccacccaggcctcccagtgagtactaacgagtggccctgcgccgctggcctggcctgccaggcctccccatgccaccacaaatggcccttttaagggccaccacctgcccgtcatggaaagagctgagccgcttcagactgcngggcaangcggtgcgcggctcacttaccattggaggtaatcaagaattgggcattacatggaggtaaaaacgacaatgcatggctgttacatctgacgccgaagcataagacatgtaagcgcccaagcaaaaaaacctgaaatagcgtcatcacacacaataggtcttcgacagcacagttagctctgagactgttcacggagacctcattatgaacctgacagagatcccaaccaacctggtgcctaccttgattcaattcaa

SEQ ID NO: 676339 - DNA, 221 bp, Homo sapiens
  misc_feature (24)..(24): n is a, c, g, or t
tcaggatccggctaggagctatgngatgggtaaggagacagatcctctcaggtatcagtctaagtagtccaaaggaattgggctttgttggcctacaatgcaaaggataagtttacatgagaagagcggccttgtcattttggagttaggtggtgcccttcacttcatgtctcttagtcggagagagaaaaaaggcggaaccaaaacccagaacaaaacca

SEQ ID NO: 676340 - DNA, 218 bp, Homo sapiens
ttcctacacgtgttaggtctcagcggaaaggtgatttctgcgaggaaaccttccaccatgccagtctaaatggggtcttccctgtgatactctcatagcaccggtgcggcttttattctccacgtcacacacggacttggagttattggtcagatgtctgtgtgtcccggcgggaaggtcaatcccaggaaggtagagagccggggggtacggagctc

SEQ ID NO: 676341 - DNA, 144 bp, Homo sapiens
gttctgcacttcagcctaggtaacagagcaggaccccatctcagtcaatcaatcaatctcagtggttgaactacccttgatatggttcagctctgtatccccaaccaaatcttgagccacccagcaattcttctttttagaatt

SEQ ID NO: 676342 - DNA, 544 bp, Homo sapiens
gagataaggcagagaaggttgaaaagatcagtcgagcttaatatatcgtgttgtatcatggtttgcttccaagatgaagaatatactgatgttatggtcccaatttttgctatatatcctgttctggggacagttaggtattaaaacaatttaatatagatccggtggtatggatgagaaaacaatagcttgacttgtcgctggtactagttgatcactgtcagtatgtcgtagatggagccattctttacgtcccaggtgaatgttcattaaagaatgctactggccgcggttaaacagtgagaacgacaggaatatggatattgcttcactaggaggtgtgtagtaacagcgagtaggattaaactccttcgtcattgccatattggttattcaggtgatagcctatatcctcgctgtggttggactgagtctctgtatagcggcgtgtataccaatgcatggccctcttctgatttcaggttagagtatcttagctctagcacaattacttggactagtttatatgaaatttgtggggttc

SEQ ID NO: 676343 - DNA, 454 bp, Homo sapiens
tgacttggtaaagttaatatctatttatgcacccgactagccctaacccaaggaatgatatatattaatggcctcgtgacggcttttacgcggtgcacctgagaaaaactttgcttgaagttagtggacgagtgccgcattacaggagaatcaagcgcgggacacattgtacggtgacggaaattagattacaattaatagggggccgactgacgcaagattagagaatttggcctgtggtgacgtaaacaatacgagacacttgttcacgattacagcggaaacaaaacaaattgcatttaggcggagggacatataagggcagaacagcatgaatgtatagtgaaaaagacgcaagaagtacctttgttagtggttgagaaattattcgggaatgattgattattaccggaagttacgaatacggaagaaggcaccaatataaccttgaaac

SEQ ID NO: 676344 - DNA, 181 bp, Homo sapiens
gaccccagaggataaaactccataaagtgagcccaattaaacacatgaaaatggttgatccagctgagcacgcttgctcagatctataatcctagcactttgagaggccaaggggggtggatcgcttgagatcaggagtccgagaccagcttgagcaacatggtgaaaccccatctctacc

SEQ ID NO: 676345 - DNA, 160 bp, Homo sapiens
cgcatcagcgaacaccaccggcccgtcatcggcgtgcacagtgggatcgcccggatgcccacacccgtcctcagctgtcaatccatctacctacacatctgtccatctacccatctacttccgccgattttacaccaacccctgttcggttgagcggaga

SEQ ID NO: 676346 - DNA, 140 bp, Homo sapiens
  misc_feature (32)..(32): n is a, c, g, or t
  misc_feature (63)..(63): n is a, c, g, or t
  misc_feature (65)..(65): n is a, c, g, or t
gtgattagcatagtgatgcctccctcagcagntcgggcaacacagacggtgtccctacgtagnanaaagccacctgcagtaaatggcaggacccagccaggacctgcaccacctgcaatttcactgcccactgctcctcc

SEQ ID NO: 676347 - DNA, 194 bp, Homo sapiens
  misc_feature (81)..(81): n is a, c, g, or t
atgggcattcgccgcggattcaccgttagtctatttaggcgacaactggtacaaaattaatgactatcttgccgccaaagntttattgcaggttaaaggcagttctcctactgcggttcctttcgaaaacgtgggcacagggggggatacccgatggcatatttccgaccctggcggtcaacgtttaggtgggc

SEQ ID NO: 676348 - DNA, 256 bp, Homo sapiens
catgtgggtgatacccgtcatctactaaaaatatgaaaattagccaggcatggtggcgcacgccgtctaatcccagctactcagaaggctgaggcaagagaatttcttgaatccaggaggcggaggttgcagcgagccgagatcgcaccactgcactccagcctgggtgacagaacaagactccatctcaaaataagtaagtaagtaaataaataagattatcaaggaaagtgaaaagacaacccacaaaattgga

SEQ ID NO: 676349 - DNA, 204 bp, Homo sapiens
cagagaatactgttcctaattaaaacaaggagacaagtagggcacaatggctcatgcctgtaatcctagcattttaggaggacaaagcgggtggattgcttgacgccaaggtattcgagaccagcctggcaacagggtaaaactccatctctactaaaaattaaaaaaatagccggtgtggtgatgtgcgcctatagtcccagc

SEQ ID NO: 676350 - DNA, 194 bp, Homo sapiens
  misc_feature (46)..(46): n is a, c, g, or t
  misc_feature (60)..(60): n is a, c, g, or t
  misc_feature (66)..(66): n is a, c, g, or t
  misc_feature (101)..(101): n is a, c, g, or t
  misc_feature (114)..(114): n is a, c, g, or t
gacactctaggggcagaaaacgtgatctaaggagtgaagaggcttnctgagatcgcacanacaggntaagacttgcgccagagtacctatccccaacttcngaagttagttttnaataagctgatgatctgatttacttatgtttacatatgtagctgctaactgaaacaaatttatttcttttaaacggaagg

SEQ ID NO: 676351 - DNA, 210 bp, Homo sapiens
ctagaggagtctccgctgatcgcttaggaaaaccgcaagaaccagggcactgtaaattggtctgttgatgacattgtcagaggcataaatagcagcaatgtggaggatcagctccaagctactcaagctgccaggaaactactttccacgagaaaaacagccccccattagacagttacagcaaatgcaggcgtcgccagaatagaaggt

SEQ ID NO: 676352 - DNA, 800 bp, Homo sapiens
ctggtcgatcctttgtgcctaaatatatgcctatattggccacgcctctcgactaataaactaatctatgacagcccctactacagcaaaggatcccagaaatggccagccctatcttccccatctgtgaccctacagatactcgagacatgggcctcatcattaaaggcagagccgggtctccatcccaaccaaatctcacctcctgcctgtattatctcaaggtactggaccatccagacggagaggggcaatgtcctcgggctgttcctcaacctgatgtgaacggatcacccttcttccatgcttccctgacctagaactatcggttcctgtaagcgggccctggccacacaaacatggacttgccgttaatgctatagaatgggaaccaccctggatgtatcctgccacgatctagccatgattccgccatcatcctcaaaaaggcccgagtcgctcctcgctgcacttaccgccccgccctttgtgcccgcttgcctcacccgacggtcaattaatgattcgcagacacccgcccacgctccccatgcaccacccattcacccccctcgacatctacctccatccccgcactctacacccctcaccacctacaatatcgcaatccccataaatacacccgtaacacacacccacttttatatctcaacccctaccacactttcccgtttacctaacacttccaacgtaatccctcattcatctccacaatatcaaattttttcaacacaccttaccgaaatacttattccccatcccagtccaccgcactcccg

SEQ ID NO: 676353 - DNA, 167 bp, Homo sapiens
  misc_feature (31)..(31): n is a, c, g, or t
  misc_feature (57)..(57): n is a, c, g, or t
gaataaaagtttgcaaaccaccatgaagctncaagtcttctcttacttttcaacttncaactctgtagtgtctcacttttaaggacagcttgatttccaggagaaaatagattagcaatcaagttatctccgacttctcaaggcttatgacttctaaaaagtgaatc

SEQ ID NO: 676354 - DNA, 296 bp, Homo sapiens
agcacaattatcctaacctttgtttaggggtcacacagtacgaacgtcctgagaaggtctccagtgagaaggacaacagatgccacagcactggatttgcatggactctgcaacatgctgaccctgagctaccagttcttgctgggcagttcttcttacccccttccaggttcccagctctgcagcccccgtctcatacctaagaggctttgatcctcctctcaaatctgttggctcagccctgtcacaatttctaggactaattctcactttagaatagcgaccccagatctgag

SEQ ID NO: 676355 - DNA, 988 bp, Homo sapiens
  misc_feature (987)..(987): n is a, c, g, or t
gggctgctgagaagcaggtcccaggcggcggcggcgggcggctggcagtgtgctggtgggcggtggcagtggcggtggtggtagcggcggtggacgtggtgccggaggggaagacgaataaagaaaacgaacgcctcttgccgagcggatcgaaggcataacaacagaatttggggatagcctgcagtttggacgattcttcatgattgattaaggatgtcctcagcagcgaagcatggtttactggcatggagatttgtcagaggttacaggggctacgtgttcccgtatgacaaagacgtcttcgaaagaactagtctaacttcaagatgggtaacagaccacaagattcagagggaagaagaagtgactgaagagcttctgaccgataatagatacttgcgttctggttctgatggatgctgaaggagcctggagctacgccatgcagctgaaacatggacagccaaactgaaccccgaaaacggtttcatcttgttatctcgcctacgcaaagccgtgaagcatgcagaggaatggaacgcttgtgtgagagcaactcgcgtggatggcaagaccagattagaggctcaggcttacacagcttacctctcaggactgctacgttttgaaacatcaagaatggaaagctgcattgaggttcaaacaagtgcaaagtatctatgagaaggtagccagtgttttcacagaggagcaggtgtgctgtataaacaagtgtggaagaaattcagccaaatcgtaggttcttatatgggacagtcagcataatgatcatgcaatgaatgaggtctggggcgaggttctggtgaaaatgaagattaatggagtcacaagcttctattatggtttttggagcgaaaatgatgtttattgaggcacggaattgggttaataaataccgttatgcgggaagcggggccaagagaattacagggtacatcaattgtctctcttattttctgttana

SEQ ID NO: 676356 - DNA, 187 bp, Homo sapiens
tactatagtaggcagtacatgcaaagcctccagagccatcgttcagaatcgatcactaaacattttttttcttagagacggaaacctgctctggtgcccaggctggagagcctgggcgcgatcttgactcactgaaccctctggctgacggaactgagcaagtctactgcctcacacttgcgagtag

SEQ ID NO: 676357 - DNA, 902 bp, Homo sapiens
  misc_feature (1)..(1): n is a, c, g, or t
nagttcccccttggtgtgaaccacgtccgtttggcccttttgtcttgagggtgccccaggtgtcccaaacccgtgtttttatctcctggccctgtcgttggggttttatatgttctagggcctgggttgcggattttggcctctggggttactgttgagttggcttgagtctccacggatgtccttgtgtccccggtccccgcccccttgggaaactcccaggggtttggcttccccggtaaaacaccaatgctctgatttgcttgggaggccccccccccgtttcggtcccctgggtccctcccctttgcgcaatccccctggggcaccggtcccttcttcttgggaatccccccgtggacccccccggaaaggggaaagaatgagggaatttcaccatcccctgttttagattccccgttaccctttatgccctccaaagtttgggttttttaaagccaaaaaatagaaaaaaaatttgggtttttggggaaaaagggaaaattttttttttctccttggttttgataaaatgggaatttgggaatttttaatgctattagcccctgggcttgccccctttggggcacgctatttaaggggaggggatttctcccccggctgggggtgagatattccccccccccccgggactccccttccctctctggctcctctcccctctttctatgaggaaataagatgctcgtaactcttttggaacctccacattttttgattttttatttgggtaggttttggggtcccggccctctttttttaccccctctggaggaaataagatgagggagaaaggagaaggggaggaaacttctcccctccccccttcacccttagcttcttgaaaatgggcccctcccgaataaatctgcccggttttt

SEQ ID NO: 676358 - DNA, 248 bp, Homo sapiens
ctcataggctgggaggggaggggctctctgatgtataccccacttgcactgtttagggtggctggtctgtctgtcagcagagatgcaccaggatctctagaaggtggagtcccaggctaatggcaggcaatagctaggagggagagatagcaaggcagactcggcagtatgtgcactggggaccaggacttgcggaaagagggcgggcaccttgctcctccattgttgtgaatttccgatgttccgca

SEQ ID NO: 676359 - DNA, 188 bp, Homo sapiens
acgacggaccatatacacatcgatggtacaggtatccagatcagggacgatgagccagtctagccacggaatgagagtgcccgtataggtgcctgtgtattcactcatcaaaggtttcaactgcattgtggcgcacggggccagtacgggtcgcctctacggtcgcttcacgtaaaatttcctgcaat

SEQ ID NO: 676360 - DNA, 292 bp, Homo sapiens
aggtcactctaaggatcccgatcacgtgcattgtggaagtggatgaggagaaaaagggagggtgagtgaacagaagcgtgtcttggctgtgcagagctgggtttcagtccaaggggctatcccttcaacccctcatggtgccagaactgaccaatggagcccacagtagagtgagaagtgaaaaccccattctgtattcccagagcgcagctagtttcatttacagatgggaagcaaacccttgggatactttgaatgcttaaaaatccaacaataaaggaaagaatgaaac

SEQ ID NO: 676361 - DNA, 433 bp, Homo sapiens
  misc_feature (42)..(42): n is a, c, g, or t
ggtgggcctgctggtcggcatggtaactcgagcgcaccatcnggcccgcaggcggcatgcgagaagcccatggcctgcgcctcgcgctcgaacatcgtgaagacatcgggatgcgcatagcgcagcaccggcaggtggtggccggagggcgccaggtactgtccgatggtgagcatgctgacgtcgtgggcgcgcaggtcgcgcatgacggcaaggatttcctcgtcggtctcgccgatgccgaccatcaggcctgacttggtcgggacggccgggttgcgcgccttgaaggccttgagcagggccagcgaatgcgtgtagtcggcgccggggcgcgcctgcctgtagagccgcagcacggtttccaggttgtggttgaagacgtccggcggcgtggcggtgaggatgtccacggcgatgtccaggcggccgc

SEQ ID NO: 676362 - DNA, 167 bp, Homo sapiens
cgacacgctacaggattgacatgattgatagctctttctcgattcctgtgggatggtcggtgcctgggcagaaccctaggttggtggagcgatttgtctggttaattccgataacgaacgagactctggcatgctaactagttacgtgtcccctacgtgtccggcca

SEQ ID NO: 676363 - DNA, 225 bp, Homo sapiens
  misc_feature (52)..(52): n is a, c, g, or t
cgattatcgacttttggcacaagaacagagagcgaacgagcagagaaagganagtgaagaggaagagaccagtatagatgttgctgggcagccaaatgaagttaccaaagcagcagaatctccggaccagagagacacacatggagggccccaggaggaggaaagtccagtctgaatccatggggctgcatggtaaattgagcagttcatgacccaggatatctg

SEQ ID NO: 676364 - DNA, 135 bp, Homo sapiens
tctctacagcaaaatgaccggctcgcagcgcatcggcatgttcggcgcgcagaaagacgacctgccggccatcttgcgcaatgctgctcgccgccgcgttttgaaacccggccacgtcttacgccactggcgctg

SEQ ID NO: 676365 - DNA, 233 bp, Homo sapiens
ccctcagacctttgccggtcccattattggtcctggtggtacagccagtgccaacttcgctgccaactttggtgccattggtttcttctgggttgagtgagatgttggatattgctatcaatcgcagtagtctttcccctgtgtagctgagcctagattcttctaaacactttgagagcacatcttgataaagtgctcagataaattatttctgtcttgttatgctttttccc

SEQ ID NO: 676366 - DNA, 888 bp, Homo sapiens
cgcacgtcgttcccgcctccgtcgcggccgccctcgctctctcgcgctacctcccgccgtccgggtgcctccgtcggtaactctcgttagtaccacggtctggtcttcagctacccgcacttcgttatccgagttattgcgactcgcggacgggtacccgggcgaggaggctggatacggatcgttgcctgagcaatggtgcatccggaagaaactggtgattgttggtgatggagcctgtggaacgacatgcttgcttcatagtcttcagacaaggaccagttcccagaggtgtatgtgcccacagcgttgacgaactatgtggcagatatcgaggtggatggaacgcacggtagagttggctttgtgggacacagctgggcaggaagataatgatcgctgaggccctctcctacccagataccgatgttatactgatgtgtatatccatgcgacaaggcctgattgagttagaacaaatcccagaaaagtggccccagaagtccagcatttctgtcccaaggtgcccatcatcctggttgggactacgaaggatctacggaatgctgagcacacaaggggggagataccccagatgaagcaggcgcaggtgacagctgcaggaaggacgcgcatcatgcccacacggatggcaaccgaagcatacaggagcagacccgcacagaccacgaagcggtgcgacagtggtgccaagctccacgcagcgccagacgaaccggcaacaacaccagacggcagccagaacactgacgcacccccgccataagccgcacatacagagagcaccaccaccgaaacagccaccccacacaacacaccccccgccaaccaaagcaacaaacaagctaccacacgagcaaaacaaaa

SEQ ID NO: 676367 - DNA, 214 bp, Homo sapiens
agggaggggaagccccaaattgcaaacccagggggccctttttcattttttttaaaaccctgaaatccccagcccaaaggggatgcccccctgccccccccaagcctgggattgggcaaaacccgggttttggttctttgtaaaacggatgttttttggcccaagggcgggtgggaaacagcccttgtttttttaataaaaaaagggtttgcca

SEQ ID NO: 676368 - DNA, 491 bp, Homo sapiens
  misc_feature (171)..(171): n is a, c, g, or t
  misc_feature (365)..(365): n is a, c, g, or t
  misc_feature (381)..(381): n is a, c, g, or t
  misc_feature (383)..(383): n is a, c, g, or t
gaccgtcggggcagggagaattccgctcggtggagcagctccaggagacgctgctgcgggccttccgggctctggtgctgtagaacggggccttggaggctttcgggttccgcagcgtgctgctcaaactgccggacctgggggccctgaacaacatgcatttcgagaagntgctgtccttctgggtggacggccagtgacccggccggccggccttttggcggtgcccccttggacagaaacgaactgggcgcttctctctcctttaggaggcggaaaggaaaagccaagcgggatcttgttttttttgggataaaatatttcgaggtgggccgctggccccctgagccttcttggaaaaaccngcctccctcccccatnancggacttcccctcctcccctattttaacccctctgtttccccccccaccctcccctggccctttggtttggtttggtcctgtttcaaatcccataggtcccagctgga

SEQ ID NO: 676369 - DNA, 1135 bp, Homo sapiens
ctcgccagcaccgccgccctctgccgccgcacccatgcacaccgcgaccccatctcctgtgccaggaacttgctactaccaagcaccatgcccataccaaatatccagcactgaccccggatgcagcaagcaaggagcatgtcatgacactcgatcaccagcatcgatggcacctggcaacgggcatcctggctgcagaatgagtccacatggagagacattgccaagacggcatgacagatccactatggacaccgagaaacaccgcaggaagaaccaggcagcattctacacgccagcatgctgacatgaccagccatgaccagcaccgccgatgcacaccccatgcacttgggcggatgatacatacctcattccatgaagaccacctcctaccacgcaacggcgagactgatgcgcgcgtcccctatcccaccaaaagcttactcaaacatccaaacgggcacggatgattgataggcgcaaatcaaacggtatacagcacaaaggacgcaagataggatcccactacatgtgacaataggcaaaacgcaaaactagcgaccgcacacacccctaccccaaccaccccaacgacgcgcatctgcgcacactcgcagccccactggatacaactgaaaagacccgccgcgcgcagaggcaacaccaaacagtcacccccccagcgaaaacacagagcacacaccctgtcagcataacggcacccctagaccaaaccattgcgcaggaacaccaaaccaagacatggggaacaccaaaccaaaccgacattgacgttgccactacaaacacagacacattatgagccgcgcactaatcagcccagtcacgacccgcatatcaacaacccaccatatacatgcaccaaaatacacattgcaaacaaaataatagcacacaaataacgctactccctagacacacccaaacatacaacttaccccacgatcaccactcaacaccaacacaatctaaaccctctcacaattatgcttacacactcaattatacataaacaaacccataacaaaaattacctaccccaatgactacaacagaacaccaaccaacacaatataaaaacaccaaagccccccacaaaaccactataaac

SEQ ID NO: 676370 - DNA, 148 bp, Homo sapiens
actagtccacggttggctttaaacgcattgcctacaggaaagcagaaatacacttttgaaattgaatatccttgtaaagctgcgcatggtggtctcatgcctgtaatcccaaaactttgggacgctgagacaggtggatggcttgtag

SEQ ID NO: 676371 - DNA, 172 bp, Homo sapiens
tagaggatctccctggtatcccacccaactaggaggacgtctgtttcatgagagatgctgtcctgtgcttggatagtcagtcaatcatttgtgtatgagacaatgtacattccatgttttgaaataatgatctcagacttctaagttaaaattttaaaatttttgtttgttt

SEQ ID NO: 676372 - DNA, 121 bp, Homo sapiens
ctcccaagtatgagaaatagtagagttacaccaggtgttgtctataggggagaggaattagatggctgaaataggaagtagtataaatgctatacactttgttcattctatccaattccta

SEQ ID NO: 676373 - DNA, 336 bp, Homo sapiens
  misc_feature (223)..(223): n is a, c, g, or t
  misc_feature (239)..(239): n is a, c, g, or t
  misc_feature (274)..(274): n is a, c, g, or t
  misc_feature (286)..(286): n is a, c, g, or t
tcatcatttgtctctgtgtggtttgcatatgcatgaagaagaatgcaggtgggagaggaaggcgtgacacccaagaagcaggcagagacagtccccaagactctagcaagactgttgtggatgatgaggagatgggggtttgcttttggaagattaagtcctgtaaaacttgtctaggccactccccaggaacttcagttggcgagtctttacctgtcacctngacttggatttaggantcatctggggagatggcccctttgagtggctgggnctgtgaaggacngcaggccaattctttgcacccctggacagaaacacatctcacctttctgg

SEQ ID NO: 676374 - DNA, 217 bp, Homo sapiens
  misc_feature (14)..(14): n is a, c, g, or t
ttcatgtcgagccnctttcatcccctgcagtagtccaagctacaccaaacattaacacatatttgtggtaaacatttctgtataaagttacctgccacacacataaacacaaagaacattccatgtcattagtcggaacaaaaatttaaaaactgggtcatttgtgaaaaacctcatgtcgtataaaagttaaagggatgaaaggcctggacatgaa

SEQ ID NO: 676375 - DNA, 837 bp, Homo sapiens
gaacgatagacccatatgtgcatagagacagcaacatacgcagcatcctaagatctagtgtgtatataagacatttatcaagctatctaactcagtttccaaacatgtatccatgattttataaaccgtcttgatttcctagtcaacatactatagaaaacaccgtggcgtacgtcaaaacacaacttctcagtgtcatccatggctgtcgtgagagacaacatagcgaatatctggtatgttgcaagcgtttcaagcatagtccgtgaacgttaaagagagtttggtggcattaacgttgggtatcgtagaatgggataataaagtgttgcgctcgcgtagattcaacgtgttggtgggtcaaagaggcttaaaaagcgttgtggaagcgcgtaagcttttgcgtgctatgaattggggtcggggtaaagtagactttgaaaagagtacacacgactgtgtatatctctacaataggcttcaaagaagagagagagataatacaacagagagacaacaaccacacacaaaccaagcacacatacagacacacagacacacagacaaagacacacacagcaaacagacacacaccacacagacacaacacgaagacacaaaagcacgacaacacacatacactatcacatacacacacagagagagagacacagagaggggagaagagaagcgcgagcgcggagcgcgcagcggagagcagacgaagagagaagaggcgaacaactgcggcacgagagagggcgcgcagcacggcacgccgcgggccgcgcggggcgcgcggcgccagcgcccctcggggacagaagagaagggagc

SEQ ID NO: 676376 - DNA, 537 bp, Homo sapiens
cacgaggtgccaaccaccttacgggaggcgggtaaagctgttccatgggggggcaaaggcgtcgcctgcgcccgtgaaacggttctacttgtgtactgaaggagggtgctatggggcttgcagcagcaaaggcgctcgagccggagccacgaccgaaaggcctgcatctgctcggcgacctgtacggttgcaaaggggaggatcggtacttcttcagcgccgatctgctgcgggagcactgcttgaggttggtggcggaagccggcctgaccccggtcggcgattatttccaccagttcggcaccgacggcggcgtgaccggcatggtggtgctcgccgaatcccatctctccgtccatacttggcccgaaaagcgctacgtcacggtggacgtgttcgtgtgcaactacaccagcgacaaccgccacaaggcgcacaagctgttcgacgcgctggtggacacgttccgtccggacgagccccgcgtgcgctcggtggagcgcgaataaggccgctagccgcgtcgatacgccatga

SEQ ID NO: 676377 - DNA, 85 bp, Homo sapiens
  misc_feature (1)..(1): n is a, c, g, or t
  misc_feature (35)..(35): n is a, c, g, or t
nattcggcacaggggaggtcttcctcaccgctttngcgccccgaagccgaccctgcgctacttcaccaccgagcgcttcctgccc

SEQ ID NO: 676378 - DNA, 1107 bp, Homo sapiens
gctgcttcatcctgtgggggcctgtggccctgtccctgtgtgggtggggctcttccatttccctgacttagaaaccacactccacttctaacagtggttttgagatggcttagtcagcactgggtagctgtttttgactccattcttgtgctttctttttctttccagaaggattttttgttgcatgaaatgtggtctattttgtttgccatgttatgtcctccttgtgaatgtgcagctcatgaagtgccttgtgaaatgtcatgtggtgacagtgacccccagggatgtggaacccctaggctactgcactttagtggttctgttctccatgtggagatgctgacctcgtccccctgatcctgacctgcccttcctggtccactgctctccgtgttttggcttccacatggcctggacttctctggcttctctgcccacacactccctgtccccatgttgtccctgcccttgcccagcacatggtgacttcatcttcttgtcctctcagctcagtggactcgctcaacttttgtatacgtctccacttggtggccagcagcttgctgcactgacttgtcccaaaaccttccatcctaaataacctttctgatacttgaaatattcggtcagcttcaatacagtacgtttctaattatatccctgaaacggatacagatacctaattaagatgctgggcatgtaatcccgtggcagcatcctgtgtccatgacagcaatctgggacttccctcctacgctgccctgtctcccgcttgtccatcagtgaattgtggtcctgacgtcctctgtgagaacacggcatatctggcataggtcagaaggcggccaggccctagagaacgcggtagcacatctccgtacccggggacgacatgaattgtaagagccaagaggagcggtttagtatatcactccatattgtgcggcaccccttgtctgggagtaatacccgcgacccatatatctaggtgagcttcgtttgaacacctggctaccaacgaaaagacaaactggagcggccacaagagttatttaagtgaaagtaaccgtgttaatttctaccacttacataaagcgggccttg

SEQ ID NO: 676379 - DNA, 720 bp, Homo sapiens
gaccacgcaggggaagagacagcaggagccgtccagcacggaggaaggcgacatggccaaggagtggggctacgcctgtcacaaggtcctgaccactggcatgaattttcccaaatgccaagggggaaaaccagttcgcccatttgagctgcatactaaagacatcaggcatgaccccttctctgccagaccatggtctgtgtcttcatgatgggggctctgcaaaaaccaatccctgccctaacttgggaagcaccgtgccgagttgtatttgaatgactacctttatggatacgctcacagtgctggacgaggggcggttcctcctccctggacctctaccgacttcgccagatttcatcctttccacctgggggctcttccggaatgactccatcggcctcttggacgcaacacccgtgtcgctggagtcccagtattggcacgcgggacgcttactattttgagtcaactgggcacccacgaacgtctaccccctttagaatagaacgcccctgcaaagcaagcagccgcctgggattcgcctggagactggcattctttcttggaacaatagggccacttgcagacctggggcgagttccacgacctttcccttgaatcgcatcggacccacatcattaagcccacagggccaaggacggcgccttacaacacgtttgccccaatccggctgttcacggcattgccgagaaaaca

SEQ ID NO: 676380 - DNA, 309 bp, Homo sapiens
cgttgcccctcccttgcctaccactgccagccggtccacccagctagctccatacccccaccaaagcaagtacccaaacacacaatccaaggtgtggatgatctctggtgatcacctcactaagtccaccaccagtgacacctgaacactactcccagggtctgaggtcaggcccacttaacctgccactaccagcagagctaggacccatactcatgcatcacctgcaggtctggggaccagcccacacaactcattgcagccaccacaataccagcggtggacaactccctggaacctaagtgtctg

SEQ ID NO: 676381 - DNA, 1180 bp, Homo sapiens
cgatccgcctgcccgtccacaccgcgccgccagctcaccatggatgatgatatcggcgcgctcgtcgtcgacaacggctccggcatgtgcaaggccgggcgttcgcggcgacgagcgatgccgccccggggccgtcgttccccatccagtcgtggggcgccccaggcaccaggggcgtgatggtgggcatgggtcagaaggattcctatgtgggcgacgaggcccagagcaagagaggcttcctcacccttgaagataccccattcgagcacggcattcgtcgaccaactgggtacgaccatggacgaaaatctggcaccacgaccttgctacaagtgtggctgcgtgatggctcccgtaggagcacccgcgtgctagcgtgaccgaggacaccccgtgaagacccgaaggacaacacgccgagcaacgatgacgccagaatcatgctgtgagcaccttcaagacacccagaccatgtagcgtcgctatccagtgctgtgctacatcccatatacagcctctgtgccgtacgcactggtcatcgatgatggacatcccggtagacaggggtcaccgcaaactgtgcccatctacgaggggtatgccctcccccgatgccatccatgcgttctggacctggctgcacgggacctgactgaatacctcaatgaagatcctcaccgagcgcgggtacagcttcacgaccagtgccgagcggggacgcatagtgagtgaattacaggagaaactgtgctacgtcggcctgtgactgcgagacaaagatggcacggatgtctccaggtctcctggcaaataactagaactgcctgcacgccacgtcatcacattggccacccacccggtccccacgagacgacggaacacacaccgaaccttccaccctggcatggaacccgggaaacaccaggaaaaacaccccacaacacccaaacagaaagcgagaggacaacccgagcaaacacagtcgccacaccaacgggcaacgagcccacacaaagacagggccacgcaccaacacacaacgacaacacccgaacaaacaacggaacacacaatgtcgcaccaacccacagcggcggaacgcccccacccaagccgcgaccatagcaaagacgcgccccacagaaacaacaccacagacacgtacatcagtgcaccc

SEQ ID NO: 676382 - DNA, 303 bp, Homo sapiens
caggacagatctcaaagtacaattcacttaccttgtctaaaacagtattcaaaggatggttatcggagagcctaggtaactgacccctagactgtccctaaacaagcacgagacagttaatgacagctagctagcagagagagctgccatgaattgaacaaaacttatataggatgcgcgtccttaatccaaaaacgcaagatccgaaatgctgcaaaacacagaacttactgagcactgacatgttggatttgggatgctcaactggtatccattctgcaaatattcttttttttttttttt

SEQ ID NO: 676383 - DNA, 246 bp, Homo sapiens
  misc_feature (172)..(172): n is a, c, g, or t
taaatatgggggtctcaggtaaccaggctggcctcaaactgtagttgaggctgaccttgaactcctgatcttcctgctgcccctccagggacttaaagcacagagaagcaagttcctactcctgcggagaggtcaaagcttttgatccttttgagacagggtctggccaaantgggcctggcattcctgaatcctctggcccaagccttccccagttgccattaccaacaacaacccaaagaacct

SEQ ID NO: 676384 - DNA, 81 bp, Homo sapiens
gcggccgcctactactactactgctcgaattcaagcttctaacgatgtacggggacatggcagttggatcagctcctttac

SEQ ID NO: 676385 - DNA, 115 bp, Homo sapiens
tgcacatctgtagttccagctacctgggaggatcacctgagcctgggaagttgaggctgcagtgagctgtgatcataccaccgttctccagccagatcgacggagcgagacttgt

SEQ ID NO: 676386 - DNA, 2575 bp, Homo sapiens
  misc_feature (5)..(5): n is a, c, g, or t
  misc_feature (52)..(52): n is a, c, g, or t
gaagnagtagaaggccaccataccatttacatcggagtccatgtgccgaagngttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagagagaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccaggtgagggcattacgctttgtgtttatgctcgctttgtatttggaggaaggtgtaggctccatgcttgcaaattttcaacatgctgtcatggtcctcaggaattagtcttgtttttttctctgaaaaactctgctactgaatttgatgtctcattgcctgaggtattttagctgtatgattcaaccaggaaggagaccaggagctctggaatgtgaacataaccaactcaatattttgaaattaactcaaactgtgggatttgcaaggaattcatgtgtacattattcttgattttataagtggggaaacctggatacatgtattaacagatataaatatgtgacaaacctatcctttgctgcttctttattggtgtaggaatgtcttcctttaagtaaacctttaatacatgattttaaacttatagaagaaaaagatactaatccacttcagataatttaaagaattaaattatgaaaaaaagaaattcagattggaattgcctagtggtagaattttatagcttatctctactagacaaataagaaaagaaaggaagagagaagaagaaatgaaagaaggaatgtgatgttctaggagtagatttacattgtagaatccagaaggacataacagcaaaagtaactcctggaaaggagtgtgattctctatatcttagccctttaaaatctatcataccaaacatgagttgacatcagaactttttcaca

SEQ ID NO: 676387 - DNA, 1355 bp, Homo sapiens
  misc_feature (1036)..(1036): n is a, c, g, or t
ggttgaagtttacattccagactgtagcctccaagactagcacgttccatcccactgccctgagtgtccactctgaggctcatgggactcagatctgggggactgggggcttcagaacaggagtcactatctgtccctggcctcaaacggaagggctcaacatctaaagaactctttgtcttaaaaatgtataagagacagggtctacactactatctcaccaggctgactgtgcagtggtgtgatcacagctcactgcatccttaatctacccaggctcaatatcatcacttccgtgacctcaagagctccaccagggtacgctgggcgacctacaagaggcaacgtagcacacattattgtcacgagcaataaaatttatctacacgtttaataagggtagaacagacttggagatctccacatattgtatgaccagggacatggatctataacaaatcctgggactccaaagatagaagatccgacaccatgggcctacaaaaacccagcacccaaggaagcagacagaaccaaagtgcaccaaggggcgatgacagcagccgaaagagagtgacccgtgggaccgctaaagaggaacggcacaccagaacaaccgcaataccacaccatacacacaacaacaaacaaggaggcccaggagaaaaccaaaccacgacgacacacgagagagtgcactccccgataaacagagaaaaccctacagtgggaaaaaaacccggggagaaacgaaggcgacagagagcacaagaggacaagacgaagcaagtatacacaaaaacccacacagtgagagaccacaacaagcgacacagcgacatacccagcacagacacacgtgagaacaagggcgagacacagacgaggaaatcaaacaagaggcacgaaccacgagaggacagaaagggcgcactagcaacaggcaggaaagtaatacaccaccagggacaaaagagaacgaacgagggagacaaaggacacaacacgataagtgaatggagcagtcgaccagtgnaagctcgaacacagagacacacagaaggagcaacccgagcagcgagcaacacaatgaacgaagaggaaacgacaacgcaggacgaagccacacaagtagcacaacaaaccgagagacagcgagcaacacaacgaaggaggtaagaacgcaagaacaaccaagaacagacgtaggagccccgcgagcagagatagcacataacacacagcatggacacaaacgagagaccgcgcaactataggaacaaccatcacgccggagaacgccacaaaccagaaagagaagaggaagcacacgagaacaaagacgatgaaaacaa

SEQ ID NO: 676388 - DNA, 180 bp, Homo sapiens
tctattcatccggcacatgcttacgagagagaaatcatagcactgggtgccgatgaatagcgagctattcatcggcaccggggttggtgtacacatagtgcgtaagtagaactagaggttaaggaaggtgatggtggctattatggtgccgatgaatagcgaggtgccgataaatagcga

SEQ ID NO: 676389 - DNA, 2699 bp, Homo sapiens
  misc_feature (159)..(159): n is a, c, g, or t
gaggaggggaagtgagtggttagacctcagctcatctgagggctaaaggttctttgtgacacatcacacagaattggagtgctgtccttctggagagtggtggagaaccaagatacagttcagaaccaaaggaatagagaagggctttgatttcttttnggctttagatggggatttgggaggcttagcaggaaagatgtccactgaaaatgtggaagggaagcccagtaaccttggggagagaggaagagcccggagctccactttcctcagggttgtccagccaatgtttaaccacagtattttcacttctgcagtctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagagagaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccaggtgagggcattacgctttgtgtttatgctcgctttgtatttggaggaaggtgtaggctccatgcttgcaaattttcaacatgctgtcatggtcctcaggaattagtcttgtttttttctctgaaaaactctgctactgaatttgatgtctcattgcctgaggtattttagctgtatgattcaaccaggaaggagaccaggagctctggaatgtgaacataaccaactcaatattttgaaattaactcaaactgtgggatttgcaaggaattcatgtgtacattattcttgattttataagtggggaaacctggatacatgtattaacagatataaatatgtgacaaacctatcctttgctgcttctttattggtgtaggaatgtcttcctttaagtaaacctttaatacatgattttaaacttatagaagaaaaagatactaatccacttcagataatttaaagaattaaattatgaaaaaaagaaattcagattggaattgcctagtggtagaattttatagcttatctctactagacaaataagaaaagaaaggaagagagaagaagaaatgaaagaaggaatgtgatgttctaggagtagatttacattgtagaatccagaaggacataacagcaaaagtaactcctggaaaggagtgtgattctctatatcttagccctttaaaatctatcataccaaacatgagttgacatcagaactttttcaca

SEQ ID NO: 676390 - DNA, 1832 bp, Homo sapiens
agtcgacggagactctccaacagcaggcgtgtggagagtttcctgggcactgctgtctctggagccatcttttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagagagaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccaggtgagggcattacgctttgtgtttatgctcgctttgtatttggaggaaggtgtaggctccatgcttgcaaattttcaacatgctgtcatggtcctcaggaattagtcttgtttttttctctgaaaaactctgctactgaatttgatgtctcattgcctgaggtattttagctgtatgattcaaccaggaaggagaccaggagctctggaatgtgaacataaccaactcaatattttgaaattaactcaaactgtgggatttgcaaggaattcatgtgtacattattcttgattttataagtggggaaacctggatacatgtattaacagatataaatatgtgacaaacctatcctttgctgcttctttattggtgtaggaatgtcttcctttaagtaaacctttaatacatgattttaaacttatagaagaaaaagatactaatccacttcagataatttaaagaattaaattatgaaaaaaagaaattcagattggaattgcctagtggtagaattttatagcttatctctactagacaaataagaaaagaaaggaagagagaagaagaaatgaaagaaggaatgtgatgttctaggagtagatttacattgtagaatccagaaggacataacagcaaaagtaactcctggaaaggagtgtgattctctatatcttagccctttaaaatctatcataccaaacatgagttgacatcagaactttttcaca

SEQ ID NO: 676391 - DNA, 419 bp, Homo sapiens
gagagagagagagagagagattgagagagagagagagagagagagagagttagtgagttatagatagattctcccgttgcccccgttttttatcatatgttcttcttcatcttacagtatttatgctattttttttcttccatttctgcttttatttattgtatccttctttaatctcttgtttgcttttcttcacttttattctctctttgtatctcttttttattctttgttctttttcttttctttttcttctttttttttctttttttttctttatatgtttattttcctatctttttttttttttttttttcctctctttcttttctttttctcttctctttttttttcttcttctctttcttttctctgtcttttttttcttttttctcttttttttttcttttcttttctcc

SEQ ID NO: 676392 - DNA, 1528 bp, Homo sapiens
agttcgacggagacttcatcaaacctgattgagtagatggggctcacaggttgatggagagagaacgtctgtgagtaatccctatcttccatacccaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagagagaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccaggtgagggcattacgctttgtgtttatgctcgctttgtatttggaggaaggtgtaggctccatgcttgcaaattttcaacatgctgtcatggtcctcaggaattagtcttgtttttttctctgaaaaactctgctactgaatttgatgtctcattgcctgaggtattttagctgtatgattcaaccaggaaggagaccaggagctctggaatgtgaacataaccaactcaatattttgaaattaactcaaactgtgggatttgcaaggaattcatgtgtacattattcttgattttataagtggggaaacctggatacatgtattaacagatataaatatgtgacaaacctatcctttgctgcttctttattggtgtaggaatgtcttcctttaagtaaacctttaatacatgattttaaacttatagaagaaaaagatactaatccacttcagataatttaaagaattaaattatgaaaaaaagaaattcagattggaattgcctagtggtagaattttatagcttatctctactagacaaataagaaaagaaaggaagagagaagaagaaatgaaagaaggaatgtgatgttctaggagtagatttacattgtagaatccagaaggacataacagcaaaagtaactcctggaaaggagtgtgattctctatatcttagccctttaaaatctatcataccaaacatgagttgacatcagaactttttcaca

SEQ ID NO: 676393 - DNA, 1137 bp, Homo sapiens
gtctactgcgtcgtacgtcctatatctgcttgattagcataactgacgcgtggggcgtttttcgttcctcctgctcacactcgtctagctgtgcgcttcactccaccacaaggatttatcccactgtttatgggagcccctgtgtggtcacacaccgccctgtggtagagtctctcctcctgtgtgctccccgaagagaccgtatcaacgtggtttaggtgtgcttcctcacttggcccccgcggtgtacccacaccatgagaaatggggcctctcaaaggggactgatggaccctgttcaaaacagagggcacacctaaggaagatgtttccccatccgatcagggggacacacattggggacatctgcgtggtaccccaggctgtaaggacctggcttttcccatgaagaagcctgacacaccacaacaagggcaagaaaggtctgagagggaaggagaatcacaggtgacaccgtgtcacagattttgtttggtttaactcccagatttctcctgagaataatctctgtgctctttgagacctggagatctaattctgtttagaccatttttgtccccgaaatacagaaggcttgaaatagctatgaaggccacgagcttctattctttatgggatgaaaaatttccaaagaggataaatcctctctgtggtaagaccctttggaaaaatcctaccccagaattggcttaatttaaatttccacgaacccacggaaatgagtatttctaataggcttttgtagaaccttccacgaaataatgtggggaaaaagggctaattgctaagtgaggctttatctaatatcctcctaagagttttaactaatggcttttttgagggaattacacacgggaagctcctggagattgtacacactggaaatctttatccctagggggaaatcaaggagctgggcaccccctaattctttatggaagtgtttaaaactattttaattttattaccacagtattactagagtagtggtttctacttctaagatttcacaaagtgcactttaaaatcaaacaagttcccgcctgcaaaaatattgttattttggtggagaaaaaaaatagtatattttacataaaaaattaaagatattaacta

SEQ ID NO: 676394 - DNA, 350 bp, Homo sapiens
  misc_feature (46)..(46): n is a, c, g, or t
  misc_feature (68)..(68): n is a, c, g, or t
  misc_feature (119)..(119): n is a, c, g, or t
  misc_feature (135)..(135): n is a, c, g, or t
  misc_feature (141)..(141): n is a, c, g, or t
  misc_feature (314)..(314): n is a, c, g, or t
cctatgtgtccccccatcccccaatcaatccctttcccccctttgnctggcctccccaacacaatganctcctttcccctatcctttttagaaagattagaaatgccttttcctagagntcccagtaatggaatncatacngtgtcctcagtcctgtttgtggtgcctgtaacaaaatacctgagactgggtaatttataaattataggaatttatttctcacagttctggatgctgaaaagtttatgatccaaggcactagcaggtttggtgtctgagggcccagtttctaatttgaagatggtgctttaaanactgtcctcacatggtagaaggggtcagatgggtca

SEQ ID NO: 676395 - DNA, 396 bp, Homo sapiens
ccggaagattggactctaggtgtattataatctttctccattctctcatttttatccaagacaaatcatggtagaaccaatttgtttgcaaaaataagttttagtcttatatttggcctgattagttatataaaatgcaacaagaataattatttgtcatataagctctctttcaaattggcattcttagaactttttccataaggagtctcagatcagaccttctaaagccttgaacccatccatggatttatttgtgcctgcaaatacctgtatgaattggatgaattcctctcctatggaggtccaaagttaacttggggctcctgggcttgttagaaagtggcattctttacttaccacaggttaggactcctgtacagggactgggtagag

SEQ ID NO: 676396 - DNA, 186 bp, Homo sapiens
gggggaggggaacctgtccagtttgtacgatttctttgtatgtatttttgatgtgttttttgatctgccccccctgtcctgtgaggacaactgaggccaaggagtgaaaaacctattactattaaaaaaaggggggcaaagtgtttacctggtgctttcaacaggacttaacatcaccaggactta

SEQ ID NO: 676397 - DNA, 270 bp, Homo sapiens
ggaaaagccccctttttaaattttaagggttgatttaaaaccgggggtttccccaaaagcttttgggggacccctgtataaatttaccgtaaaatttttcccggggggttgggggaaaaaaggggttccccacccctccccgggggtttgaacttccccccaatttttggggcccaaaaggttggttttgggccccggggggccccaaattgggggtttttttttttggtccccctttttttaaaaagggaaattaacccccaaattgga

SEQ ID NO: 676398 - DNA, 416 bp, Homo sapiens
  misc_feature (130)..(130): n is a, c, g, or t
  misc_feature (150)..(150): n is a, c, g, or t
  misc_feature (156)..(156): n is a, c, g, or t
  misc_feature (159)..(160): n is a, c, g, or t
  misc_feature (165)..(165): n is a, c, g, or t
  misc_feature (171)..(172): n is a, c, g, or t
  misc_feature (181)..(181): n is a, c, g, or t
  misc_feature (183)..(183): n is a, c, g, or t
  misc_feature (185)..(185): n is a, c, g, or t
  misc_feature (187)..(187): n is a, c, g, or t
  misc_feature (191)..(192): n is a, c, g, or t
  misc_feature (194)..(194): n is a, c, g, or t
  misc_feature (201)..(203): n is a, c, g, or t
  misc_feature (205)..(205): n is a, c, g, or t
  misc_feature (225)..(225): n is a, c, g, or t
  misc_feature (227)..(227): n is a, c, g, or t
  misc_feature (239)..(241): n is a, c, g, or t
  misc_feature (243)..(245): n is a, c, g, or t
  misc_feature (247)..(247): n is a, c, g, or t
  misc_feature (249)..(250): n is a, c, g, or t
  misc_feature (259)..(259): n is a, c, g, or t
  misc_feature (266)..(266): n is a, c, g, or t
  misc_feature (270)..(270): n is a, c, g, or t
  misc_feature (276)..(276): n is a, c, g, or t
ttttttaatgggagcaggcttactcagactctgaggcctggagtgtgctcacctctctaatccggaagatgggaagagcattaatgctggaggccacaaggttgggctcgccctggagttggaggcttantccagctgaaagaaaccttngggaanggnnatcanaagatnnggccttaananantnccanngngaccagnnncnggcttttttcccccaagaanangatcaaaacaannnannntntnnacaagagcngtatttnaagnatttanacagttctttgttagcgggtttctagggggttatctagtcaccagtgctgcagccctgcagtcacctatacattattaaaatgtatttaactgttaagcgcgctcccaccaatagtgaaatacacctttatgaaaactgc

SEQ ID NO: 676399 - DNA, 799 bp, Homo sapiens
tatgagcccatggaatcaccagtcccagcaagagcacaagaggaatgagagagaccctcactgctggtgagtgcctgccacacatcagtcccttctcaccacactgaatctcccctcctccgcagttgccatgtataccccttgaagaggggaggggcctaaaggagccgacctttgtcatgtaccatcacataacagtacccctgtgctcaacaccaaaaactagatagagcaggatataatatgatccattatagtgagacgggacggtcctgcacattgattaccccggcgaggcgggccagaatcatgacgtgttgcacaaattgtgttagtcccaaggggctcgcaattgggatgacactcataaaacattgtaagaagacgagtgccttgatttccaaagacaggagaacacgagggcaacagatacagcgaatgcgagagaaaggtgctcaaggaaaaatagacgacaccagctgcgaagagggtggcacttgacttgagatcacagactgcaatgctgatgtgtcgatcacgtcagtggaaccaccatgaacaagaacctcgacatgtcggctttacaagtggtgttactaaacccttcagagggacgccacaggagagagagacaaactccagtgtactcgtaggcacaacccgatggaggcatttgtaatcgccatagactttcggccggcaacttagcaagggctaaaaatgacaataacaaattagcgctacagaattaaggctgtgtaacttagcttcaggaagaagacctaccgtgggtcatact

SEQ ID NO: 676400 - DNA, 122 bp, Homo sapiens
cacttgctcgggggacctcggttctgtgacttacggacgctacggtgattacggactgacgtcgggaccgaacgacacgacgacggaccgtacacgtttaccttactggcgtggttgggttg

SEQ ID NO: 676401 - DNA, 761 bp, Homo sapiens
cgctggcagcgtcggcgtcacgcggagcagagctgtatgctgaagcgggacccggagcccgagcagccgccggcatggcaatcaaatatctggaagtcatcaagcccttctgtgtcatcctgccggaaattcagaagccagagaggaagattcagttgaaggagaaagtgctggtggaccgcatactcaccctctattatctatcgtataggtgtgctggccagagttcccctgtgttgggcatcatggtctctcagagttcagtcatgacccctctctatcggcatgagaggtgattctagcctctaacagaaggcacatcgatggagctagggactctctcctatctggtcacggtctggcacttactaatgtcaatctcgttggctggcgccaagataattgaagttggtggacgaccccgaaaagaccgagctctcttcaacggagcccaaaagttatttggcctgatcattactatcggccagtctatcgtgtatgtgatgaccgggatgtatggggacccttctgaaatgggtgctggaatttgcctgctaatcaccattcagctctttgttgctggcttaattgtcctacttttggattgaactcctgcaaaaaggatatggccttggtcctggtatttctctcttcattgcaactaacgatctgtgaaaccatcgtatggaaggcattcagcccactactgtcaacaactggccgacgaatggccttgcacgggggccatcatcgcacctttc

SEQ ID NO: 676402 - DNA, 259 bp, Homo sapiens
tctagagatcccctgtgagctccttggtggtcagccccctctttctccaatataaagtccaaactccttaacataaaatagaagaccttggcaggggcggtggtcacgccttcaatcccagcactttggggcccgaggtgggtggatcacctgaggtcaggagtttgaaaccagcctggccaacatggtgaaaccccgtttctactaaaaatacaaacgttagccaggcgtggtggcgtgtgcctgtaatcccagctac

SEQ ID NO: 676403 - DNA, 431 bp, Homo sapiens
tactcatatctactaactatctcttcctatgtgggcagcccctggaggcgcctcccctttgactggtggctccaggccatggtctagacagcgctgtccattagaactttgtgcacgcgatgtttacagtccattctgcactgaccagtgtggtcagccatcaatcatgtgtggccactgggcatttggaatgtggaatctggaataccggtgcagctgaagaactgcactgttaattatatttatttcaattcagtgtcatgcagtgagtggccaccagactagacagggtcaggccctctccccttacttccatgggccttccctctatcctctactgcctgggtaggactgcctttacccaagcttgtcctgtgacctctctctgaagacagtggcttccaaagaggctggcctggggcactcatctc

SEQ ID NO: 676404 - DNA, 300 bp, Homo sapiens
  misc_feature (117)..(117): n is a, c, g, or t
ttggctctcctcagcccctaaataataaggtcaggagttggagagtgtacaacagcaggaacatgcattcgatatgagtcacgtgcatgtgtagtctcttgccgtcctactttcctntttcccgagagtctactgtaggcccaggctcttgatgcaattgcaaaaaaattaacccggacagctcaactgagaaacttgattccactgggcttctgctacagtggtcactgatcgcaaccttgggatgtacctcgttctagggcgtggtaccccatacgccctagagcgaggcgtttggaa

SEQ ID NO: 676405 - DNA, 172 bp, Homo sapiens
tggaaaaaaagtcttgctctatcacccaggctggagggcaatgacacaatctaagttaattgaaacctccgctttcgggaatcaagtgattctcctgtctaagcctcccgatgagctggaattacaggcgtgtgccaccacacctggctgatttttttttaattttaaaaaa

SEQ ID NO: 676406 - DNA, 192 bp, Homo sapiens
tactttaacaaacctttccttatgagcatgcctgtgtagggtagacagtgagggtactaatgactagtaggtagatagtagatatacgggctgtcaatagtcagtacagtgtattaatctgacgcaggcttatagcggcaggcagaatgtctacatgtaacttatactaacataagttcttctatagggtga

SEQ ID NO: 676407 - DNA, 841 bp, Homo sapiens
tgggcttgactccaggatttaaaaactgggaacggtgaaggtgacggcagtcggtgggagcgagctatcccccaaagttccacaaggtggccgaggactttgattggcccttggtggggttttttataattagtcatctccaaattagtgagagtgcgttgtgtttacgggaagctcccatggccactcctaaaagccaccccacttctctctagagggagaagtggcccagtccttctcccaagtccacacgaggggggagggtgatagcatgtgctattcggtgtaaatatagtgtcaatggccaaacatttgtgttttaattctgtcgccttaatacctgttttttattgtgggttactctattttgggaagtggagtgaaggccttgcgtgtgggccccccttccccctttttttgggtcccccaactggagcagtgctattgaggcgctttgggctcctcccgggggagtgtggggtggaggcagccgagggctttcaccgtgtacacgtgactttgagcagccgttggaattaacagggtgcacacccttttaaaaataacaaagataacaaaagaagaagaaaagaacaaaaagaagaagaaaaaaacgtccgcggggccattattgtatgctgggggggcggcgggaaaaaagagtgcggtctactaaaagacggcaccagcaggtagcaaaaaaatgtgttgcctgccgccccaccatttgtttgttgcaccagggtggaaaaaaacgcgacgggaccccccagcaaggagggggccgaataaaatacacagacgccggtcccgctatcgtcgtacgtgaaagaacaagaag

SEQ ID NO: 676408 - DNA, 696 bp, Homo sapiens
gtgtgcctgcctgctcctcacttggagtgagcagcttccttctggtgactggacatgctttgctccgctcccagctggcccattgccccttccccagtgaccaccatcaccaacagctctggccgccaaccccatctatccaccatgtgaccatcacacagaccagacgtacaacaagcacaacacacgccagatgaaaagtgggatccacaatgtggagcatagaggatcggacgaagcacgcaaaaaccacacaatggaccatcaagatatcgccgaaacaacacgcacacaagagccacacacacagcgaataaagcaccaataggctcagatgagagaaaaagacaaaacacgcaacagaaaataacacgacaagactgcaaacgccagagagcgctacacacacacacaaaaaagagagacagacggaacaagacagaacagagagaggaaaaacagcgaaaaagcaggagcacagcaaaacaggagaaaaagacaagacaaggacacacacgacacgagaaaaaaccacgaaaagacaagaaggaacagagacgcaaaacacaaaacactgaagcacagagacaacaagagagagaaaccacaggcaccaacaacatacacaccaaaggaaaaagagacaacaaaaaaacagacgaggacacaagaagaccaggaaaggcacagacgcca

SEQ ID NO: 676409 - DNA, 524 bp, Homo sapiens
ccgggagttctttcattgaaagccgttatttattttaccacaatgcaaaactgatagaccagcaatggagctactgaaatcgacacaaagcgctattgcttgattcgcatattaaattttgctgttgtgtgtgtgactttaaacaggtgagggggatttaagagacagctaaacagtatatttgtactttataaacaatcattttcaactgtatatagactcatgagttatatagtatatgccctgccaaggcatagttcaactccatgatactaaaacatagtgaacgagacactctcccgtatggagagaagcaagcttaattatttggatccatctagaaaagcatcagcttacaggaatccttgactcggattgtatgatcacctttattagatagatcatgaactgtccctgtgaaaatgatgagaaactatttctgtaggacttaagagaatattttaaaggagtgactagcactattgaactgtgcctgtcaacttatgctgcaggactgggataat

SEQ ID NO: 676410 - DNA, 537 bp, Homo sapiens
gtaaagggaaacgtgcacagtgagctaaatcctcatcttccacacaaggaagtcaacagacactatcaaaagccaagaacctccagttacataagaaatacaggcactaatacctaaaaatagataaaaggaaaaagaggtggctaccagggcataagaaaagggtatggacttctatttttttcattatatgtttttttaaattgtttcttaaagtacacaaatgtataactttgataaatcttaaaagtttaaattaacaaaaaaaaaaaacaagaaaaaatcaaaacaaaaagaaggtatatcaaatgtatccattccttggactagaagaagaaaaaaaaagtagtggaggtcctcgctgattaaattaaatcaccttcttggatatgaaagacctttttcagtggagctaagtcttaggagtcaggtgtccatggattgctctcagcaaaaggacaatgtttcaagcccagaaagtaatcctggacagcctggcaatatggatgagagaggctgcaaaaagtcacctgcccc

SEQ ID NO: 676411 - DNA, 1173 bp, Homo sapiens
ccccataggaggaaaagctcttcacaaagagcttggaaactcaactattggaacaatgtactgttgacacaacgtgtcgctaaagagcagagccttccctcagtgatgggttcacgttccggaaggtgtcttagaggacattacccgcgcgtacttgctttgtaagtgatctgaagcgaggactaacaaatccaagcagcaaaattcacatatcgatgggaataatgagcgtccctccccagccccaaatgttgactatccattagactggacgagacagattcctaccctatccttggatcaatcacgcagattcagttgtcggaacatcctccttccgaacaagatcatgaacgagcaatcagcttgccactttaactatcggatccccgttataccgctgtccgatagacaccagcgacagcaactaaacagagacattcgcgtcagctcaccaggctggccactctctactgctcgcccagcgcattcctcccacacgactgccttgcccgcaacctacagcgtatccgcgacgaacaacacccaacacatatcccacaagcaccttgggcacctacacgacactttcccgaacttcactacctaccagccctggccaaaacgcctcaacccgccgctgacacctgcgactcggagcagggcggcactcccacgcaacccatcacccaggcacactcacttgtcaagcccaggcctgaaccacacgcgactcctcacacacccaaacgccccccgcataccctgcaccggacgcacccacaccaaccccaaccctcagggccaacggccgcgatcggacggcgcgggaaaaagcccaccgacacacttgagtacagggacacccgcacgtgagaaatggaaaccctgcgcacagcagtcacccgtgcctcatacaaaaatacttcagcaacgctacgccaacgtcaccccccgcgaggccagcagtgtcacaaggacatctggggcacgacacgccatcggaccaactgcgcagcaaatcacctacgacgtccacctgcgcgggccacaccaccgcctcgcgcagtcctcacccgcgaagcaggatgcggaacaacaacaacagcccgcgcaacacaaggcgcagacgagctgataacgtgaggaagacctgatccggcacacaccgag

SEQ ID NO: 676412 - DNA, 185 bp, Homo sapiens
cgaatcatgaactagcgcactatcctctcagcttgacatgtctcaggcgtatcgtgcgctatactatgcttcgtactatcatatttcgcccctcgtcacagagtcgtgcggtccgcgctcgagttcgtcactcgtggtcctagctactaccgccgggcctggaacacaagggtgggcctgggcac

SEQ ID NO: 676413 - DNA, 828 bp, Homo sapiens
  misc_feature (345)..(345): n is a, c, g, or t
  misc_feature (664)..(664): n is a, c, g, or t
agcgggctgcccgcggcctggcttcgggcttcagggagctctggtgcatgtctccgtctgtcgatgctcggccgctcgctccgtggatgccacggccacggtcccagctctgcgtggcctgcaatagtcctactatcctccgtggagaagccttggcgcagcacctgccgccgcggatgtctctagcgagtgagtcggctctagggcatttgagccataggtcctagtagaagtacctcgagaagcgtagaagaaagtaacaacgatcacgtaccaccatgcacctctggcactataggaatccaaggtcaagcaatggcttatagcttggattcgcacatgaantgcctcttattcaagcttacttgcgacgcagcgcatgtcgttggactatagtgtatgaggtagatctcgtaaccctgtagggacaagatgcgcgtcctaatcataagtcaacacgatttgaggggaatgtgagcaatgtgatatgtgccataggtaatatcaacctagatcaaatcaagtatagctgctgacatacctctgggtttcataatcatggcgtattaggtcatatgtggtctccgcctcgagtcatgcacttgcaaggcgttggtgtggtaggccgagaaattgttagtcttcgtcgactcttggagatatntgacgcaatgaatgcagataacggggtaaagacctgtagtgatataaagaatttttgcaaggaatgaggaagcgctaagttgctcgctacctgggattaaagcaaatgattcgacccctccttgatcaaattaagatattgggatttgtactgactcaacccaa

SEQ ID NO: 676414 - DNA, 690 bp, Homo sapiens
agcggacgggggtcgagctggggcgcagctcgcatggggtgagtctatcccgtctgtgccgccccggtcccggtgtgacaggctggtctggagcacgttcttctctcacctgtggtctcttctcttacgacacaggctcaggaccagtgtggtacaaggaacgacaggccgaccagagcgcggggggcacctggtctgtcgctgctggcggccttggcgcaccttggcctgtggacgagaaggtctatcacacgactcagcctatcctgccggtcagataactagtgggtgccatgtctttcttacagcagtgacaggacttccatccgcaccatctatacttcattgcataatgagctgaagaaggtggtgactggccgtggtgccctaagtgggactgttcctcacgtgtgaagaactcctttcccacctgtcagagcagctctgcttctttgtcaaggctcggatggagatagcagacttctatgagaagatgtacaccctcagcacacagaagttcatcaatgctgaagagctcgttggccttttggatgccatcatgaaaaaatacagctccagatttcaccacccaatcctcagtcctttggaaagcagtttccagctggaagttgacgtcctgtgtcatctcctgaaagcccaggcccaggtctcagagtggaagttcctccc

SEQ ID NO: 676415 - DNA, 886 bp, Homo sapiens
agtggagagtctagcttttctatggcgctggagcgaagagcatcctatggtgtgtcaaacaggcagatggctgtgtcttgagatgaaggttacagacgaagatcccagtaaggcatctatatacaaaagatattgacatacatgaagttcgtatggctggtcactaactacaagctggaatgtacttggtgaagacagaattgtcttatggcgtatctctagcaaggaataaaaaacatgcaactgtgagcactgaagatcatggagcaaaagtttgatgaaaatgatgctgatatacatgtgtggctaactttgagcagtgcatgaagtcagcaactctcggtatgctaacgaatggacaacgatcttggcgtcgccttcatcactcagtccggacagtactagctgggacggccactgtgtcccgcatgtgctctgccacaatatgtgcagctttgacatatcactgtcccggtcagactggaaacagcccatattttccacactacgctgaagagtatacttacatccagaacgtccccttagaggatcgcagtcagaggaccaccagcgggcctgaacgagaacgaacagattgtgaacgttgtgctgatgaatggtttgccaggagcttgacaaaactatccgggttactaagccatgcgtgcatgaacatccagggcaatataacattcttgggtcagataccattatggctaaagattgatcggcggcagggttgccccaagccacatggcgcatacggaaaactggacacagctgcgacgagccccaggggctcggcaacttatgagatgctgccgaggaacgcactcacctcgctcacccgtgccgcgcgcccccggcaacctgtccgtgcctccac

SEQ ID NO: 676416 - DNA, 1235 bp, Homo sapiens
aggaaagaaggccaggggacaagaaggtgtgctccggcctccagatgtcgtgaaggaagcaggagggctaagaaagtggtgaatcccacttgattgtgtagaacaatggccatagagaaatttaggcaattggacaaggacatccagcaccaagaagagacctcatccgcttagagaaatggtcccgactgataatccaaggattgcaagccgtggtagcaagagccatgcccttcctattaacggcgggactagataacgttagtcctactctagcgactataaacctatgttctatccctcacggcaccgtgggactctgctcgaagaccatgcttactccaagtcctgcgttcaaacgctggcccccaccacagctaacagaaccgagggagaccaagaggccaccgcagacagaaacgctacgcagcactggtgtgagcaccccgggctcagcagaaagcaaagggcctggttgggcgaacagtggcgacgttcacctaagcgaaatagcaggacgcaactcttaggtcccttcggaaggcatgcgaaggttaaagcacccggtcaacaccacctatgggcttgggaagcacacaaaggaaaagccatcgacgcattgggttgtgttggatctagcgactacagaacggtggtgcttcccctatctgaagccttgggtttaggtctttgcctttgcactaggcgcccttggttgatctgttacacccattggggggcgtacccctttttgaactggggcgattttcatcccaagaggggcggcacacacgggtcccaaaggaaactgggggggcccagtaactgaagttccccaccctagggaacaatgaaacctttgtgcaacatcaactttgtggcgggcgctatcccacccacccctggttggcaaaactttcccggcaaaagcaacgccaccaggggggccggctttttatggggatttaaacagaccttggggttcggagaaacgccttaaatccaatgcggaagccaaaagatgcaacaaaagaggaagacgaagtaaccgcactggaagaaactcccggccccggcaaccgaagggggaggtgcggggacacatggagccctatggggcgccccgtaaacggcgctcgcgaggggagccccggtaagccggcaccacagcgcgcccgacacacaagggggcacaaggggaacacagaaccttggccacatcaaaaccgggggca

SEQ ID NO: 676417 - DNA, 464 bp, Homo sapiens
tgttctagaggatcccatcataggttcgcaggcatctgccgctactcagagtgaatgtgggaccatggtttttgacaacttcagtcagcgtgcttggtcgggctggacgccagtgttccgatgccttcaaatctcttgacaaagatggcactggacaagtccaggtgaacatccaggagtggctgcagctgactatgtattcctgaactgtgagccccagacccgccccctcaccggcttgctatatggagtctcctggagcctcggtctctcccagggccgctcctgtctgcagtcacatgtttgtggggccggggacccacaaggtttagttcgtctcagtacttgttagcgagctgctcaagtgtccatggccgaattggccctgcatggagtccccctggctctaggacactctaacatgctctgtccacgggtctccccattcccaccatggcctgaac

SEQ ID NO: 676418 - DNA, 230 bp, Homo sapiens
ttcatcgccggctgcttgttgcgctccgcttgctccgcctttgtcgggcccccgacctctgtctccgtcagcccccttctggccgtcgcttgcggctcctctcgcgtcggctgccgcctgcccgcttggccctggcgtcgttctcgcccgtcgtgacttggtcctcaccgccctagccctggccgtccgcctaaccgctaacattcccgcaggcccacccgactggtagt

SEQ ID NO: 676419 - DNA, 909 bp, Homo sapiens
ggcacccgccatctccctggctcgaatgccccctccactcgcgacccgggtggatcactccctgtgctggggcactcaactgctggcttcaatgtgagaccctgggccatgatgacgctgtggcatgacgatgactggacgcgtcaactgatcctgcgtttgaccatgcgtacatctgagaacggttcgcttcctggaacagcaaacatcaaggcgctggctgctgagctgaaccagctggctgggccaaggagcccaccaagctggtagacgtctaccaggctgagctggcgagagctgcgtgctgcggctcgatcaactcaccgtcaacagtgcccgggtggaggttgcgatgggacaatctggtcacatggacccttggaccacttgtgagtgcatgcagctccaggatgaaaccaacctgaggctggaagccgagaacaacctggctgcctatagacacggaagcagatgaagccaccctggcccgtctggatctggagaggcagattgagtcgctggaggaggagatccggtactagaggaagatccacgaggaggaggtccgggaactccaggagcagctggcccgacagcaggtccaatgtggagcttgaccgtggccaagccaagcacctcaccgcagccctgacaggagatacggcacgcagactgaggccatggacgtcagccacatgcatgcagccgaagagtggcaccgatccagtttgcagcactgcagacgctgcggcccgaacgcggagctgtcccccaggacaaccacgaaagccaggccaaccggggaccagaggccgacatgacccgcgcctggaggacctgccgggcagacgaatccagaaaggccaatggccagcagggacagcaactcaggaagagcagcatccaggg

SEQ ID NO: 676420 - DNA, 896 bp, Homo sapiens
ctctacaaaaatttttaaaaattagccaggtatgaagggctgggcatggtggctcacgcctgtggtcccagcactttgggaggcccaggctgtggatcggttgaggtcaggagttcgagaccagcctggcaatatggtgaaacgccgtctctactaaaaatacaaaaattagccgggcatggtggcacgtgcctgtaatcccagctacttgggaggctgagacaggagaatcacttgaacccaggaggtggaggttgcagtgagctgagatcatgccactgactccaccctgagcaacagagcgagactgtctcaaaaaaaaaaatttagccaggtatggtggcttgcgcccgtggtcccagttactgtgggaggctgaggcagaaggatgtgcttggcccaggggttggaggctgcagtgaggtgatcatagctcatgactcaagcctggcaaaagagcgagacctcgtctcaaaaaaacaaaaacacaaaaaaaattcgagggggtcacaaccagttttggtgaaaagcctttaatattttcccccggggagaaaccggtgcctctggccaagaaggcgccaagggttactgggctgtcctcggagaaaatattcacacatagttgcggggaaaagagagaacgaacaaaaaaaagatgtgtgggggctcggccagcgaagattgttataacaactctgtggggggcgcacccgatgataagaacggtcccaaggtccaggagacacggtcgacgaggggcttccccagaaaagccgagcgcggggtcgaacacacgggcgttggccttgcggctcagcccccacaccccgggcgcccgcggaagctcacacgacaaggacactgagaggtgcacacgacagaaggcagcaaga

SEQ ID NO: 676421 - DNA, 151 bp, Homo sapiens
  misc_feature (121)..(121): n is a, c, g, or t
ttctagattatttggccagaacaagaggaagggagaaatagctgcttcaattgccacacacatgaggccatacaaaaaaaagagctagccaaatgcagtgttgctaggatgcatgtattcntctatgctaagacggaatggaaacttgtct

SEQ ID NO: 676422 - DNA, 303 bp, Homo sapiens
gggacgtgtagagtcttgtaagtcattgtgagcactacttttcttttcttttcttttgagatggagtcttgcttgtcacccaggctggaacgtagtggcacaatctcggctcactgcaacctctgccacccgggttcaagtgattctcctgcctcagcctcctgagtatctgggataacaggcatgtaccaccacacccagctaattttgtatttttagcagaaggggtttcaccatgttggtcaggctagtctcgaactcctgaccttgacgtcgctttcacctagacgtcgctttccctag

SEQ ID NO: 676423 - DNA, 681 bp, Homo sapiens
  misc_feature (4)..(4): n is a, c, g, or t
  misc_feature (7)..(7): n is a, c, g, or t
  misc_feature (16)..(25): n is a, c, g, or t
  misc_feature (31)..(31): n is a, c, g, or t
  misc_feature (55)..(55): n is a, c, g, or t
  misc_feature (58)..(58): n is a, c, g, or t
  misc_feature (60)..(60): n is a, c, g, or t
  misc_feature (67)..(67): n is a, c, g, or t
  misc_feature (75)..(75): n is a, c, g, or t
  misc_feature (103)..(103): n is a, c, g, or t
  misc_feature (110)..(110): n is a, c, g, or t
  misc_feature (133)..(133): n is a, c, g, or t
  misc_feature (141)..(141): n is a, c, g, or t
  misc_feature (149)..(149): n is a, c, g, or t
  misc_feature (157)..(158): n is a, c, g, or t
  misc_feature (163)..(163): n is a, c, g, or t
  misc_feature (173)..(174): n is a, c, g, or t
  misc_feature (178)..(178): n is a, c, g, or t
  misc_feature (184)..(184): n is a, c, g, or t
  misc_feature (193)..(193): n is a, c, g, or t
  misc_feature (209)..(209): n is a, c, g, or t
  misc_feature (215)..(215): n is a, c, g, or t
  misc_feature (219)..(219): n is a, c, g, or t
  misc_feature (231)..(231): n is a, c, g, or t
  misc_feature (236)..(236): n is a, c, g, or t
  misc_feature (247)..(247): n is a, c, g, or t
  misc_feature (258)..(258): n is a, c, g, or t
  misc_feature (261)..(261): n is a, c, g, or t
  misc_feature (269)..(269): n is a, c, g, or t
  misc_feature (273)..(273): n is a, c, g, or t
  misc_feature (280)..(280): n is a, c, g, or t
  misc_feature (293)..(293): n is a, c, g, or t
  misc_feature (303)..(303): n is a, c, g, or t
  misc_feature (314)..(314): n is a, c, g, or t
  misc_feature (327)..(327): n is a, c, g, or t
  misc_feature (342)..(342): n is a, c, g, or t
  misc_feature (361)..(361): n is a, c, g, or t
  misc_feature (373)..(373): n is a, c, g, or t
  misc_feature (377)..(377): n is a, c, g, or t
  misc_feature (398)..(398): n is a, c, g, or t
  misc_feature (403)..(403): n is a, c, g, or t
  misc_feature (409)..(409): n is a, c, g, or t
  misc_feature (413)..(413): n is a, c, g, or t
  misc_feature (415)..(415): n is a, c, g, or t
  misc_feature (427)..(427): n is a, c, g, or t
  misc_feature (429)..(429): n is a, c, g, or t
  misc_feature (439)..(439): n is a, c, g, or t
  misc_feature (456)..(456): n is a, c, g, or t
  misc_feature (466)..(466): n is a, c, g, or t
  misc_feature (489)..(489): n is a, c, g, or t
  misc_feature (502)..(502): n is a, c, g, or t
  misc_feature (504)..(504): n is a, c, g, or t
  misc_feature (508)..(508): n is a, c, g, or t
  misc_feature (559)..(559): n is a, c, g, or t
  misc_feature (574)..(574): n is a, c, g, or t
  misc_feature (579)..(579): n is a, c, g, or t
  misc_feature (587)..(587): n is a, c, g, or t
  misc_feature (596)..(596): n is a, c, g, or t
  misc_feature (602)..(602): n is a, c, g, or t
  misc_feature (605)..(605): n is a, c, g, or t
  misc_feature (609)..(609): n is a, c, g, or t
  misc_feature (613)..(613): n is a, c, g, or t
  misc_feature (651)..(651): n is a, c, g, or t
tganggnccagggggnnnnnnnnnnacccgnttgttcaagaacatggggggggcntcncnccttttncgcggggnttgggcggggggggataggcagcattcnaccattnccccagcaacagaggggaaggcnccccaacncagaagcncaaattgnnggggncagggggggnngggnaagggngaaggaaancccaaggcaattcaanagaagngggnaaaacgaccccnaacancactaagggcnggggggggccngcntgcccagngccngccaagngtcccgccccccntgcccccccnacccccccccncccaaaagatccnactgaatccccaggnaggcagcagggaatatccnatcattaggggncaanaacaggaaaagccacagaggngaggnagaggnttgngngagagttcaggngngcaaatatcncaggcccggggggggcncaagggggcngccagcaggggcagcagcattcncccagggcccccncncccncagagttgcccgagaggtccacagctcagctccactctgctgtttggcccncaggggttccagggnggggnggtggggnggaggcaanccagtncangaanagtntggattccgtgaagggtcaagtgtagtgttggtctcanaagtcaaattcgtccaggtcccctgtgccc

SEQ ID NO: 676424 - DNA, 314 bp, Homo sapiens
tatctgacagaagggccatagaaataacatcaccacttcaatagcaagcacatcttatatcctaaatgtcagaagatctcctgaacgggatgcttgcatagtgaactaaaccagtctggtcagatgatggtactctgggcataaagcgaggaatctgatattgggcatactggtaaaaacaaataataagtaaccatggaacattaattggatactaggtctagagactctaaaacctcaccaacgtgggtgagtgtattcttatattaagcaatctcttagtcctctcacaaactcagcacaaatccaaattg

SEQ ID NO: 676425 - DNA, 472 bp, Homo sapiens
ggtctcatatattgatggcatgcctcagtaaatgggaagtatatattacatttatcaatttaagtcaaaattaccaactttcctctttccttctaaccaggcacttcgtttaagtgaaagataattggccagagtaatagatatattgttttatgaggtaagaattagaatttataaaaggaactgatgtcttgatgatagtcataaatttttgaatcaaaattgatgctttgttttattttttctgtaatacatcacataacttacatattatttatcacttcaaagaaaaattataaaatcctaagcttactactaatgcagctttattcaacttcaggtatttatatttgttcaccatttgtaaccaccatttgtaatggcaaaaaaaagaattcaccaacatttgctttgcctggctgccaggttccgggtcaaagtaccttattttattattttattcataataata

SEQ ID NO: 676426 - DNA, 211 bp, Homo sapiens
tattgacgatgatgaggatgactgaagagctagaagcctagagggtcgagatgacacgtttttagatggtgcattcaagtcagagctggacgggtcatacaggacccagatgctcctcttactggacagagcagttagaatcccaggctctttcacggatttaggctgagaaacttcagcagcagtattggacttctctgctggatacctt

SEQ ID NO: 676427 - DNA, 444 bp, Homo sapiens
tttgacgcagaaatggttccctattgtggaaaggaattccgggtcagagccgtcatagatacgatgatcgatgagaagaccggtaaaataacgaaactcagaaatcgttgcgtatctttggagggggcgatttgccgatcgaagtattccaactgcagaataaactgcccgcgcacgattcttccctggtggcgtgaaatctggctcgagcgagtctccgaagatgggcgggccggtagccacagctaaagacgccaatggccagggttttgatgcccatcgcaggagcatcgacgttcagcggttgccggtgcgccgacgtcgtcgcagatagccaaaaaagccccgaacggtgcgccccggatctgggtcagccagctctacttgaccgcggcgtttgcttatggggaacggtggtatcgatgatgccttccgccaaaagct

SEQ ID NO: 676428 - DNA, 120 bp, Homo sapiens
gagcgctggaagtgtgacggagacaacgatgtgctggacaacagtgatgaggcccagccctctgctatagaacactgccctcggacgatcaagtggaaaacaacggtgatctcaacgtat

SEQ ID NO: 676429 - DNA, 117 bp, Homo sapiens
tggactcaggcagactggagtgggacgctggtagagatggaggaggaggcaattgggatggcgctaggcatatcaagtatggtggttgtgggtgaccagttgcacttgagccgtctg

SEQ ID NO: 676430 - DNA, 584 bp, Homo sapiens
  misc_feature (189)..(189): n is a, c, g, or t
  misc_feature (385)..(385): n is a, c, g, or t
acagcgctctccagggcgaaaggtggggaggggtttctcaaggtggcccgccctttcccacacaaattttttccgggcgagtataccccgagaggggtgggttttggcattcagtaaggggatgggtccctcccccagttttggaacccttggggtgcccaggccggggcccctcaaccgggggggttntgagttttttggggccagtttccctgtttttcaggaccacccctgttggggcccaggcccaggtttttaaaggcggtgttttaacctccccggggccggaaaaaataggtttccccctttcccccttccctgggggggggggggggggttttgggggaaaatttacccccgggggaagggggaatcccgtccccgntggtggttctttttttttggggaaagtttgttccccctggccccccccccattttccaaggggtcccaaagcctggggccggggttttttgtccccccccccccctttggcccggggggtggtgggccctgttttttttttcctggggggcggtccggccccccccccccccccctaaagcttttttttcccctgtgga

SEQ ID NO: 676431 - DNA, 247 bp, Homo sapiens
  misc_feature (140)..(140): n is a, c, g, or t
  misc_feature (163)..(163): n is a, c, g, or t
  misc_feature (173)..(173): n is a, c, g, or t
  misc_feature (229)..(230): n is a, c, g, or t
gctaagtggatgctccggtggaaactaagttcctgaggctcccagtggttggtccgggctccctgagaacattagaaccagtgaaggtatgggctgagtctgtgtgcccatttcatacaggtcttgccttctgttccagnttacctgtttgctggtggaacanaataagcccncaaacgttagggacttagagatagcacagtgtggtttatcgtggatttagcggagnncagttccacattaggcg

SEQ ID NO: 676432 - DNA, 297 bp, Homo sapiens
cgtccttttagtttaaagctgtgcctcgtagtgttctggcgagccgtcttgttgatttatctgttgcgccttagtgctaagcatagtgatgcatctaatcccagtttgcctcttagctattgtgtgttcagatatgttaaagccactttcgtagtctattttgtgtcaactggagttttttacaactcaggtgagttttagctttattggggccttctccgcatataacactttttacgccgttttctattgcttgaggataatcgcgtgaccccggcgtctgtcacgaaattgacc

SEQ ID NO: 676433 - DNA, 303 bp, Homo sapiens
acagcagaacctgtccgggccaaggtggaagcactgtgcggcagccatgaagaaatatcaaggctatcaggtgagctagcacctttcaaactggcaccatggccttctcccagggggatgggaccaactagggttgggcaggatcatccagtgtcacacgctctcacggtagaaactgcagggatttgaccatgccattctcatatttgcgtgcacctcatctaccgtgcaacacagcgcttgggcgagatgtagcggttaggagcggaagtgagcactccctctccatagctccgtgaggag

SEQ ID NO: 676434 - DNA, 610 bp, Homo sapiens
  misc_feature (11)..(11): n is a, c, g, or t
  misc_feature (572)..(572): n is a, c, g, or t
  misc_feature (574)..(574): n is a, c, g, or t
  misc_feature (579)..(579): n is a, c, g, or t
gcctgcccgtngccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcgcgccagttttcgagcctttcagcaacaaaggccagacgctggtggtgcagttcacggtgaaaccatgagcagaacatcgactgtgggggcggctatgtgaagctgtttcctaatagtttggaccagacagacatgcacggagactcagaatacaacatcatgtttggtcccgacatctgtggccctggcacccaagaaggttcatgtcatcttcaactacaagggcaagaacgtgctgatcaacaaggacatccgtatgcaaggatgatgagtttacacacctgtacacactgattgtgcggcagaaaacactatgaggtgaagattgacaaagcaggtggagtccggctccttggaagagatgggattctgcancnaaganataaggatcgatgcttcaaaacggaagatgg

SEQ ID NO: 676435 - DNA, 159 bp, Homo sapiens
cgattggacctctttgctatttttaaactaaccattttctgctgggcgcagtggctcacgcctgtaattccagcactttgggaggccgaggcaggcggatcacctgaggtcaggcgttcaagaccagcctgagcaatgtagtgaaaccccacctctact

SEQ ID NO: 676436 - DNA, 633 bp, Homo sapiens
  misc_feature (11)..(11): n is a, c, g, or t
  misc_feature (595)..(595): n is a, c, g, or t
  misc_feature (597)..(597): n is a, c, g, or t
  misc_feature (602)..(602): n is a, c, g, or t
gcctgcccgtngccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcaacagcttattatagtcgtctgtacgggtcggcagttatcggagccttgtcagtcgtagcataggaggccagtacgctgtgtggtgctagttcgatcggtgaaaccatgagcagaacatcgactgtgggggcggctatgtgaagctgtttcctaatagtttggaccagacagacatgcacggagactcagaatacaacatcatgtttggtcccgacatctgtggccctggcacccaagaaggttcatgtcatcttcaactacaagggcaagaacgtgctgatcaacaaggacatccgtatgcaaggatgatgagtttacacacctgtacacactgattgtgcggcagaaaacactatgaggtgaagattgacaaagcaggtggagtccggctccttggaagagatgggattctgcancnaaganataaggatcgatgcttcaaaacggaagatgg

SEQ ID NO: 676437 - DNA, 124 bp, Homo sapiens
aagtatatagccggtccgagaactttccctctctatcctttcagactttaactggatctttgtatcttccccgccccgagaacatttaacttaataagaataatttttaataaggatcccctag

SEQ ID NO: 676438 - DNA, 555 bp, Homo sapiens
  misc_feature (154)..(154): n is a, c, g, or t
  misc_feature (165)..(165): n is a, c, g, or t
  misc_feature (239)..(239): n is a, c, g, or t
  misc_feature (494)..(494): n is a, c, g, or t
cctgtggagacgggtctcaccatgtgcaggctggcttgaactcctgacattaagtgatctgcctgcttggctctagaatttatttatttttatgatatagtgtaaagtcaggatctaacttttttccccaataaatagttttttaacactgttnattgaaaattngtcctttccctgctaattgaaaatgctgcttttactatattctgcattcttatgtatccctgatctgtttttgnaagctttggagtcttctcgcttgtttcattgcttcttgtgatattctaatttagtctctttgatcacagtcattgtcctgaaacacagatcatatcatacccctcttgcacaaacaccttccaagtattttattgcctacaagaaaagagaccaaacttgttagccaggtctaaccctaagctatcttactagctgcatttccccatagactctctgctttttggagcatactgtattttcatgtatttgtaccntttgttcctactgttctcttagctagaaatagcctcctgagaccccgtctccacaggtatg

SEQ ID NO: 676439 - DNA, 268 bp, Homo sapiens
gagttgtggagttgtgggctttgattgtgacggtacctacgcaaatctacacacatgctaacttttatagaattgtgcactacaggaaaaaaacaactgtactgtatttaaaaagcaagattttgacatacagctctgtataaatttacagtatacacgatgatctactgtatgccactaatatgtcattatcattggggaacaggttaagctttaaaaacaagaaaaggcggggaggatcttgtccacataaattccggtaccgagc

SEQ ID NO: 676440 - DNA, 464 bp, Homo sapiens
agtatcctggcgcagctgtggactccccagaaatcactgtctcagcctcttatatattgtggtgggggaaagacaaggtgccgtaaagtgattctgatcacactccttcaaggtcaaagtaaataatctcttgaaactggctggatatgcaaaccctaaggaaattatgagaataaccctgtccacggttacaatccagtcccccagccctgggcgaaaagcccctcactcctctttaccaccagagagatgagaccagaaggccctgattaaacactcaccccttcaggagaacccagagttatagaagggatgtcagtggcgctgagcagtagctttaagtcccagaaaagccttttcttactatgcaaacccactcgtgcctggatgcccactttacatttgtggtggctgcctccaccctggcagaacccattctgagcacagatcccattctgagcagg

SEQ ID NO: 676441 - DNA, 156 bp, Homo sapiens
gctcgtgagtagtggtgctgcttttccttagttgctacatttctatagttaagttggttttactggaatgattcatgtttagggggaaaatgaaaatctgccttaaaattagtttcaacgtcctcctgcaaataagataaatgaagtggcagatgt

SEQ ID NO: 676442 - DNA, 450 bp, Homo sapiens
gctatattccgccatcttacacccctgataaggctacaaagtagcgcagtacccacgtaagacgtaaggtcaaggtgtagcccatgaggtggcaagaaaaggtctcggttatctaccacagacaacctgcatgcctgttatgatgcttctgggtctcggtgtggctacgtcagtactgtgagagtccagtgcgttagttgaacagggccctgaagcgcgtacacaccgcccgtcaccctcctcaagtatacttcaaaggacatttaactaaaacccctacgcatttatatagaggagacaagcctgtcctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtg

SEQ ID NO: 676443 - DNA, 350 bp, Homo sapiens
  misc_feature (284)..(284): n is a, c, g, or t
  misc_feature (306)..(306): n is a, c, g, or t
  misc_feature (329)..(329): n is a, c, g, or t
  misc_feature (340)..(340): n is a, c, g, or t
aacatctctacaaaaaaatgttttataaaataatttacctagtcatggtagctgggactacaggtgcatgccacaacacccagctagttttttgtatttttagtagagatggggttttgtcatgttgcccaggctggcttgaattcctgggactcaagcaatttgcctcccttgtgggattacaggtgtgagccactgcgcctgggcccaattcaaaaagtttttcaaaaatgtatatacccacttcaccaccactccaatttaaggataaaggaagaaaacanttccatcaccctgtttttcctncatcaatttggatttttaggcanttttattttanttgtggctct

SEQ ID NO: 676444 - DNA, 945 bp, Homo sapiens
cacaaattattttacaatatagatgtgagttttttaatgaggaccccggccagcatctggttttattgtactctgtgtagtatatataatgccttctgctttaattcgctccaatattggtccatagatcgcctttgaaaagggccccattaggcctttggctccaatttcaccatcaagcaacattattggctgccataggcggtgggtaaccccacggtttatagccatgggctgaaaagccacttgatgtccccatatatcacaaccatcattcggtttatgtttttaaatggtccagaaaggatgtatttattccgaagcttaggtctaatcaataataatgtgcttgtatgtttacggaacagtaagaaatcattatcttgccaaaatgattccaaaatgggaattaaagaagggtattcttgtttaatgaactttcgtctcccccatagagaatgaatataatttatataaggcccacaaataaattgctatttataatcctagagtatgatataattattgccgcgactatataccgatgtagatgaggagggattatctgcccaatcttaaatggtaaaagagactgtatgtaaataaccaatagtcgacgtcgtgtgcatacattgatggatgtatatcaattgagtcaaagacacaaatgtagagccacaatctgatgattctctgtatataatcgaccgtctgtaacgagtgacgcattgcattgttatatctagttatacgccttacatagtccacagtcttcaaccgtatattcccctatgtgtccttttagtattagtctgatcaagaatcctgaagttttcacttttccataataattcagtattcctgtgaaaaaaatttcccgatcggatgcaatatatagtcaagagataagtagttcccgcaaccgctgctacatagtatgggcat

SEQ ID NO: 676445 - DNA, 1158 bp, Homo sapiens
tggaaaaagtctatgggggccagggggtgggtttgaacccagcttgggggggttcgatcccctccctttcttggtctaggatttaatgtcatacgggttctctccgatgtgtgtggccagggtggggggcatccatatagtcacctccaggttctatggcagggctcctctctccccttgagcgcactttctcgctctcgaagccgaaggcttctcaatatctatgaacaatttatttaacttatttaccgggctggtcagaagcaaatgtgaatttgacccctacagaattgatacggagtgttacagtggtggttgattctgccatctcggggatagctccgagataaacgtcgggcgacatttcccggaatagcgcccgaagacacgtctgctcggtggccgacacggaccgagttcagcattcttcccgccgcgattgaacctacgcgactcgcctcgacaatgtggcacttcggggccgtatacgggctatggccaccaacgtgcggtgctaccccccgggaacaactcttaggggcgaacacaccccgctgcaaagaaaacgccccccgcgttagcccgccacatatgcaggagcaccagcgcccgaacatcacatcacaggagacactcttcgagactgtgagtacagcgacccactctgagaccctccagacatcaccagaccactaatacccaatgtatccacacacagagagggattaagaccacaagaagtgccgctatacagaagaggtgctcacaccaccatcgagagacccccccgggagcacatctcaacaggacggccgcctccacataaaccacacttgtgtgatccccgtgaattccaccgccaatttcagtactccccgttcgatagttcatcttcatcccccagattggttgcgagcgacgcaacagaacaaacgatatcagcagaggcatgaggccaactggggtgacagtagagtgcatcaaatgtggtaggtgagaggaccaagtgtgtgactcatgcagcgatggtatatttcctcagggacaatgatagtaactcggtgctacgaaccgacatcaaaagagatagtgggttagtaagcagacgcccaccgcggtatgtgatcatgattgagatagagtctagggaccaacccc

SEQ ID NO: 676446 - DNA, 141 bp, Homo sapiens
tgctgtcatgatattgatcacacattttacagagatgtgcaaaacagcagaccggatataagaacccagaaattaaaattgatgaaacagggagcacgccaggatacgaaggtgaaggagaaggtgacaagaacatctcca

SEQ ID NO: 676447 - DNA, 206 bp, Homo sapiens
acaccatggcagaaggctggggctcatttgcaggggggagacaaaagggtcatcatctctgaccccctctgatgactgcccccatgtatcgtacatgggtgtgaaccatgagacgtatgacaacagcctcaagatcatcagcaattgcctcctgcaccaccaactgcttagaaccaagcaccagcacgacatcccatggggttttt

SEQ ID NO: 676448 - DNA, 440 bp, Homo sapiens
  misc_feature (102)..(102): n is a, c, g, or t
  misc_feature (108)..(109): n is a, c, g, or t
  misc_feature (128)..(128): n is a, c, g, or t
  misc_feature (145)..(145): n is a, c, g, or t
  misc_feature (149)..(149): n is a, c, g, or t
  misc_feature (156)..(156): n is a, c, g, or t
  misc_feature (167)..(167): n is a, c, g, or t
  misc_feature (208)..(208): n is a, c, g, or t
catctttgattcatcccatcccttggtgtaaagtttttggctgatattggcagaattactcttggccagcaggatatctggggtgtctggcatacgtggatngaggtnngtcagcatcccaagcttcngtgtataaatgcttgcncatngtcaggncattattcttngctaggacaatttccggagtgtcggtaatgcatgtgaattngagctggtctgcaggctggcgatacttcctgtcactcaggatttctccagctctcttcactttctcgacctctacagagccaatgggaacccatcctatgcctctcagccactcaagatcagatttgtaaatagcatcactctgcaggtcataggccttccgagcctgaatgacgtcattctgatcaggcaggcaggtccattcatgcaggggatgcttgtagtctatgtcg

SEQ ID NO: 676449 - DNA, 968 bp, Homo sapiens
  misc_feature (65)..(65): n is a, c, g, or t
  misc_feature (67)..(67): n is a, c, g, or t
  misc_feature (76)..(76): n is a, c, g, or t
  misc_feature (78)..(78): n is a, c, g, or t
  misc_feature (305)..(305): n is a, c, g, or t
  misc_feature (311)..(311): n is a, c, g, or t
  misc_feature (321)..(321): n is a, c, g, or t
  misc_feature (325)..(325): n is a, c, g, or t
  misc_feature (340)..(340): n is a, c, g, or t
  misc_feature (350)..(350): n is a, c, g, or t
  misc_feature (370)..(371): n is a, c, g, or t
  misc_feature (401)..(401): n is a, c, g, or t
  misc_feature (456)..(456): n is a, c, g, or t
gcacaatagggctttctgttacagaatagtgtgcatcatgtttacttaaccagaaaacgtgcatnancttgcaagntnatgctgcaaacccaacgcatacaataaaacaaaaaggaaactgagctttaaatacaaccaaaatttgtacaattccagctgtttcacatattcatttggactgacaattccagctgtttcacatattcatttggactgacaattatatatcaacaggttatttttaaaaagccaattgtagattacaagtaaatttactcagcaactatttttatctgaaatcatanacagtnataaagtagnttantgaacaattaatacngggcacaagncaacagtcaatcgtgcattnnacatatttgcaaactttcatgacccaaaanttgcaagtataatttgtcaaatacacattttgctgcaacaatgtgccctgctttnaaaacttgacatataacagaggcactaacatatcattaaattataaatagattgggaaaatgacttaaccccaatggtactatgtcatggccctagtatttataatacaatacagcttttcacaaaatatttttccaatatctgccaatttcttctttattgctcaccttaaatttgactctattacaactggtatcagaactttcacacaaatcatactcagacatttttatataaaactatacaagatatgtaaacttgtatctaatacattccaggtgtatggctgtattgatctatgcaaaagtacaaggcatatggataattcctgtgtgagataaatatacaatgaatatataacaaatacaaatacatttttaacaataaatatgaatagatagaaggttattagggtaggaaaattcatagaacaagaataaacaaattaaatttaaagcataaataaattgtcagaaatttagaagagaaatttagataagaaaaaagagtaa

SEQ ID NO: 676450 - DNA, 933 bp, Homo sapiens
  misc_feature (65)..(65): n is a, c, g, or t
  misc_feature (67)..(67): n is a, c, g, or t
  misc_feature (76)..(76): n is a, c, g, or t
  misc_feature (78)..(78): n is a, c, g, or t
  misc_feature (270)..(270): n is a, c, g, or t
  misc_feature (276)..(276): n is a, c, g, or t
  misc_feature (286)..(286): n is a, c, g, or t
  misc_feature (290)..(290): n is a, c, g, or t
  misc_feature (305)..(305): n is a, c, g, or t
  misc_feature (315)..(315): n is a, c, g, or t
  misc_feature (335)..(336): n is a, c, g, or t
  misc_feature (366)..(366): n is a, c, g, or t
  misc_feature (421)..(421): n is a, c, g, or t
gcacaatagggctttctgttacagaatagtgtgcatcatgtttacttaaccagaaaacgtgcatnancttgcaagntnatgctgcaaacccaacgcatacaataaaacaaaaaggaaactgagctttaaatacaaccaaaatttgtacaattccagctgtttcacatattcatttggactgacaattatatatcaacaggttatttttaaaaagccaattgtagattacaagtaaatttactcagcaactatttttatctgaaatcatanacagtnataaagtagnttantgaacaattaatacngggcacaagncaacagtcaatcgtgcattnnacatatttgcaaactttcatgacccaaaanttgcaagtataatttgtcaaatacacattttgctgcaacaatgtgccctgctttnaaaacttgacatataacagaggcactaacatatcattaaattataaatagattgggaaaatgacttaaccccaatggtactatgtcatggccctagtatttataatacaatacagcttttcacaaaatatttttccaatatctgccaatttcttctttattgctcaccttaaatttgactctattacaactggtatcagaactttcacacaaatcatactcagacatttttatataaaactatacaagatatgtaaacttgtatctaatacattccaggtgtatggctgtattgatctatgcaaaagtacaaggcatatggataattcctgtgtgagataaatatacaatgaatatataacaaatacaaatacatttttaacaataaatatgaatagatagaaggttattagggtaggaaaattcatagaacaagaataaacaaattaaatttaaagcataaataaattgtcagaaatttagaagagaaatttagataagaaaaaagagtaa

SEQ ID NO: 676451 - DNA, 563 bp, Homo sapiens
cgcagtggcttattcctgttatcccagcactttgggaggccaaggcaggtgaatcacgatgtcagtagatcgagaccatcctggctaacacagtgaaaccccgtctctactaaaaatacaattagccaggcgtggtggcggacacctgtagtcccagctactcaagaggctgaggcaggtgcacaccaccacgcccagctaacttttttgcattttagtaggaactatgcattcagccattgcagcaccaacagcatacaattcggattgagtgatctgcattgaccgaggcttgtatagcccaaggagcagcttcacaacagcgagtcatgctagaacaaccaccaggactgatgccaaatgcacaggatatgtctacagaggaacctgctcaaacaatcatgcaccttctcaagccaattaactttaccagaatggggcaaacaggcttcgtgcccatggtatcacaattttacgactttcaaccacatgctcactattatgacgcttttcctcagttaggtctttaactcctggagcttaatgcttgctaacgcaatccc

SEQ ID NO: 676452 - DNA, 102 bp, Homo sapiens
ccacaagaacaaaactccctgtcctttcatatactaagaaagaggataggctactgaaaacagtcattgcaagacacatgaagacgacatactgtggcatgc

SEQ ID NO: 676453 - DNA, 221 bp, Homo sapiens
aggtcgacaaagcctagcattcttgcagaaccctatactaacatgtaatggggagagggtgggcagatgagtagagaacagattcaggcctcaagcttccaagcatttttataaatggaaatcttaaatatgaacagctgctatagtgtctcttttaaattcagacttttttatgatatgagatgctgttgagttttaactaatctgacagagagataaag

SEQ ID NO: 676454 - DNA, 892 bp, Homo sapiens
aatccacggcagaactcatggaaatcagtgatgatacaaactacacacatcagacaggtggctccaagcaaacccctacctgaagtgactgatgagtataaaaatgatgtagtagaacaccagatctgtttatattaaaggcttctcaaatgatgcaagtcttgatgacatacaagagaatggttagaagataaaggtcaaggtactgaagatattcagatgagaagaacgattgcagtaaagcattgtaagggatcgaatgtaatagttgtgtttgatagcatattgaatctgctaaggaaattggttagagacgccctggtcgagaagtacagaatgaaacagacgcgtgccggtagagtacgttttcatacggcaacgattactgtgtgccgataggaagagatatggaggagaaggaaaacataataaagtggaagctaaattaggagcgtaaacagtgagcaatgaggcataaacaaaagttagaagaagatgctgaaatgaaatctctagaaggaaaagattggatgctcgttgaaatttgccgggtgattcagatgatcgagacctgtagagaagatttacacagtatcttttctcacactcatggtgaaaataaaatggatagacttcgtcagaggagcaaaagaagcggataagttctatttaaaagaaaaaggcaaggagcattggggtacagccaaagatggaattaatggaacctacagtttacgaacaccgaagtgagcttgggaagtaacagaaggagggggggaaagacagcctgttgaaatattggagaccccagaatcttaaattcgtaggggagggtgattaagaaaggcaggaaaaatgccccggtttgtaagaaaatatttgggaaaaaatg

SEQ ID NO: 676455 - DNA, 112 bp, Homo sapiens
ctgaccagttctggtccccactgtcctccaccatcttactctggattaagaacaagatagtctctttttttttgagatagagtcttgctctgtcggccaggctgagtgcagt

SEQ ID NO: 676456 - DNA, 150 bp, Homo sapiens
tgcacttgcaatctgagacgcacgtgtgaccgtatccagatctgcacagatgcatgtgctatgtgcctaagtatcgctctggaccaggctcagacgtttcactatgtacacgagcttagctctcatcaaggcatgagtgcatcattctct

SEQ ID NO: 676457 - DNA, 1082 bp, Homo sapiens
tgaaaatttgcaagataccggattgacaaaaattcagccaagaaaccaccgaatactgtaacggattcagtcctatggtttacatgatctccccctgcttgacgaggttctggtggctgatgatctggataactcgagagacagtatctgaagttgcccttttggcagctagtgataagccaaacatgaaatagatacgcgttgaacaggacataattgtggcgtctcatgacacatatcagactccaaatatttattcgaggagatgcattcagtatgtagggatcagggatggtccactatctccatgtagaccgacaacaggaaagaataatgcgttctttgaatcacaggatctggaatgatatatgcgtgaatcatgtcaccacgctgatagcttccccgggtgactacccaggctcgtagtgcaaagtcagagtctatggttcaagaccatcttggaactatctttcactcccatgctcgatagagctgttccactactcattgcaagatagtagagaatttctccagatagaaacgtatgcttagccaagctacatgctgacactctatcttgcagtagttctaggtagtagagcgattcgtagccggatttggagtcgcccaaataggaactggcgacctctccctggggcagctatgcataggcttttagccatatagaaatgtggaaagggtctgtggcccgaggtacatgaatccaaacaagcattactgccatattgtaaagatgttttaacagatgtgcctgcagaggaatgttctgaagtcatgaacggtaatagttaggactttattgctagaactcttgttcgtgtgccgcattatagaacctcgttaaccaatgtgaagggcaggcctccgggcaactcatcatgcacgtaaccctgaaggtaacctgcgacgttcaagttggatacgcttgcaatgttaaaatttgaagggtgtctccctcacaacgtgtggggaccattaaaaattccgccataaagcaaatgagctgcttacgacaccgggcatacaaggcgttaaagcaggacacacaaaatattccatac

SEQ ID NO: 676458 - DNA, 370 bp, Homo sapiens
gccccctcctccggatggcacaggctttgctaggttccggacccaggcttttgggggaagggtctcccttggccctcccgggaatggagtccatgctaaaaaaagctcagtgttgggctgggtttgccagtaaaaccctgcgttccagtccccccagtcttgccagaaaaaaccagccccttttccccgtgggtcctgggttcaaaatgtgggattgggtctggcccagccttttcccctgttacccataatttttgcctctttccataaaccgggggttccgtttggctttggaaataaaggtgggggttttttttttttttttttttggcttgttttttaaataaaccaaagtccaaaaccaactcca

SEQ ID NO: 676459 - DNA, 675 bp, Homo sapiens
agcggggtcttcccgccccgcccagaccgccgaggctgccgccggagtcgccaccgccgcgccctcgctcaaatgtttgaaatagaaaataaaaggaaataattagatgcagccctgtcgagcaatgtgcgttcagtcgcacgacaaaccggagacataaacgatcgagtgagcgcaagaaagaccctgtttttaaccaacgctaagaacaccaggggaacagaacgcttaataaagaactacacatagtggcagtccacaggacagttaaccaggcgtgcacacaggagcaagtgctgatatcaaacactgcacataacacagcagcagctgaagctacaacagccgcgatgctccacaccaacactgcaacccagctaaaaccgcacaataatataacaaaacacaccggcgacactacaacgatgcacccaaccaaagagaagccaaacaagaaatgagagaacctcacatgccagaacagaaccaccaacgaaaaaaaaaaaagagggtaaccatgtggagaagccaaacacgcacaaacaacagggacacccacacccagcgcaccccacaaattgcccccccttacaaccaaaacgcaacaaaacgccaactggagacacatacagaacaagaaagacatacaagtggggcaaacagaaactcacagta

SEQ ID NO: 676460 - DNA, 387 bp, Homo sapiens
  misc_feature (18)..(18): n is a, c, g, or t
  misc_feature (53)..(53): n is a, c, g, or t
  misc_feature (182)..(182): n is a, c, g, or t
  misc_feature (268)..(268): n is a, c, g, or t
  misc_feature (271)..(271): n is a, c, g, or t
  misc_feature (290)..(290): n is a, c, g, or t
  misc_feature (381)..(381): n is a, c, g, or t
  misc_feature (385)..(385): n is a, c, g, or t
cgggggtggggtcccaanattcctaagtttttgcctagtccctccccggtgantcctgatgaatgcctaaagtttgagcatcactgaaataataattacctgtaatcatcacccaatggatgcctaaaacccatgaggtgaatggttgataggcaaccctataatggcaggatcaggttganaccccataaacctactgatccatcttagcaccactagaaatgtgacaacctgaggttctgtgctttctggtactttctgttttttntgntcacgcttgtaatcccaanactttggggggcccaggctgcaggattgcttgagcctgggagttcaagattagcctgggcaacaaagcaagacccccctctcaaaaaaaanatanaa

SEQ ID NO: 676461 - DNA, 155 bp, Homo sapiens
ttcggtcactgaagacagcgtacgttcctgaggtggggaacggcaatccatgctgtgattggctttccttctgaggtccccacttcttgctcatggctggtgatgtcgttggagagcgttaatgggacttcgctgagctgaagggccccgcacta

SEQ ID NO: 676462 - DNA, 441 bp, Homo sapiens
tcacttggaaaaatatttttttacgggaacaatcccccattctcggggactctttaaaaaaaaaaagggcccaattggggggaaattaaaacaaacaggggagaacgaagggttagccacgtgctcccccaaactccaccaacccccgaggccccagaggccgtgggcggggccagcggcaaacgagggtgaccccgagggagttcttgtggaccccacctctctcttttggccttaaaaataaagaacgggcacgggcttttattttcccccatttccctcccctcccaatcccggggaacttggaagagggctccttggttccccgcccgcgggaaaatgggggggcggggaagggcggggaaccgtgaaaatccggggtggggctctctcaaaaataacaccacttggggggtggggggagcgggcaggaaaaaatca

SEQ ID NO: 676463 - DNA, 664 bp, Homo sapiens
ggtcctcagctccacggcccaagcccagtgccccagagcttggcaggaggctcccggcggacccaggaggaggacctccagtgctaagtcccagcccagcgtgccaactgcatcccagaaaccggcccactaccccagccccatctctgccctgtgcttatcccagataagaagaccccaaatcccccctggggaaaaccccaggccttgaccattgttattcaaatggcccctcccgaaaagttttaatgatttcccatttgtatttgtgttgatgatggacccacttgacccatcaccatttccagtattcatagatgactgtcaccatatttaaaatagttccccacttgagcacggtacaccacactggtcataattcctgtctgtgtaattcgatgtatatttttcccaacactgtagctattgtttgctttgatttttgcttggcctcctttatgaatgtgcactgtccttgaaggctgaatggacacgtccctttcacgttcagcacgatcaacacacggaagtggagctcttcatgactgtctccagccataggatgatttactataaatttcatcccactacttgtgatctctctcacctacatccattatgtatgttaatttcagccattataaagaattgattttaatgacca

SEQ ID NO: 676464 - DNA, 197 bp, Homo sapiens
ggggttcaagatcagcctggcagcatggtgagaccctgtctctaccaaacatttgccaggcatagtggcttatatctgtagtccctgctacttgggaggctgagatggaaggaccacttgagccccaaggtcaaggatgcagtgagccatggttacactactgtaccccaggctgggcgaaagaaaggggatcctct

SEQ ID NO: 676465 - DNA, 1314 bp, Homo sapiens
ggaaaactagggactctcttctagagccatatagttccctgacagaagagtctctggggttagcgcttcaagcctaagaagggcaatctcagtagactcttctgtcagcgaaatgtagggactctcttgctagagccatataggtccttgtgattatggacatgagagcgaggaacggatggacgtataggatcctcgatattgtgtgaaaagttcaaggtgacagtttgttgaagagcaactaagtatgggagaagtaagatcgtcaagtgtgggcaattgtgtcaataggagtataagttagggacggaggaagggggaatctattgcatacgttgcgagaaagcaaacaagaaggggaaaagaagtagagggacataaagatcagattagggaacgagagggaagaaggaaagcaggtaaggggttagaagggctaagcagtaaggggatcccattgtaaggaaggttaactataaaatagagtagtattcgcgtcgtaacttagtatacgcctgagtaggtgtgcaccaaactaagaaacaacaataaattttagaatcgattgattaaccacaaacgaaatctcagagtagctgaaacaccggggtggaaagcatgagcgagcagaattgtttgagaatatatggctatatatggaaatgcagataagatgaacagaggagttcatatttacgagtatataggacacacagtaataaggtttcacgtgtgtaattgataggaaagattctgtaaagtaaaaagttatgaaggtaggatagatagggcaaaagggatgaacaaaggtatgtggaacgcctatatgaaaattgtgtgtacggcatgggtgcgcattaagttggctagaagatggcacacagggtgaatttgagaagagcagcaagacgtggggagttgagagagaggccaaaaaggaaaagggtaatctcacgcatggtaaaggaaatgagaaaagagaaaacagagcgaaaacacacgacgcggcgcgagcgcaacgagagagaccacaagagaagagggcaacaagacccgaaccatagtgcgacggacacgacacccccattgagcagctaacgaaacaaggagggaaagaaataccacagacagagggggacaaccgcgaagggagcagaaccacaacgaggtaggaggacacgacacgcgaagaggtagagaacgaaaagacaacgacggaggacgaagaaaggacaggcaagcgacgaaacgaggacacaccgacaacgaccagcaaagtcacaacaacacgagacgacacacccaaaacacgcg

SEQ ID NO: 676466 - DNA, 217 bp, Homo sapiens
  misc_feature (17)..(17): n is a, c, g, or t
  misc_feature (212)..(212): n is a, c, g, or t
cataagatagtgacttntggtttctttctcaaaaccattttggttttaaggccgggtctattggtcacatggtaactcttttacattggacttcagtaagatcaagatccttcttgggggccagtgggaaaccaggtctggggcactaaacattcaagaaaggtagggggccatatattattttggctctagatactcctgtagacatatanaaggc

SEQ ID NO: 676467 - DNA, 104 bp, Homo sapiens
gctcccgtatttattcctcacccgaattcgtttgtaaatgtagagtttggatgtgtacctgaggcgggggggagttttcagtatttttttttgtgggagcggtg

SEQ ID NO: 676468 - DNA, 790 bp, Homo sapiens
  misc_feature (427)..(427): n is a, c, g, or t
  misc_feature (465)..(465): n is a, c, g, or t
  misc_feature (487)..(487): n is a, c, g, or t
  misc_feature (497)..(497): n is a, c, g, or t
  misc_feature (515)..(515): n is a, c, g, or t
  misc_feature (524)..(524): n is a, c, g, or t
  misc_feature (539)..(539): n is a, c, g, or t
  misc_feature (555)..(555): n is a, c, g, or t
  misc_feature (577)..(577): n is a, c, g, or t
  misc_feature (589)..(589): n is a, c, g, or t
cccccacaaggtaaatgcctttgttcccagacaatgccttaatgcccccagacgcaacatttcctggacccagtctgcttggtccccagcaccattgtttgacccccctcgaagacatgaagggcttgggtctgttttgagtaatggggagttgcacagtgtatccaccaacggggcagacactcttaattgggtgggaaatggattccttcggctggtttctggttccgagtgctctccccacccacccgagaccagtgggtaaaaaggtccagtcccttgcagggatatatatccgggagagctaggtcccctggggctctggatgctgggtaaccccagaggtaatcgtgggtaccccttctgaagctgtcagggctgtgactagcaccccttatcacccctcactgccttgtgggaatagtanagggtttttttcctccagaccccctggcctttcagttnttaactatttccctccaggccngaaagttttntttgaggaaggagagganagggtggcnatgatgcctttgatntggaattggacatttntctgtcagagcacagaggaggntcatatcacctnttccctctcctaacttggccccggctgcttggaggaccgaccccctggctgagaatatgacggcacagaggaaccgagtttgctcccagtgggaaagggtccccaccccgtcccgagaagatgtctgtgtggctttccctccctgcctccccccgctccccccctggcctttgtaaataaatggcgtggtctttgttgtga

SEQ ID NO: 676469 - DNA, 134 bp, Homo sapiens
gctcggtgatctagtacggcgcagttgctggattcggtaaggagggacagaaaggataacatgggaagcagatgctgtaactactactagagtacctacagggatatagcgctgtctttccatacttacaacta

SEQ ID NO: 676470 - DNA, 110 bp, Homo sapiens
gaggtcctgttctagcaaacaggtggcagccgcttatcacactcacacagtgacttctggaggagtcctggtttggcacaggttgattcttgctccccgagtttgctaaa

SEQ ID NO: 676471 - DNA, 157 bp, Homo sapiens
ccccccggggtaaaaatgccccccgtgttatggggcccaggggggcaaaattggcccccccggagggactcccccctggtagggggttcccctgggccggggtgtcccaaacgcccctttttcctttttttttttttaaaaaaaatttttttgggga

SEQ ID NO: 676472 - DNA, 373 bp, Homo sapiens
ttcataccattatatactttacaaaactcatagaactgtgcaagaccaaaagcgaatcttaacgtaaacagtggacttaagttaatgataatgtatcatgtatccattcactaactataataaatgcatcacactaatgcaagatgtaaataataggggaaactgcctgtaggggaaggggaaggaaatatatgagagctctctgtactttctcttcagtttttctataaacttaaaactgttctaaaagtaaaatatattaatttaaaaaagaaagactaaagagatggtacatcaacacctaacaaaagtacctggcacagagtagacacgccagtaatgtgtatggaataaatggataaactgaaatgag

SEQ ID NO: 676473 - DNA, 600 bp, Homo sapiens
  misc_feature (1)..(1): n is a, c, g, or t
  misc_feature (255)..(255): n is a, c, g, or t
nccacccccaaagactaaaccctgcctaaaggttggtcttcctctaccatgcccaaagttgtaaagccacaacgggtctgaggactctttaagcattcccagtttaaaccagcagcacaaagacctccacagtgcctcccagttatgagctgctttgatgtgactttcatagacacaaagtctcgaaggcacaagccaattatgtcaatatttgtatgtaagaacctatttatgtaataggtaatgaatctgaanctatctagtgcccttaaggagatccagtttaattcaaggtgatcatttacctgtacaagagtgtaaacttttttgtgcttttatttttcaattgtgagaaccactgattggtatgttcaacaaatttgtgtatacaaagaaatggataaatcactgcttttttttactatagagtgaggggttgttaacaaagaatatatattggtcattcttacaactactatttaaagtcagcaccttttcactgaatttgatagattttatgtttggccatatcttcatgctcacatttgatttctgaagacctcctacatacacttcaataaaagttaaatggacatactc

SEQ ID NO: 676474 - DNA, 302 bp, Homo sapiens
cctatctcaaaaaaaaaggaaaaggatttaaaaaggaaataatttagggtttgtcctgaaggggatctgggactaggacacaagtggttataaggaacattactagaataattaaaatttgaacatgacctacagataagagaataggactgctggtccgatgtaaaattttgcgatcttggaatttaaagcaatgatcttgggttttaggacatacgtgaagggtatttaggagtgagaggacacaatcatttgcaatttactctcaaaggatggagaaaaaactgtgtatataaaatgtg

SEQ ID NO: 676475 - DNA, 153 bp, Homo sapiens
  misc_feature (107)..(107): n is a, c, g, or t
gcacttgcacatggttagacaagattagaacaagaggaacagatatggagttaaatttttttgttgggattcagtaagagttggttacaaaagcacaaggcgcagcncacccaactggtcaaggcacatactaagggctacactaggtgtcca

SEQ ID NO: 676476 - DNA, 123 bp, Homo sapiens
ttactcgtcgtctgagcagctgggacaccctcaacgcaaatgtccccagattccaatgtcccctgggaagtaggatcattcctgctgagaaaccacggtcccacaatatccagcttgcacaga

SEQ ID NO: 676477 - DNA, 150 bp, Homo sapiens
taagatgaaaatgggagcacggtccctctgacacctcccacctgcacatgtacactgaccacatctgtagacatcttgagttgtagctgcagactgggaccagtggctcccattctcattttagccattttgtcgcctgcgaacctatta

SEQ ID NO: 676478 - DNA, 286 bp, Homo sapiens
acaggagtttgagaaacctatataccaaaggacagaagtattcattcctgcatgcatcccagacctccttctgcttctcagagctctattctgacaccctccaaccatggaggaaacgcaacagaaaatcaatctagagctgctccgcatctccctgctgctcatcgagtcgtggctggagcccgtgcggttcctcaggagtatgttcggcaacaacctggtgtatgacacctcggacagcgctgactatcacctcctacaggacctagaggaaggcatccaaacg

SEQ ID NO: 676479 - DNA, 115 bp, Homo sapiens
cacgagggcggcagggcgcatgcgcaggcgcagtgtgcgtccgcgtctgatgggagggatgtgggggaagcgaccgccccctgtttgtttgggctgtgggcggtgcgcaccggag

SEQ ID NO: 676480 - DNA, 95 bp, Homo sapiens
aacctgaagattttgcaacttatttctgtcaacaacttcatgattatccccgtacgtttggccaagggaccaaggtggagatcaaacgaactgtg

SEQ ID NO: 676481 - DNA, 134 bp, Homo sapiens
ctagaggatccccagtgtcgttaagaggtcatttaaaacggagacaaaatacaatttctcactttgcatttagtctaaagaaacaaatgctttatagcaaaatgaaagagaacatgaaatggcttctttctcag

SEQ ID NO: 676482 - DNA, 200 bp, Homo sapiens
cagaatgcattgaattattcattaggtgccgtgtacattgcctagaatgacaaaactacattgaagaccttcagtaatggtcctatcagacaagaattgttaattccagtgtaccctggtcaagtgattttgaagactcagtcacatctcatgcaaccagtccacaataagcctgtttaacaacggacctacgcgtataa

SEQ ID NO: 676483 - DNA, 101 bp, Homo sapiens
aatcacatcaagccacaaaccgtgatcgagaccctgtgcgaagtgaccaagggcgacgcctttgtgacctccgacgttggccagtcaccagatgttcgcgg

SEQ ID NO: 676484 - DNA, 160 bp, Homo sapiens
ccattaaaccacaaaaaagagtctatttccagtggaggaaatcgattatcacaaaacaatggcatcccagagtggtcgtggatggggaaagaccaggcgaagaatgatcaggacttttgcagaagcccaggggactcccagagccagagggtttcgatga

SEQ ID NO: 676485 - DNA, 266 bp, Homo sapiens
  misc_feature (8)..(8): n is a, c, g, or t
  misc_feature (209)..(209): n is a, c, g, or t
  misc_feature (214)..(214): n is a, c, g, or t
cataagtnaggctgtgaatctcagctccacagctggctgtgtgtcagtttgctatacctctctgagccatggttttcctcatctgtaaaaagagggaaaaaatctatctcacaggaattatgtgagaaacccattaaaaatgtctaccacataattgtcatttaacttttccaagccttagcggattatctgtaaaatgatgtctatcncaggnttgcaagaagcctagcacaaaccctggtacccagcaggcacctaataaattt

SEQ ID NO: 676486 - DNA, 397 bp, Homo sapiens
ggactggccggggctgtcgcttccgagggcagcggccgggggcgatcaagtgcccggggaacgaccctgggcccccggcccgcgccccggccccggtggcgcgcagggctattgcgcggaagccgttgagaccggactcgctgatcatctaccggcagaaatgcgaattcgtgcgaggatcgggcgccgacggccccagggcaagcctggtgaagaagctcttccagggccgggtaaggacaaggcgccggtgccccggacgggagacgagggcaaggccgggaacccggagacggtcccgaccactcctggccgcgcggtggaccccggaaagcccggagagcccaaggcccaggcggcggtccgcgaggcctccagtgtccggcccggcccctgg

SEQ ID NO: 676487 - DNA, 213 bp, Homo sapiens
tgatctagatgatccccttgtgcaccatccattcacgttcgacgggcagccatcaatgaaactgacactccagcacagctcgagatagaggacgaggacaccatcgacgtgtcccagcagcccgcgggaggtgtgccggacagcattcctggcagggccacagtctctatagccgcccgtccccagcccgggccgtccatcctcgcattgctg

SEQ ID NO: 676488 - DNA, 425 bp, Homo sapiens
gggctctctctgcggaatgaccatggcggctgcgaccctgtacacgtatcctggaaactggagggccttcaaggctctcatcgctgctcagtacagcggggctcaggtccgcgggctctccgaaccaccccacttgcattttggccaaaccaaccgcacccctgaatttgttcgcaaatttcctgccggcaaggtcccaccatctgagggtgatgacagattctgagcggtcgatagcaacgccattgcctactatgtgagcaatgaagagctagggggaagtactgcagaggcaggagcccacgtggcgctagaggcgagctttgctgattccgatatagcgcccccagccagcacctgggtgctccccaccttgggcatgaggcaccacagcagacaggccactgagaatgcggagggagcgg

SEQ ID NO: 676489 - DNA, 423 bp, Homo sapiens
gggggcccagaagcgggaaaaacgctgggtgctgacgtcccccagctgggcaaccctaggaactctcgggaacttggctgtgttgtcctgcctcaaagacatagccatctattgtaggcctagcccctgcctttgaaaacatggaaaggttggaagaacatcaacacagcatggaatatccagggaggtctaatttcaaaacttcataacgaacaaggaaccacctggacttatgtgagggcgatgattaaactggcctgaatttgaatgaaaggatcatgcatgctcaacctgtgactaacaccaaggaggtcaagtggcacaaggtctcgtatgagcgacagcccttccctgataactatgtggaccggcgattcactgaagagctccggacatccatgctaggtacctattgggctgggt

SEQ ID NO: 676490 - DNA, 682 bp, Homo sapiens
  misc_feature (44)..(44): n is a, c, g, or t
  misc_feature (109)..(109): n is a, c, g, or t
  misc_feature (125)..(125): n is a, c, g, or t
  misc_feature (160)..(160): n is a, c, g, or t
  misc_feature (174)..(174): n is a, c, g, or t
  misc_feature (177)..(177): n is a, c, g, or t
  misc_feature (180)..(180): n is a, c, g, or t
  misc_feature (194)..(194): n is a, c, g, or t
  misc_feature (209)..(209): n is a, c, g, or t
  misc_feature (239)..(240): n is a, c, g, or t
  misc_feature (259)..(259): n is a, c, g, or t
  misc_feature (262)..(262): n is a, c, g, or t
  misc_feature (289)..(289): n is a, c, g, or t
  misc_feature (302)..(302): n is a, c, g, or t
  misc_feature (333)..(333): n is a, c, g, or t
  misc_feature (347)..(347): n is a, c, g, or t
  misc_feature (370)..(370): n is a, c, g, or t
  misc_feature (379)..(380): n is a, c, g, or t
  misc_feature (389)..(389): n is a, c, g, or t
  misc_feature (416)..(416): n is a, c, g, or t
  misc_feature (481)..(481): n is a, c, g, or t
  misc_feature (483)..(483): n is a, c, g, or t
  misc_feature (485)..(485): n is a, c, g, or t
  misc_feature (534)..(534): n is a, c, g, or t
  misc_feature (543)..(543): n is a, c, g, or t
  misc_feature (588)..(588): n is a, c, g, or t
  misc_feature (592)..(592): n is a, c, g, or t
  misc_feature (597)..(597): n is a, c, g, or t
  misc_feature (619)..(619): n is a, c, g, or t
  misc_feature (669)..(669): n is a, c, g, or t
cctcccctgggggggcttgggggggggcggggccattctcctgngggggaggggggggggctttggggatggcaagggacttcctgtaacaacgcatctcatatttggnatgactattaaaaaanccacaatgtgcaatcaaagtcctcggccacatggngaactttggggggngcncgngccaaccgactgcngtcaccttcaccgtnccagtttttaaatcctgagtcaagctaaannaaaaaaaaccaaaacaggnganaaaaaacaaataaagccatgccaatcncacctggttttcngcgcaagtgaggttttgtcaagaaagggggngacgcaactgggtnatagtccgcctagaaccatttgngggggacgnngggggggcnggactcgtcatactcctgcgtgcgganccacatctgctggaaggtggacagcgaggccaggatggagccgccgatccacacggagtacttgngntnaggaggagcaatgatcttgatcttcattgtgctgggtgccagggcagtnatctccttntgcatcctgtcggcaatgccagggtacatggtggtgccgccaganagcnctgtnttggcgtacaggtctttgcggntgtccacgtcacacttcatgatggagttgaaggtagtttcgtggatgcanaggactccatgcc

SEQ ID NO: 676491 - DNA, 215 bp, Homo sapiens
aaaagttctactgtgggtaaaatgctatcatgctatcaaacagcatcacatgctacagagaagtcttgtgaaaggatgtcagtgtggcaaacttcattgtcttttaagaaattgccacagctatcgtaatcttcaaccaccaccaccctgatgagtcagtagccatcgtttacgttggcgtaagaccctccaccagcaaaaagattgttagcatt

SEQ ID NO: 676492 - DNA, 1162 bp, Homo sapiens
agtggaacatttgctgccatatagctccaatcctgctaatccgaagccaaagagagtgtatcgttcagcatatgactagaacattccatgacttggcaaggaaatgcagttaaacgggactctggaatatggatcaatgggtttgattatactggaagtttcatcacagtaaccccatcagcattcctgagatcaatgatagtatccgagctcactgtgaggagaagtgcacctctatgtgggtgttccgtgggtatcttcgcagatgcactttctgagtcaggaaagaactggatatcgttcctgccccagaagtttcatccaagaaatcgctccatcatttccgagctcatatccaagagagacagagcaccttgggattgctataacaagttgacttttgaagcacacaggaccaagccatatgtccgttctagtgttcgagcccacaaagggtcaacacatttctcagtggtctctatggcaatggcaccccagtcacaagtaaaggaggagactactttgtactttaactcccatggactccaggcctctgcatggcaggacaggataagaagtgcaggtatcagaagaacatcctgacggaatggtcaccgtggacattgctgcccatatctgtctggggaagacaagagatcccctcaactggatgctctgaaggacaacgttcccagattggacatatccatctgcctgggtgtgcacactacgaacacatagaattccactctggtggaatgaagccaaagagaattgccacaggggactcacccatgtgcactggagcaaccaatcgtacgtgcatgatgcaacgacagaacaagaatacacggacacatcacaagaacgcaccgcgagaaggcgacacgaggacacaaacagacaagggaaacaaataacacacaatcaaccagagaacgacagcaaccgaaaaaggcagcacaggaaaacaaacaagacagaagaacagaaaagacagaaggaaaggagacgacgcaacaaacgacgaagcaccagcgaacaaaacagaagcacgacaaggaaaaggcaacagcaaagaggacacagacaacaagacaaggaaaccaagaagagagcacaacaagatagaaacaataaaggacacgaatcaaaaaggcaa

SEQ ID NO: 676493 - DNA, 648 bp, Homo sapiens
  misc_feature (318)..(318): n is a, c, g, or t
  misc_feature (353)..(353): n is a, c, g, or t
cggccgcgtcgaccgacgatgcgggaatcactgatcctattcacgcggccactttatacccgttatgaaccatccgattatcacgcgtcagacgcattcttcgtcggcctgttcccggaagacgatgccgtcaaaatagctgctacctggtccgcatctaagagaggttcggcgctaatagtctcatttgcgccaacatgatggaacaccgcccgcaccctcgacggatcaatccccctcgcctgcgccacgccaaccggtagatggatagctggagcgggtctgctgagcgtggtggtgaggtcttccaatcaatgncgagctcatctccggggtgatccggatcagcgacnacggcgtcaagacgaccacgcacgaccgtctgaccgatcgtcataacaaaggatttctctactggcagtacagtggcgcccggccagcgactctcttcaaaggcttggcaaaggctccgcagcgcacggttctcggcaccactaggctcagctgcgacagcctcctgtgtagtgttctcctcgtcaagctccgcaacctcctcggcatcgaacagcgggatcggttctgcaggcgcgagccgttgggtcacccactcatggaattgtgtaccaattccagctcctctgtcagctg

SEQ ID NO: 676494 - DNA, 197 bp, Homo sapiens
cccccttttttttttgggcccccccgcccccccggggggggggggggccccggggtttttttttgggccccccccggccctttttttcccccccccaaaaagggggggggggggggggggggtttttttttttttccccgggggggggggcccccctctttccccttttgtttttttccccccccccccccccccca

SEQ ID NO: 676495 - DNA, 316 bp, Homo sapiens
ttttttgagacaaggtcttgactctgtcacctaggctggagtacagtggtgcaatcacagctcactccagccttggcctctggggctcaagtaatcctcctgcctgagactcccaagtagctgggagtataggtatacactaccacacccagctatttaaaaaaatttttttgtagagatggggtctcgtcatgttgcccaggctggtctcaatctcctgggctcaagaaatcctcctgcctcagcctctcaaagcattgcaattacattgcatggtgaggaccacggccagccccagtcactgtcttttgatgag

SEQ ID NO: 676496 - DNA, 255 bp, Homo sapiens
agctgcacccaggctggagacaatggcgcgatctccgctcactgcaactgctgcctcctgggtttaagtgattctcctgcctcagtcttgccaagtggttgggattacaggcatgcatcaccatgcctggctaattttttttttttttttttttggagggggagtttttgtagccaaggttggggggaagggggggaatctaagctaactgtttcttttgcctcgggggacggggggattctcctgcctaagctt

SEQ ID NO: 676497 - DNA, 360 bp, Homo sapiens
gacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaagtaccaggcttggtggcgggagcctgttgtcccagctgttccgtaggcttgaggcacgagattcactttgaaccttgggaggtggaggttgcttgtgagcttgacaccattgccacttgcacttccagcctgggtgacagtgagactctgtctcaataattaaaaacttaattattaatttg

SEQ ID NO: 676498 - DNA, 860 bp, Homo sapiens
  misc_feature (860)..(860): n is a, c, g, or t
ggcgagcgaggagcgcgggacctgcattaatgaatcggcattcgagcgcggccggggcccggagcggcggagcagccgggtcctgaccccggcccggctcccgctccgggctctgacccgacgggcggacgagcgcggcgcggatccgggccgaggcggatgtcatcgagcggacagcactggaaggactctggaatgagcatgacacataaccaggacacagaactcagactgatgccagaaagcacaagaggacatagcaaagctgcaacggtcacaatgtgcaccccaatacggagagaccgacgcacgagcatgcagaggaccaagaggagtagggacacgtacaatgagaaacaagaccacgggcacacttggacaaagttatccaatggacccaatgcacaacaattatcccagtagaacacagtaagaccatggatcacagggccagacattgcacacatgataccaaagcggctaggagcctcgacggcaagaattcatctaagaagcattcccaggaaccgcattatgacacagaagagggtgcccatatggacccaaacaggcaagcgaacgaatccaaaaacaacagtcaatccagagccatgccgttaacgcgaacacgtcatggcacaccaaaaaggccaagatggggacaacgatgaatttgcacaacgcgagcatcgaagggagcaggcggcatgaggcaaaccacagatgcacggtagcagaaggcctgcaaacagccacgccatcgagcaccgtgaggattgacacaacgcgccgtcagcaagagaaccagagaggagggtatcggaccgacaattgctacttgtagcggcccacacacggtn

SEQ ID NO: 676499 - DNA, 1091 bp, Homo sapiens
ggggaccaactttgggaggcgccccgagcagccacgatgtgggactccccatttaagcgcccgcaacggttgattcgcttgacccggtgccaagaaattgttttccacaacgcgcacgttttcaaaaaagtttaaccaatttttcccagggagtccgaaccacctctgccttccacagggaagttgaggatttctccacggttctcggtgttaaaaagggtgattaccacaggagcctttgtgcctagagtggaccaccccccctctggtgcaaaggcagcctgctggttgttgaccccctcgcctcagaaaatttgggagatttcttggcccctccacgccttggtgttctccttacccccggccacggttgctgggcccacttccgccctgccaatgcctccaatgtctggcccccccactgctcggttgtttttttggggaccccccactctgtgtgccctctctcgaaaattgccactaaattgtttgagaagtgccctctacacacccctcgtggcctcccacgagaatggggaactaatgttttggagagaaaaaggggttttttataaagagaggtaaactctataaaagttataaatgagagagtccactttatctcgtgggacccctcgagatcccacatttgagcttatatcgcccctctattatagagaaaaggagaaattttggccacccttaacccctcaccacgagggaaagaaaatcaccttttgagaagacccccccgaagaagaaagaggggcccagggaagaagaaggtttccaggggaaaccccacccctatggccatattcgcttcttggatattcccagccccccaggaatttactgggaaataaccattttttttgttttaggcccccccccatacttgttaatactttgttatggccaccctagccaacttatgccagtcacccaccccgggtgaaaatgggacattccccactctagctctttaggcccagctttatttgtaataagatatcttgttttccaaggatatagatattgagattttccatgtatttgtttaaataaccttgtttcttgtttaaagccca

SEQ ID NO: 676500 - DNA, 139 bp, Homo sapiens
taccattacgctgacctcttccgtcattcaatcactctttcggaatattctcttcctttctatcagtttccccagaagcagtagaaggttactgtttttctccctttgtctagtcttctatctgttctatagttgctat

SEQ ID NO: 676501 - DNA, 285 bp, Homo sapiens
gaacctgaactcaacatgtacaaatggatctaatagacctttacagaactttctacccaaaaacaacaaaatacacattctttgcatgagcacatggcacatactctaaaattaaacacataattagacataaaagaatactcagcaagtgcaaaatagccaacatcctaccaaacacactgtctgactatatcacaataaaaatagaggtcaaaactaagaaaagagctcaaaaccatacaattaccgtggcttggccttgccatagtgcaagggtaccgagct

SEQ ID NO: 676502 - DNA, 917 bp, Homo sapiens
  misc_feature (306)..(306): n is a, c, g, or t
tggggctaaaggttggggctttaagggcagcgggggtaaaaggaaacaaaaacagtaattctgaaaagcccaggaaacaggcagccaggaccagccgtggcccattccaggccagttgacctgaaatgctgattctgtccaggaggggctggctggtattgttgtacagactgggtgaggcagtctagggaggactggaggcctctggagaagaagaatgggaaagactggtcagcgctcaaaagtccattggatgctagtggggcccaggtatgtcctttgcagaccagatagttcgctagaccntcgtcttggggtctgcatacgcctccagaagtttgaggggcacgtcaagttgatccgatagacccaaggcccccgcaagaagggccacacgccggcgctctcctccaatggttccacgcaatgagactcatcccccgaaattggcagaccccttgcaacgccacgggcgcgggcgacccctttctgagcttgggctctctacgcaagcaagccgcttagagacgtgcccatccacggactggactcatcaccacggcttaggtcgagataacaacggaaagtgaggaaatagcctggtagtatccccgagaagcaccccgggttgcggcacaaatcccgggagtaccattaagttcccaaaaaatcctccatcggggcacggtcacaaaatcggctcaccgacagcgcgagctcgacaacggaaacaagtccaaggcccctatgacggccaacggcctggtgcgatacaaggaaacaacgtattagccccccagaaaaagcccagagtgcccagacgccccccagaccttggccccaccgaaaggcagggaccaccccaggaccacaggaccgagatgggcatgtgctacccgacaaaacacgggggaagc

SEQ ID NO: 676503 - DNA, 412 bp, Homo sapiens
  misc_feature (80)..(80): n is a, c, g, or t
  misc_feature (85)..(85): n is a, c, g, or t
cactttctctggtaactccttgagtagcttaataatcaaccttctgaattctttatctggcaattccagaggtttcctcntggtntggttccattgctagagagctagtgtgatcttttaggggtgtcaaagaaccttgttttttcatattaccagaatcacttttcttgttccttctcatttgggaggattatttcaggtgaaaaatctggaactcaagggctgctgttcaggttcttttgttccaccaggtgatcccttgctgtggtgttctctcccttctcctgggatgggggcttcctgagagttgggctgcaatgattgttactgccacccagcagagctactgggctcttacctagtgctgaagtcaccatcttctaaaagaggtgctgcagcttgtgttttcttg

SEQ ID NO: 676504 - DNA, 433 bp, Homo sapiens
ctggctttgggagcactccacccctatgggcatttggagggtcctcccagggtcgggctgccaaactccacggttagctccgggccaacgtggtaggcaaagtatggcgccaggtccaggctacaggctttttttgggaacagaacagtgcccccaatgggcgaggcatgggctgccgccctttccccggctggaccaaccttgttttactggccatggcttaaaacttctgaaaggagggaaaggaggggaaccaaaaccctcatgcccctttggcttttaaaggacaaagggttttgggttttgcccccagccccttggaaaccagtaattcaaaccttcctcatttcatttcaggggtttccttgctgttatcccccaaagccctggggtgaatgtgaatccaaaatctattttttttaataaattggga

SEQ ID NO: 676505 - DNA, 111 bp, Homo sapiens
acgctgctctcactacttctcctcatggtctatcaccaatcttggcaacacgaccatgtggtgcccaagcccttccgcccgatacttggcctgcttcttgacttgagagaa

SEQ ID NO: 676506 - DNA, 526 bp, Homo sapiens
ctacatgttatagcacatgcattagctgtttttcctgatgctctccctcccgtgaaccccttcctcaacaggccagtgtgtgtcgtccctctctgtgtccatgtgttctcgttctcattgttcagttcccacttatgagtgagaacatgtggtgtctggttttcttttcctgtgttagtttgctgatgataatggcttccagctccattcatgtccctgcaagtacattatctcattcctttttatggctgcataatattcctgtaatatgcttatgccctgaatggtattgcctcaattttcttctagggtttccttaatccagtctatcattatggacatttgggttgattccatgtctttgctattgtgaatagtactgcaatgaacatacttgtgcatgtgtccttacaatagaatgattcgtattcctttgggtatatatctagtaatgggatcgctgggtcacatagtatttctgcttctagatctttgcggaattatcacatcgtctttcacaacgggc

SEQ ID NO: 676507 - DNA, 661 bp, Homo sapiens
  misc_feature (516)..(516): n is a, c, g, or t
  misc_feature (518)..(518): n is a, c, g, or t
tatcacaacagaagtaaaatgttgcttggtaaaaaaaaaaaaaaaaaaaaaagggggggggggccaataaccttcgcggggcggggccaagttaccccacccttttgtagggggcgggcccgggggggggtagataagcataaggccggggcgggcgggtgttcacaagacgcgggcgcgggaaagaaagagcaccggtagggctatgcgttgtgctgagggggacccgaacccttctggtggggggggggacgataacattggagtgagagccaccctaacccgaagaatataaatatcaacacgcggcgaaagcgttataacaatcacaacaggtggaagtgagatggtggtgggagatcaaccccgggagccttggtgctcattgggcttgcgtgcggacacaagataagcggtctcacgcgtgaccatgagtggactaatcgagtgcatccagcgataatctccttctctcactgcggcctgtggctgtctaaatcaattcataaatcaccngnaggaacaataaagcaaaaacaacgagataagcaaacgaaacgaaagagaaagcatatgtacagaagccagatagatgaagatcagcagcaagagaagagacataggagagcacacgagaagacagcaagaacaaacaacacga

SEQ ID NO: 676508 - DNA, 439 bp, Homo sapiens
  misc_feature (14)..(14): n is a, c, g, or t
  misc_feature (25)..(25): n is a, c, g, or t
  misc_feature (28)..(28): n is a, c, g, or t
  misc_feature (44)..(44): n is a, c, g, or t
  misc_feature (180)..(180): n is a, c, g, or t
  misc_feature (255)..(255): n is a, c, g, or t
  misc_feature (311)..(311): n is a, c, g, or t
  misc_feature (320)..(320): n is a, c, g, or t
  misc_feature (327)..(327): n is a, c, g, or t
  misc_feature (332)..(332): n is a, c, g, or t
  misc_feature (354)..(354): n is a, c, g, or t
  misc_feature (396)..(396): n is a, c, g, or t
  misc_feature (416)..(416): n is a, c, g, or t
ataacgtgccgtgntagctgtgagnccngcagcagcatggctcnaacaagagaagagatcacagaaacgtgaggatcaagaagccggactacaaggtcgcctacgtgcagctggcccatggacagaccttcacgttcccagatctgtttcccgagaaagacgagagccctgaaggcagcnctgccgacagacctctacagcatgctcgaggaggagaggcagcagaggcagagcagcgacccgcggcggggcggngtccccaagctggttcgggctgtgaccggggtggccaagcagggacgccgccccanggtgggcangcttgtnggcangagcaagccgacccagcggccnaggcggcattccccaagcttggtttccgggcccgttgacggnggcggccaagcaagggacgngccccaaggttgggcaagctttt

SEQ ID NO: 676509 - DNA, 167 bp, Homo sapiens
atacagattatgatctaagcctcgtgaagtgaacatctacctaccgtccttgcttacaacacctcaaatcccctgcccaactgtagccagattctctgcaagacttacagtacataaaacctagcgatacactgagcacatgataaagtcacaagctcttcgcccag

SEQ ID NO: 676510 - DNA, 662 bp, Homo sapiens
  misc_feature (556)..(556): n is a, c, g, or t
agataccatctcatgccagttagaatggagatcattaaaaagtcaggaaacaacagatgctggggaggatgtggagaaataggaactcttttacactgttgctgggagtgcaaattagttcaaccattgtggaagacagtgtggtgattcctcaacaatctagaactagaaataccatttgacccagcgatcccattactgggtatatacccgaaggattatctatcatgctactataaagacacatgcatgtgtatgtttattgcagcactgttcacaatagcaaagacttggaaccaacccaaatgcccatcaatgatagactggataaagaaaacgtggcacatatccaccatggaatactatgcagccataaaaaaggttgagttcatgtcctttgcagggacatagatgaagctggaaaccatcattctcagcaaactaacacaagaacagaaaaccaaacactgcatgttctcactcataagtgggagttgaacagtgagaacatatggacacatggaaagggatatcacacaccaggggcccgtcaggngtgggagccttagggagatagcctttggagaatccctaacttggatgatggggttaaagggttaaggtgcatataccaccattcccatgtatttacctatgtacaa

SEQ ID NO: 676511 - DNA, 267 bp, Homo sapiens
  misc_feature (88)..(88): n is a, c, g, or t
  misc_feature (93)..(93): n is a, c, g, or t
  misc_feature (111)..(111): n is a, c, g, or t
  misc_feature (113)..(113): n is a, c, g, or t
  misc_feature (116)..(116): n is a, c, g, or t
  misc_feature (119)..(119): n is a, c, g, or t
  misc_feature (132)..(132): n is a, c, g, or t
  misc_feature (141)..(141): n is a, c, g, or t
  misc_feature (147)..(147): n is a, c, g, or t
  misc_feature (169)..(169): n is a, c, g, or t
  misc_feature (181)..(181): n is a, c, g, or t
  misc_feature (183)..(184): n is a, c, g, or t
agaggagacccccgggctcgcagagaaatcggcacgaggtttctagagacgcccctaagtcacctgcttcattagacggtttccaggntttcncccaggtgacgctgttancnccncanctggcggtgacanccggcccancgtgcnccaccacacaccgcagagctgnccaggcacagcncnngccccagcgctcatggtgttgaaactgtctgtcatgcaccacggtgtctgtgtccacacagtaataaacggtttactgtccgc

SEQ ID NO: 676512 - DNA, 172 bp, Homo sapiens
tgcgtatagcttgtgtgagcgtgagtgtgcatgtgtgaacctctgcgtgaccatgtgcaaggggccgctcatgcaagagtgttgtggtgatcagcgcatatgcgtgcgtgtgcactaccgggaggggtggctggccgtcgtacaacaggagctgggtgtgaggaccatgctg

SEQ ID NO: 676513 - DNA, 1247 bp, Homo sapiens
gagcactgcctggctccacgtgcctcctggtctcagtactgtgcagctgtcctggggttgcttagcagtcctggagtcctcctacctcggtgctgtgcaagcccacggatcccatctgtgtgccaactctagtaccggtgccgcatcagccaacgccaccctggaccggatcactgggcaagtggtataatatcgcatcgtgcctttcagaaacgatggatgtacatgtcaacggtcgggtttcaggagatccataggcaaaccttctttctagttcagtcggcccagagcgatgacaagaggacatcgagtcgtttctcaagagagtatcctagacgccgatcaggacgcagtgcatcgtagtaaacgagcctacctagcgcttgacattcgtcgccatggcgcggaaagaaattggggagccagtgctgctcgagggaattaacggattgcgcgcaagggtccaaacatgtacgccaattctccggctgcgacctttgccttgaattcccatactagcgtgacgacctctaaagactcttaaccattcatcgtttgccttctttttggaaccagttctgtagaccccggagtttggaaggagacgcacatcctaggggggggcgacctgtgataccttaggcttccttaattcggcgtggaacccaaagggccgctaagcaagcaacagaagcgcgataagtgcatgacatacttggtgagcatgtaaagttaacctgactcgaaagcccttcatacggaaactggcttatggcccggccaattttccccccaaaggttcaaagacttgcttccggtggttaccaacccggcaattgggcgaacacaacacgggcactacacggttgttgaggacccaacctggggaacgaaaaggcaaggccaacgaaggaaacgtggaggaagcgaaaaacccagcgaagcgacgcggcgggaaattccctaaggcccaggggacacacaaagccctttgtggaattccagggaaccaggaaacaaacctttgcggcggggccccaattcccttggcccccccttcccaaatacccgccgaacaatttgtttgtttacccctcccaagggcgttttatattccccccgttccaacttttggccattttcagaagttcaaaaagcggctttccattgagatgatttattgagaaaggacaagacaacgacgacacgacacagtatacaaagcatacaatagacaagcacacaga

SEQ ID NO: 676514 - DNA, 261 bp, Homo sapiens
ggtgcaatcacggatacactgcagtgtcaaactcttggtctacaaacaatcctcctgcctcaggcctccagagtagaagcaattctcatgccttagcctcccgagtagctgggacttcaggcatgcaccagcacacccagctaattttttgtatttttagtagaagtgaggtttcaccatgttggccgggctggtctcaaacacctgacctcaagtgatcttcccaccccagcatcccaaagtgctgggattacaggcgtg

SEQ ID NO: 676515 - DNA, 1396 bp, Homo sapiens
  misc_feature (498)..(498): n is a, c, g, or t
ggcgcctcgggccaggcgttcacgtggcttccagatgaacctgaacatctccgtttccgcagctcgagctggactgacgcatgcaaactcacttgatacgtggacgatgagactgccaagacttgctggtcaacatttctgagttgatgagacgcggtagtagcgcaccagccatcaacaacgcttagcctgctgtacgcctctcgcgagttcgaacgaaagtggcacaccgcggtatcatgctagtggtccgtaacaatcaggtgggtgagtgagacgcacaaaaagcgaacggctcttacccccgaatgcaaagcgaggggtcgctactatgcaccgcagttgggccgttgctcgcagccctgcataactgcacgctaatggggagccattgcgcagttgtaccagacccaaatgggagaacagctggtaggaaagaaaaatcaatgaacaacctcagaccctgtcgtgatctgcagttgcttggagtgctagagnatctcgagacggttcctcacaccattgggttgacttgtcagagagacgcgacgattgaaggcactattccgtcggacgtgaaccatgagtactgtacatcgatgccttcgtgcctgtgcatggatgcctccgaaagagcagccgtagtcaagtagatttcccgtgcgaacaacttcttatcgaatcgtctcgtaacacgacagtaattgacctggttctcgggccaggcctactagctttggttacacgagagatcgacctccttataaatacttagagactggacacggggtgagattgcaaacacccccttaagggagcctcaacacgactactccccaaaggagtttccataagcggctccctatatgtctacaattcccaaccaggattggttcgccgtgggtccattgcgaacccacaaaagcggcggatccgggggccgggctaagttattggcctttcattggacagacaggaaaatgccaatgtccaggtttaggaccccagaaagtaccccatcaaaagcttataggcacggaccacgccaaggtggctatagccagggcaatattctaattttggcccattacgcagagcggtgtcaccgtggagggccccccagatgtgaaaaggcaaatcctggtgacgacaggggccaagggtgctcttatacagtagggagcgcgaaaaacaaacactggcccctgatagtgtggtacaactacccacgcagaaatttttgcttccagaagtagagggaaaagcaataatcgtgcacaagaggacaccacttttgtataccccaattcgggttccctgtgagcgcgcagagcccgtttaccattataccgtttacacacttaacaaggagtccattaggaataaagtatgccca

SEQ ID NO: 676516 - DNA, 114 bp, Homo sapiens
cggagcattacatcctggaagccctgttgtgactatgaacattattcagatattacttattggggatacccaaataaagaatatgaagttgtgactgaagatagaatattcttg

SEQ ID NO: 676517 - DNA, 438 bp, Homo sapiens
acttggcgaggcagtctcgaggggcggcggccgcgctgctctctgtaacgggtcccgcagctgggcaggcgggcgcgctgtttgcgcggagccatgaagcccacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctg

SEQ ID NO: 676518 - DNA, 458 bp, Homo sapiens
  misc_feature (37)..(37): n is a, c, g, or t
  misc_feature (59)..(59): n is a, c, g, or t
  misc_feature (89)..(89): n is a, c, g, or t
  misc_feature (128)..(128): n is a, c, g, or t
  misc_feature (138)..(138): n is a, c, g, or t
  misc_feature (186)..(186): n is a, c, g, or t
  misc_feature (231)..(231): n is a, c, g, or t
  misc_feature (241)..(241): n is a, c, g, or t
  misc_feature (263)..(263): n is a, c, g, or t
  misc_feature (303)..(303): n is a, c, g, or t
  misc_feature (429)..(429): n is a, c, g, or t
atttctttttaaaatgatggttcaaatttgaaaaaanggcttttgtgaggcccaggttnaaggtgacccaggaatcttgtatgatgaanaccttcccataccctgagactctggtactatattgtaancctggcctanagtagttaattacttgagattctttaattttggtctctgagctgggcntggtggttcatgcctgtaatcccagcactttgggaggccaaggtntgcggatcanaaggtcaggagttcgagacccncctggccaagatggtgaaaccccatctctactaaaaatanaaaaattagctgggcgtggtggcgggctcctgtagtcccagctactcgggaggctgaggcagaagaatcacgtgaacccaggaggcagaagtggcagtgagccaagatcgcaccactgcactccancctgggcgacagagcaagactctgcctca

SEQ ID NO: 676519 - DNA, 306 bp, Homo sapiens
gtccagggtgtccagttattcttttcagcagtgcaagtcagacggtggatcaccgagacaagattgtaccgtggtgaaggaaagtggccccacgtcggggtgtgttagtgtgtgaagagaacgggagagtcaggttctatgtcatacaccatccgtaccccgttgtcttaggctgccctgtcccccttcaacccttccagccagggttccatttggtttgcagtggcccaacacaagtctggtgtcctcatctccctactaaccctctgcccgcttctacttgtttaaactaatctaaaaaaataa

SEQ ID NO: 676520 - DNA, 420 bp, Homo sapiens
tctcctcttaggcatatatgctcgatccacgtggacacagaggtgggcatcaagtcaatatccacatgtacagcgcagtattagatggctctgtggaaatctaatgggtattcctggctaggtattagacaagttgtcagctcctggtgatgtggttgaaaatatgctcagtgcctccagtgagaccgtgagattctagcttcaatgagaaggactatgcctgtggtagggtcagcagttacctggtaggcagcattcggtgccacaggtagtatcatggtcgtgtaagcagcatgttccattggctaatccttatagatatcccgtagacggatagagaatgaagctcaagtttcagaatgaccctgtaagttacgcacggtgcagcatgtctctaaggtatcagtctcaccgagtgcg

SEQ ID NO: 676521 - DNA, 235 bp, Homo sapiens
gctagtatgtcctagctgatttagtcaggtgccaggtgcacctggacgctccctacgcttaccgtcaggcctacttacccaaacacttcccgctgccggtcaggcccacagatgtggtcttctccacagtccaggacgctctgcgccttgtcctctatccggctcttgctcggatcaggtacggctgggctgaggccgtggctgtccactggggcttgggggccagctggcgggg

SEQ ID NO: 676522 - DNA, 110 bp, Homo sapiens
gtacgactctagaggtcccctcagtcgcgtgttcacctatggccatcacccaaaacaagaaatagaacacttctgagccaggcgcgtggctcacgcatgtaatcccagca

SEQ ID NO: 676523 - DNA, 896 bp, Homo sapiens
  misc_feature (1)..(1): n is a, c, g, or t
  misc_feature (263)..(263): n is a, c, g, or t
ntcgtggagccgcttttcgcctggtatcctccgacgagtgtcccccgcggatttgttccgccaaaaaggcttgccccccgtgtcgtgacgtgagggtggcccccatccaatgggcacgcgtccatcttttagtgaaccgtgggagcccccacacaggatggtgtttgccgcccaaaccaaccgcgtggtgcgggcatacccgcgcgtgtagtagacaattctatctcaggcagtgtgggcgcgaaagtaacgacattctctcntagtagcagtgtgaatgtggtgtccgctcctctgttagccccagcgtgtatgtgcaccacctgcccttcacctgcccgactcactggcatggtaaaaacatcattacaaccactacttgggggattcatcatgtcctccctccctattctagctctcctcggtataactccgcgcgggcggtgcatcccccccactcttcattgttgctttccacccactgcggcagagatgtttatcgaatacaagagagataacgaacattgttcttacaatactagaaattctatgggagaaaacacgttccggggccccactctcatttgaagtcggatccgctacacccaaataatgcatttggtctcttctgcctttgttgagccggggggccatttatcttgggcagaataatcgcggggtcggtccatccaccttttgaaagaaaagggtgcccggtcgtgttatgcccccggaaagcacctttggatacaagggcagtgcgaaaagaatcaaattgcaagacgacactgcgtcgcccactagtcggcgaaaaaaacgagactgtgattgtaggaggaaaacaaaagttacattcccatccaaaaaataaatcaaaaaaacaaaaaacatgacga

SEQ ID NO: 676524 - DNA, 711 bp, Homo sapiens
tataattacaatgcgtagatccctatatcgtcttttctggcacattgcagctgcaaagatgtctacaagacgcacttccccctaatcatagtagagcttatcacctttcagatcacgccctcagaatcacttttcctatctgcttccctagtcctgtatgccctttgtcctaacactcactactaatacttagctaagttctcacatctcagacgctcaggagaatagaaaccgtcgtgaatcatagtcctgcccgccatcatcctagtcctcatcgccctcccatccctacgcatcctttacataacagacgaggtcaacgatccctcccttgaccatcggaactcaattggccaccaatggtactgaacctacgagtacaccgacttgatcgtcggactaatcttctaactcctacatacttcccccattattcctagaaccaggcgacctgcgactccttgacgttgacgatcgagtagtactcccgattgaagcccccattcgtagtagagtaactctacatcagcagagacgtctatgcactcagtgagctgtccctcacattaggcttatctacagatgcattcccggacgtctgaaccaaaccactttccccgctacacgtccgggggtatactacggtcaatgctctgaatctgtggagcaacacagtctatgcccatcgtcctagattaattcccctatctg

SEQ ID NO: 676525 - DNA, 1402 bp, Homo sapiens
gtgattctctggctactaagctgtctgtccgcatcgtcaggcctcctactagtgcgctggattatacagtgtgacgtgacttcctccggtgccgtatttgaacgcagatctagttgtagcagctcgctttgagaatcttgccgaaatgctctctggcatctccaggaggatcactccctcttggcctcatgtccaagtgcctccatggagctgtgtatggcccatggccttacttatctagtggtgtgatgcactcaccatcgtatagtcaaggcatgcatacagtacagtctggacttcgagtcacgattgctccaccagaagaggataaccgtgtgtgtccccgtgcctgggatttggcttgcagtgcgtttgtgagcgccttggtgcaagggcttctcagagcactctgggacgttcctctttgcacatgcatcgtcgtggctcgtgttgcatccctcattcaataagatccgtgagaggggtacgcatcactgcacactaatgacgcgagacgggtcgaatcggtagacaagtgcgttgaaatgctcttgtgacccgagggtttcctattgcccactcggatggtgatcgattctcaagactatgtcggggaatgctcaatgggggcccatgtcgaacattgtccatcaccgggagtccgatggcaaggtgggagttgccttgcctcgagagattgagagggaagaaagcgcatttgctaccccaagcccattgacccgaaaacgctcgggcgtggacacacatcctgccatatcttcttagcgtagaacagaatagcaaccaacacacttgcaatacctggggcttgcaacagtgatgttgctggcaggtgaccgcatggatcaggatcgccaacgccctaatccgttgggttgcaatgcgcttggcacggggcccgtggactgaccatgagttgttatagacccctccttgtctcgaacgcgccccgcacgaggtgggccacttgcaagggtcttgcagtagtccggaggcccgagttgtcaatggtgccatgtcccctacgcggtggaccaagtgagggcaatggcaacttgaccaagttggtcccattttcctcatatgttggcaactacatgcgacctgcggaagttgctggcccgtaatgtgggctccggagcgccccgttaaccatcaaagtgagggtataaatggtgaccacagcgggacacctacgtggttcggaattggccccgacccgcatctgtcgacacggcgagccatacccgtggtacagacacacagcttcggtgtcatgcactgtcccacgcggttgtgttcccctatacacgtcatggcaacccgtgtgatataacacaatcgggtatttgccgcaagctggttcaacccaggtggtact

SEQ ID NO: 676526 - DNA, 801 bp, Homo sapiens
  misc_feature (345)..(345): n is a, c, g, or t
  misc_feature (370)..(370): n is a, c, g, or t
  misc_feature (375)..(375): n is a, c, g, or t
  misc_feature (384)..(384): n is a, c, g, or t
  misc_feature (388)..(388): n is a, c, g, or t
  misc_feature (392)..(392): n is a, c, g, or t
  misc_feature (402)..(402): n is a, c, g, or t
  misc_feature (410)..(410): n is a, c, g, or t
  misc_feature (418)..(418): n is a, c, g, or t
  misc_feature (430)..(430): n is a, c, g, or t
  misc_feature (446)..(447): n is a, c, g, or t
  misc_feature (450)..(450): n is a, c, g, or t
  misc_feature (463)..(463): n is a, c, g, or t
  misc_feature (465)..(465): n is a, c, g, or t
  misc_feature (469)..(469): n is a, c, g, or t
  misc_feature (474)..(474): n is a, c, g, or t
  misc_feature (476)..(476): n is a, c, g, or t
  misc_feature (508)..(510): n is a, c, g, or t
  misc_feature (522)..(522): n is a, c, g, or t
  misc_feature (532)..(532): n is a, c, g, or t
  misc_feature (565)..(565): n is a, c, g, or t
  misc_feature (597)..(597): n is a, c, g, or t
  misc_feature (796)..(796): n is a, c, g, or t
ctcaacaccctgcttctcccggggacgcttttgagtgggccctgcccggggagctgcagagcagcagcacctttctctgagaagaggtccttggttgggtcaaggacagggctgagcgtggaagggggagcagtcaggggctctgtgttaggatgcggctttctctgcctctgggcagcctgctttggcctttccttgtatgtgggtgtttattacaagtggctttgtgtcagacacgctcggctccccacctggacacacactcaccagtggcctttcagtgtagcgggaggaagccggtgtccctggatgtgaagctcacactgatgggctggggcaggggcntgggccggcgaaggggccggggggngaggnacaaatcgnagtnttcnaggcatgccnagcagcanaaaagaantcaaccaaagtntagttatatatttcannggnatacaaagttacntnagtngcctnanaaatcccttcctgttccctcctggtcctgtgnnnctccccagggtntgttccttcnttctctctcctggtgtgggttaaagggacattnacaaaccaggtcaccatcctcagaggctgagncctgtacccaccccagcacagccacctccgccagaccccgtggctcctggagagccagctttgctattcccattgtgacagcgatggcaggcctgacccacggggcagttagagcagcctcgtggagctcgcccctcccctcagcctgcccacctctccctgcatcctgaggccagtggccccgggccttcacagaatncctaa

SEQ ID NO: 676527 - DNA, 213 bp, Homo sapiens
ctccatggcacattacatcaaactgtcaaaagtcataagcaatgataaaattctaaaaacagaaggagaatagtgtctagtcacttataatggaaccctaatgacttcttatggaaaagcttacaaggcaggattaaatgaaatgatatactcaaagtgctaaaaaaaaaataatgccattcaaggatactatactcagcaaagttatacttc

SEQ ID NO: 676528 - DNA, 616 bp, Homo sapiens
  misc_feature (25)..(25): n is a, c, g, or t
  misc_feature (455)..(455): n is a, c, g, or t
  misc_feature (493)..(493): n is a, c, g, or t
  misc_feature (496)..(496): n is a, c, g, or t
  misc_feature (505)..(505): n is a, c, g, or t
  misc_feature (553)..(553): n is a, c, g, or t
ggtttatcgtcgcttggggactaanggcgtcggtgtggcgcgcaatcgggttctaggcgtgcaggcagctcgaggacccgcggcgcccggccccggtctcggcctgggcagatagcagaggcagacaggccgtgccgggggggcatgttgctgctaacaaggtggccccagggtgcatgcttacaggctgcgactagtgcaccatgagagggcagggcccgcagcaaggtgctgaacactatgtcttgcaagatggcttgttcgtggcgatcgtggatatacttccgttcgagtggtgtttaactgcatctggggtggaagactttatagatgatcacgttgcgagtcgaggattagactcgtgcgacactttggcgaattggcgaggtagtgctccttagcggttaggacaaaatgcgtgcgcacgccggttgaaagtcgttgccaatcgcggntggtgctaaagctgtcacctgttgggttaaccccttanacnatgtcggcntaagtggggaacgaaagtctagaatcccgggtcccatcctagtactgnacaggacaaacctatgatccccgtccccgtttattgagggggccgcgggccgggcaattggaa

SEQ ID NO: 676529 - DNA, 249 bp, Homo sapiens
tctagaggatccacccatttctcaggtgattattctgtggatttatttatttatttatttgagagacagagtcttggttctgctgcccaagctggagtgcagggtgcgatctcagctcagctcaatggcagcctcgtgcctccaaagttcaagcgattctccagcctcagcctcccaagtagctgggaccacagaggcacaccaccaggcccagctaattttggtattttaagtagaaatgggctttgg

SEQ ID NO: 676530 - DNA, 167 bp, Homo sapiens
actggcatgtaggttatccactattttgctcaggatatctggaatacctagtctgaagcaatcctcttgccttgtctttccaaaatcgttcgattacaggcatgatacaccatgcctggccactaatttctttttttttatttatttatatatatatttattattta

SEQ ID NO: 676531 - DNA, 1350 bp, Homo sapiens
agcggacgtgggaactgtagtgggtgcagctacggccgtcgggtcgtcgtgtgtgctgttgttcgtgcgaggcgagcgcgctgacgcgtctgcgagaagcatcacgtggggcgaccacgggccccgtcacgtggtgcgtacttcgtcgttggcgtgcccgcccgtgtcatacgtcccatgcctcatacttcttgaggatttacgtggattgcgacatgtctaatcttgatgggtgcatctgatgcgcgaggagtcagcaggaaagtagagtaccgcgtgactgtcatctagatagacagcacattccagaaagtgctttgcgattacaacgtcaactcgaggaagtgacgcctcgcagagtgtgcctccgatggattgcctgcgtgtacaaacagtgtctcggctaacgattcttacgaatcgacgagtcaaatgctcgcgaggaagcatgtcagaacgctgtctgggtgtagctgagcgtgcgatagcaagaactatgatttaatccgtctcatcaggaagttgccactttgaaagacatcttccgttcgcgagggtaccaatagaggaaatggcagggcaattggcataggattgatcgtaggagcaaccgaggggcggggccctcggttgggatttggaaataagagtggccgcaggttgggaccttgtgagtgatatccggaaatagtgttcgcattaccctgtggtactaaacagccttggggcggactcggagcccttttttcacattccctcgacttttggatgaaaattgggctggtggaccacatttgagaatgaccggacatgtggctttagataatgcaacacccccgtctcgcgcttctcccgcgcacgggtaacatttcgcaccgttttcccccttccttgttcacttctagatagagcgagaggaggttgcgtgtccctactctataagaaggggaattcccccgaaggtccctagggggtggggttcattgacacaatggcccctcgacaagaccgttggtacttctggtagagagattgatccgcctacttgttccatgtccacaccttttgcgaagtcgcttgtgtgatggcattggtggtcctttgtggaaaaattttttcccaccccctcctcatatctgccagcgaagcctatttccaaatgttatgcattaggttgcaaggcgcaaactaagtcgggaagtcattcgcgtcgttagcgcataatggctgattcgaaaaaggccccataaggaattgtcccgcatttgcgttcctttgggaaccaatttgggtaccccctatatggttagcgtatgtaacagctttagggacaaaacgcaattatttaca

SEQ ID NO: 676532 - DNA, 112 bp, Homo sapiens
ataagcactggctgttggctctcttttcggcgttgttgatactcttgagagcctctgccaggacattcatgcgccccattgtggcttagattgcaggatggtgcaccacgaa

SEQ ID NO: 676533 - DNA, 651 bp, Homo sapiens
agcggggggggggcggggcctcgggcctgcagcctcgtcaggctcagtcccctcccgataaacctcctagtatagggagctttcccggggggtgaccctggcttctgggcgaaaacccccagtttaaggaggccttccccctggcttcacgattgtggagtcgaaaggaacccttggtaaggcggagaatgagctcgtgacgatggacccgaggaaaaaacctgccagaccaggattctatgtagaacttcagcgtctttcaggctttggagggaaggcgattatgaacgggatttcaatgaaatgaaccctgtcccttcggcttttgttttatcctcttctcgggttctcgtcacgttgatggtcctatctttatttttaaaaattaacatggctgcatattccccagcatcctaaactctagtgcaacctagtggcaagtggcgaaaaaattacctgccaaccgggattcctactaggtcccccggagttctcgcaagatttgcgacccagattggcaaaaatacagtgtgtgcacgcggactcaagtggaccattgtcaccaagaagtcacgagattttgggggacttgtagcagaaaacagcgtgttttataaacagccctgctccacagctgggttaccagtgact

SEQ ID NO: 676534 - DNA, 1517 bp, Homo sapiens
  misc_feature (1225)..(1225): n is a, c, g, or t
  misc_feature (1413)..(1413): n is a, c, g, or t
gggaaagagagagagacactaatctcgaggtatgtaacaaggattgagcgagatctgtgcctctactcattctacatcactgtcggaacatgctgctgtccgatgccttggagccgtcgggaaggcgtatcgcaagggcatggttggagtcaccaacatggggagcacgggcgggacgagctgcaccagatgatgcctaggaagactgagtccaggcaatggggagggagtagccggtccgcggccacgtgacttaattagcatagggacaggactgcgggcaacggtggaaagaacaggcacactcaggcactagagagtctatttgtgtcgacaatgtgtcgctctcgagagacgctctaggaaaaatgggcgcgagaatcatctacgtgtcgactgcgggctctggtgtcgacgctagtacacacttcgtgtacctcccacataggggacgcactcgcaagggcgagacgcaccccgaacaagactgactttgcaaccgtgcaactggtccttttcccagtggtctggggtcccaaatacacgagcccacattagctgtgctatgtttgaacacccggcacgcgaacgcacacgcggattcgaagttcatgttcggacacagggcggggaaggagagtgtgacagagaccagatgtgcgcaaagaacctctagtatgtgcgagtgtcctgttgggagtctccacaagagggcactcttgtgttgccactctgtggagagcagcatagagagtcttggccaccagggtggacccccccgtcataatgtgactcttctataaggaggacagtaaaagcacggaatgtaactccaaagtccttactcgaaaaatcttttgtgctgctcccccccaataataaactatgtcggcgcacgcaattgtttgccccccatcgccaaggtgtagacggcgaaaatatatatgggcggtgcgcgtgtgtgcacgggtgtaccaacccaggatccgccctgtgaacaccaactatataaaccaacccgcgcgggggacaacatgtgagacattctcgctatgtcgttgtaacaaaacggctgttgggggaaccaccccctttataaaatataaccacacaaaaaatgtcggctctttctgtactatcaatcccacaaaggtgtaggctctccgaaaatagagcgcgccctttacacacaaatgatatctccgacatggggcgatcgggctcngttatgagggcggagccaacccctttggtagtttccttgcggcaaagacatacacgtgctgttacaaacaggcaggaaaagcagcaagcgggtggcgcctcaaaagggaggcgccttgcctggctccgccctttagacacacgcgacaacaatttcgttccccacattacaactcacacacgtgtgtnggtggctggtgtattacagcaccacaggttcggcgtgcatcacatagtgagtggtcacaccccgtggggttttatgcccccaataaaatgtggttgctggtgcg

SEQ ID NO: 676535 - DNA, 410 bp, Homo sapiens
tgaggggagaaacataaaaggaggacgttggccaaggagttcgagaccagcctggaaacatagtgagaacccatctctacaaaaagcacatgaattagctggacatggtgacataaacctatatccccagcattcgggaggctaaggcaggaggattgcttgagcccatgaagtcaaggctgcagtgagccgtgatggcaccactacactccaccctgggtgacagaatgagactctgtctccaaaaaaaaaaaaaaggaaaaagaaaaaagaaacaagaatttcctccagtaaggctcttaaatcagtattcggctggttaaagaacatggaagggcaaagggttacgggaggtgaaagaatccctgcaacgggtctgaatactacaattttaagcaaaacagtagata

SEQ ID NO: 676536 - DNA, 149 bp, Homo sapiens
cagtccacgtgtaggtcagtcacagcaggcccaggcccaggacacagtgttgagcattttacgggcaggtaagaggcttctaggaaactggtgcctctagaggcaacccggtgcccgaggtggagcaggttttcagtggctagaagtca

SEQ ID NO: 676537 - DNA, 317 bp, Homo sapiens
agcggagttgggcatcccagcactgagttctgcccgagagaagccgacccctcccgcaatgccagccccgccgtgcgcctcctgtcatgctagcacgcgcacgaacctacagacacaatgaaaatacgatacaccaacacgcacatacagatcgagatgccactgactcacctgagcaacgagccatccaagcacgcaccaacctgctagccacgcacaccacgagacagacagccagcccagcaacacgacacacaacacgctcacgaacccaaccacacaacaagataacgagcacaacacacaacaaaccacaa

SEQ ID NO: 676538 - DNA, 399 bp, Homo sapiens
  misc_feature (19)..(19): n is a, c, g, or t
  misc_feature (45)..(45): n is a, c, g, or t
  misc_feature (83)..(83): n is a, c, g, or t
  misc_feature (244)..(244): n is a, c, g, or t
  misc_feature (252)..(252): n is a, c, g, or t
  misc_feature (309)..(309): n is a, c, g, or t
ggagagccaaggggagggncagacagatggagagacatggcgggnaggaggagagagagccaaggggagaaacggaaggaganaggtgttgatagggtctggctctgtgtccccacccaaacctcatcttgtagctcccataattcccacgtgttgtgggagggagctggtggaggatggttgaatcctggaggtgcgtctttcctgggctgttctcatgatagtacgtgggtttcacaagatntgatggtntaaaaactggagtttccggacacaagctctccctttgcctgccaccatccatgcaanatgtgacttgctcctctttgctttctgccatgattgtgaggcctccccagctacatggaactgtaactccattaaacctctttcttttgt

SEQ ID NO: 676539 - DNA, 741 bp, Homo sapiens
  misc_feature (165)..(165): n is a, c, g, or t
  misc_feature (168)..(169): n is a, c, g, or t
  misc_feature (174)..(175): n is a, c, g, or t
  misc_feature (237)..(237): n is a, c, g, or t
  misc_feature (250)..(250): n is a, c, g, or t
  misc_feature (284)..(284): n is a, c, g, or t
  misc_feature (327)..(327): n is a, c, g, or t
  misc_feature (342)..(342): n is a, c, g, or t
  misc_feature (349)..(349): n is a, c, g, or t
  misc_feature (362)..(362): n is a, c, g, or t
  misc_feature (369)..(369): n is a, c, g, or t
  misc_feature (374)..(375): n is a, c, g, or t
  misc_feature (395)..(395): n is a, c, g, or t
  misc_feature (408)..(408): n is a, c, g, or t
  misc_feature (415)..(416): n is a, c, g, or t
  misc_feature (433)..(434): n is a, c, g, or t
  misc_feature (436)..(436): n is a, c, g, or t
  misc_feature (442)..(442): n is a, c, g, or t
  misc_feature (444)..(444): n is a, c, g, or t
  misc_feature (457)..(457): n is a, c, g, or t
  misc_feature (463)..(463): n is a, c, g, or t
  misc_feature (491)..(491): n is a, c, g, or t
  misc_feature (496)..(496): n is a, c, g, or t
  misc_feature (506)..(506): n is a, c, g, or t
  misc_feature (508)..(508): n is a, c, g, or t
  misc_feature (529)..(529): n is a, c, g, or t
  misc_feature (536)..(536): n is a, c, g, or t
  misc_feature (552)..(556): n is a, c, g, or t
  misc_feature (558)..(558): n is a, c, g, or t
  misc_feature (564)..(564): n is a, c, g, or t
  misc_feature (591)..(591): n is a, c, g, or t
  misc_feature (599)..(599): n is a, c, g, or t
  misc_feature (605)..(605): n is a, c, g, or t
gctaaaccatggcactggctgtttctgggaagtagggcctattaaagcatgggccaaggagacggtattgtctccttcaaaagaaaatacatctctcctggggcggggtggggggtctttctaggcccccaaatagctttttgtctttctcagcctctgatgtgngtnnagatnngggtcttactatgctgtccaggctggtctcaaactcctgggctcaggagatcctcccatctncgcctctcaaagngctgggattgctggcgtgagcaactgtgcccagnctctctcttctttttttctgaaccctatctctgatctctctgnctctggctcatcatntctatgnatctctgtcactntctgctnttatnnccgtgagtccctttctgggnctctgtctctgtntgtgatnntcctttattacttaacnntncctcangntggttccaaacantcttangagaaatctgagtagcaccaagcccctngcagntgactgctgngngatgttgggtgagctgctgtnttttggncttgactctcttttgnnnnnanatgcanaactagtacaagcggcaggggtccagnactgggangatttngggggttctcaattcacacacacaactgtgggtcacaattcatagaaggcaccccgcaccgagcttattctcttaatccctttgggaggcccggtggtgtgttcacccgggttgaatttagaccccttgtcctttt

SEQ ID NO: 676540 - DNA, 688 bp, Homo sapiens
gctgtagagacagtcttcttggattcagatcctgactccacttagctatgtaacctggtcagattacttcacctctctgagcctgtttcctcatctataaattgggggatagtaatgccaactcattgtggctgttatgaggattcactgagataatgcgtgcagtgctcttatcaccatctctggtcgcgtaagcgtcaacggaaatatgcagttgctgtgtattcggggctaatagctctgaggcaaaatgggcgacattatttcctttgaatgacattcaagcagtttgtagcatagctgagggcttactattggggatgagctagtctcctgcgtcatagacctctgcacctttcatcacgtcagtactccttgatcaagcagtccccatagccttttgggctaccagggaccgagtttagtgcaaacacaattttcccaccacgtggactggagggggactagcagcgggtagatagtgccgtggatgataactcgtgtagatcatctagaatacagtgaggctagtaacccagttctgcactaaaggctcgtaatcgcaaagcctcagattcccttcgccccttgcccgggcaaaagtggccgtatgcactccctgtgacaagtctcttgcaggtgcttcactcttgccagagatgaggaaacttcaaggcggatctgctga

SEQ ID NO: 676541 - DNA, 468 bp, Homo sapiens
  misc_feature (67)..(67): n is a, c, g, or t
aagacattcggcaatgtttggagatattttggtcgtcacaactgcaaggaaggatggtatgctgccnacctattggctagaggccaggatgctgctaaacatcccatacaccttacaggacagccttctccaatcccaaagaatcatctggtccaaagtgtaaatagtgtcagagttgagaaattctgctctagaagcttggtcaaattcaagttcaattattttggcaaggtctgcttgtcactgtttttgtgattagatttggtagtgggcttaagtgtcatcaatgtgatttatccattgtaaagtgattgccttttgcataatgtcatgcattcattcatgatcattgcctagattcgttgttgttaggagctgcaaaatgatcactttcttattgtgtctctctttcagccattactggaatccttttatttccattactgaaatttccattacaggaatcct

SEQ ID NO: 676542 - DNA, 334 bp, Homo sapiens
ctcccgggttcacgccattctcctgcctcagcctcctgagtaactgagactgcagatgcgtgccaccacacccagttgatttttaaatatttggtaaagatgtggtcttgctgtgtggccctggttgatctcaaactcctgcactcaagcaatcttcctgcctcaagcgtcccaagtgctgaaattacaggcatcagttaccgagcctggagggtcgtaactaaagcgaaaaagtgcaggacagagatgtaggagctcaggctccctctgatggtgacagaaccaggcgacgtttttaagctgggtcctgtgtggttgaatggtcgcaatccgg

SEQ ID NO: 676543 - DNA, 684 bp, Homo sapiens
  misc_feature (165)..(165): n is a, c, g, or t
  misc_feature (168)..(169): n is a, c, g, or t
  misc_feature (174)..(175): n is a, c, g, or t
  misc_feature (237)..(237): n is a, c, g, or t
  misc_feature (250)..(250): n is a, c, g, or t
  misc_feature (284)..(284): n is a, c, g, or t
  misc_feature (327)..(327): n is a, c, g, or t
  misc_feature (342)..(342): n is a, c, g, or t
  misc_feature (349)..(349): n is a, c, g, or t
  misc_feature (362)..(362): n is a, c, g, or t
  misc_feature (369)..(369): n is a, c, g, or t
  misc_feature (374)..(375): n is a, c, g, or t
  misc_feature (395)..(395): n is a, c, g, or t
  misc_feature (408)..(408): n is a, c, g, or t
  misc_feature (415)..(416): n is a, c, g, or t
  misc_feature (433)..(434): n is a, c, g, or t
  misc_feature (436)..(436): n is a, c, g, or t
  misc_feature (442)..(442): n is a, c, g, or t
  misc_feature (444)..(444): n is a, c, g, or t
  misc_feature (457)..(457): n is a, c, g, or t
  misc_feature (463)..(463): n is a, c, g, or t
  misc_feature (491)..(491): n is a, c, g, or t
  misc_feature (496)..(496): n is a, c, g, or t
  misc_feature (506)..(506): n is a, c, g, or t
  misc_feature (508)..(508): n is a, c, g, or t
  misc_feature (529)..(529): n is a, c, g, or t
  misc_feature (536)..(536): n is a, c, g, or t
  misc_feature (552)..(556): n is a, c, g, or t
  misc_feature (558)..(558): n is a, c, g, or t
  misc_feature (564)..(564): n is a, c, g, or t
  misc_feature (591)..(591): n is a, c, g, or t
  misc_feature (599)..(599): n is a, c, g, or t
  misc_feature (605)..(605): n is a, c, g, or t
  misc_feature (684)..(684): n is a, c, g, or t
gctaaaccatggcactggctgtttctgggaagtagggcctattaaagcatgggccaaggagacggtattgtctccttcaaaagaaaatacatctctcctggggcggggtggggggtctttctaggcccccaaatagctttttgtctttctcagcctctgatgtgngtnnagatnngggtcttactatgctgtccaggctggtctcaaactcctgggctcaggagatcctcccatctncgcctctcaaagngctgggattgctggcgtgagcaactgtgcccagnctctctcttctttttttctgaaccctatctctgatctctctgnctctggctcatcatntctatgnatctctgtcactntctgctnttatnnccgtgagtccctttctgggnctctgtctctgtntgtgatnntcctttattacttaacnntncctcangntggttccaaacantcttangagaaatctgagtagcaccaagcccctngcagntgactgctgngngatgttgggtgagctgctgtnttttggncttgactctcttttgnnnnnanatgcanaactagtacaagcggcaggggtccagnactgggangatttngggggttctcaattccaccacctggggtagatatcacgacacccttgggtgagattagaccactgggcgctgggccccn

SEQ ID NO: 676544 - DNA, 338 bp, Homo sapiens
aggactgtcattagagttataacagctcaaaaagttttataatactgaagattagtatgacaccaattagttcagtaaccagggcacagttgctatctcctattgatttggtatgggtagagtgaaatgaacctagaacattgaaaatactaaataaatcctctaaacaattgtttctatccatattgagatattttgcctgcagaaaatggatttttactgaaagcagtgccaactagggattgtatacctggttagggaatccaagttccaattctattacctctttaactttttacttgctttctgagttatggatcagctctgtatatagcatt

SEQ ID NO: 676545 - DNA, 193 bp, Homo sapiens
gagaatggccagcaggaaggcggggaccggggcaagtggcagcaccaggcaggcccaacgtggttcttccaacgtcttttccatgtttgaccaggcccagatacaggagttcaagagtttctccccaccttccactttccttagagctggggcttctccaaccttaaggccccatccacaggcttcagctgat

SEQ ID NO: 676546 - DNA, 167 bp, Homo sapiens
gaacccccgggggggaccctggggccctccccggtatcctttttttcctttggggggggccccccccccccccccccctcccccccttttggggggggggggggtagggggagggctgttttttaaaaaaatgggaaaaaggggaataaaaaatttgttggatccga

SEQ ID NO: 676547 - DNA, 136 bp, Homo sapiens
tctcacccgaaggtatggaaatctcatcttgaggccggcctcccgcttagatgctttcagcggttatccatcccgaacgtagctaatcagcggtgctcctggcggaacaactgacacaccagaggttcgtccaacc

SEQ ID NO: 676548 - DNA, 840 bp, Homo sapiens
gattacagttcactccagcctcaatctcctaggctcgggcaatcctcccatctcagcttcccaaatagctacgactacaggtgcatgcctccatgccctgctaattttgtgtaagtagagatggggtttacatatgttccctaggctaatcttgaactcctgagctcaagcaatccacccgcctcggctcccaaagggctgggattacaggcgtgagcctatcatgcctggcctaatgtattttttaaccagtggaatctaaccaagactttccaaacaaaatataaatcagctcagtaaggatggatattttgtacatttaaaactattatttaagcgccgggagtggtggctcacacctgtaatcccagcatttgggaaagccgaggccagggggatcatctgaggtcaggaacgttcgagatcagcctggccaaacatggtgaaccccatacctctactaaaacatacaaacattagctgggtgtgcaggatgcgtgtctgtaatccccagctacttgagaggctgaggcaagagaattcaccttgaaactgagaaggcgggggtcggcagtgagccgaggatggcagacattggaactccagctggggtgacagagcaggactccgtcttcaaaaaacaaaacaatcaatacacactatctgtcttagctgatgtcttacagcattgagaatccaaggctaatggatggtccaagtccacctacaatcaggcctattataaaaatccactatggggtgctatgaccggacttcatcatacggtcatattcctggacacacgggggcctagaagggcctggcccaagtgggtctcca

SEQ ID NO: 676549 - DNA, 200 bp, Homo sapiens
agggcttcttcaaggtaccgcgcacccaggtgggctttttgttggaaatggagagaggctggcctcatcccattggacctgtggctccccctggttctcctcctggctaagtccttcctgcgggtgggatcgccctccaggtgggcgccttcctggagaccgtagatgccagggctggaactttcatttgccgggacact

SEQ ID NO: 676550 - DNA, 274 bp, Homo sapiens
acctggggcccccccggggggaaaagggtttttttttccccccccgtttccccccggggggcgggcccgttttgaaagggggaccccaaaccggggtttttttttaaaaattaatttacccccttaaaaggggggtttttttttttgggggggggcccccccccccagtttttaccccccccccctttggggggcccgttttccccccgggggggttttttccccctacaaacgggggggggggtttaaaagggaaaaattttttttttcccca

SEQ ID NO: 676551 - DNA, 275 bp, Homo sapiens
ctttcgttagctcaggtttatcactgctgtttcccgctgaggggtgtggctggctaagcgttttgagctgctttgctgcggtgctttatgcttgttccttttgatcgtcgtgtatttagagccgctgctcgcactggaacgggaggcggagcatagtcgactgggagcgaccgatcgggccgccgccgccgccatgaaccccgaatatgactacctgtttaagctgcttttgattggcgacccaggcgtgggcaagtcatgcctgctcctgcggt

SEQ ID NO: 676552 - DNA, 821 bp, Homo sapiens
gcctcccttactgtcttaccccttctcgctctcacatgtggtcactctcttgctccttttcaccttccagacataggacaacacgatgtgagagcttcaccagatgcaggcccctcactttcccagtgttcatataccataaactcaaagtgtaagcccgttataaatcacccagatctgtgagtattctgttgtagcaacaacaatgcagactaagactgggacactcagggagctcttctctctacttgatggaagcactcccatgcgctggtgccttggtattatgtagaacggatgatgctgttacaacttctctttgtaatgtctcgaagagcttttagtggtgttgaaggaggttatacaggaggaagcccgatcacagggttcaggtccattctgtggtcttctttgctccttagattcctcgccctaagtctgactgttacattagcatcatcagtgtgtgtcctctgtgaccacatagtagtcagtatgcatcctgagatcatcagtgctaggaaatacatgagttcacatggctggtccccagtaatactgaagaagaaagtctaggagtgagacccaactattctgggtttaacaagtccccaggtgagtctgatgcacaaagaaacgtgagctgctgtattagatggtgtcgagttcatgccaccgaatcactgacacacacatctgctcactgcttgctcttcgcacaggcccctggatcctcctggaatccctgatccctgttgctcccttgcggagttttctagtccctcttatttgaagcatgtctttcagagcctcgacagcca

SEQ ID NO: 676553 - DNA, 331 bp, Homo sapiens
aatcaccgaagaagacagatgagacacagaacatcactacagagcatcaacataaggtaggagcaacaatcgtggaacacaccctatgtccacaagctgggcaatgttgacaagttttcccactttgtactcatcacccttccctagtacaactcaaattacatcatcttactgaacactactgactttactgaatctcatacctagggttcgatgttaccttatcatacaaatcacagtagaaaaacagtaatgaagtataatcaatacagccaagatgctggcttctcacctgtgcatatagttaacacaacaggtaggcatgaagcta

SEQ ID NO: 676554 - DNA, 868 bp, Homo sapiens
  misc_feature (1)..(1): n is a, c, g, or t
  misc_feature (238)..(238): n is a, c, g, or t
ngatttgttttgcgctgcgtggttgtgccgtgcgtggggcgtggtgctgatgggtgttggtggcgccgtgcgtgtgtgattccagtgtgtgtggtgattgtgcggagaggttgtgcggtgtgctgctctttgtggttggtccgcttgtgtgtttgtgttgtgccgtgcggccggaaggtggtgtggtgtggcccgccattcttcgcggtacgccgttccgggggacccgttgcccccncccggcggtttcccctccccccggttttgtttttcaccccccatagggggttttttccccttctgtgatggcccgggccccagaatttttttggcgggacccgcccccccaaacttttcggtgttggcgggcacaccttataccaaggtttccctgtgccgggtccccgagcaaattctccccgggagtttcgccccattatctgcgctgggggcgctccctcttcagtggcctagtaatataattgcctggttcgaactttgttccctcgctatggggaattattgtattaggtcgcgtccacctcggtatacgcccctattattccagaatgagaataatattctctcgttccaaacaaaagcttctctgtcaaacccctgacctcacccactcccctttttcaaccaaaaattggcctccacgatcgcaccaaaatgtttgttgccccaccgaagcagtacacccaccggtgggccaacagcatcacgtatttattccatactcacgcccataaaataagggcggctattatagtacatgtccaacacaatataactcttactctcccagttaatgtttcccccccaataatatttatcccccgcacgcattccccaaacaataaca

SEQ ID NO: 676555 - DNA, 596 bp, Homo sapiens
  misc_feature (77)..(77): n is a, c, g, or t
  misc_feature (186)..(186): n is a, c, g, or t
ccccagcagccccttcagccccgcatgtttcggctggccaatgcctattccacgctccagttggtccccacccctancaggcccaccattgatggagtcagattttggggacatcaggacagaacgtgagtgacattttccgatacagcagcatggaggatcacttggagatcctggagtggaccntgcgggtccgtcacatcagccccacagcccctgacactttaggttgttaccccttttacaaaactgacccgttcatcttcccagagtgcccgcatgtttacttttgtggcaacacccccagctttggctccaaaatcatccgaggtcctgaggaccagacagtgctgttggtgactgtccctgacttcagtgccccgcagaccgcctgccttgttaacctgggcaagctggccttgcaagcccttaagtttttggggtttggggcaaaggacgatgacctgggaggcctggggctgggcccctgactcaaaaaagtggtgtttgaccaaagaaggcccaagatggaggcttgttcatatccctgcaagtgtcggcacttgtaaataaagcctgagcacttgctgatgcga

SEQ ID NO: 676556 - DNA, 132 bp, Homo sapiens
tgtaccagtatcacgcgcccgctacacgagccccaccaccacgaagctcacacacagaacagcacccgctacacggccccaccaccacgaagctcagacacacaatagcacccgctacacggccccacaaag

SEQ ID NO: 676557 - DNA, 165 bp, Homo sapiens
gtatcggtctaactcttctgtgattggctgactggacagagtcttcctctagtgctaaagattctagaggctacatttcttccagaatctgcagctgtggacctacaccaagccgagtacagagaccggctccacagtcttgccagaccacaatggcccgtgcat

SEQ ID NO: 676558 - DNA, 110 bp, Homo sapiens
aaggggccaccgacgctgtttttaaactattttggaagttataaaagggtagaccatctgactgatgatgttcacataaggggacagacagactatcatttgcagacatg

SEQ ID NO: 676559 - DNA, 276 bp, Homo sapiens
ggtagatagtgaatcatatagtgacaaagagtgtttcactgattataaggaatataccgggtaatcctgtcagttagatgactaagttttcccccaaattctaatcagagtatgtaaattgtaagttaacttatgcacgcttaactatcttaccaagctttgagtgcaagagattgaagagttcaaatctgaccaagatgttgatgttggataagagaattgtctgctccccacctctaagttgccagccctcctagagctacctgtggagcaacc

SEQ ID NO: 676560 - DNA, 218 bp, Homo sapiens
ttctttaggttcctgccatcgtgggaactccttcgctcgtagggaggcgagcataggatatattttaccacataggctggcctataaatctgggctgttgtataatgttatcgtattgttgtgctcgaactgttcatgtgcttcgtaatggccagttcgactgccgcaatccgcggcggcgctatcgaagggctaccgcgatgaaagacacaacgaga

SEQ ID NO: 676561 - DNA, 376 bp, Homo sapiens
ccaggatacctagagctgctctagacccactgatatgctgtctacctaccactgttacgcttacgctcgattccagacaaaacttttcataagcttcttctatctctgggtccatctcatcatcaatatcatccaagtatggatcaccagccccggtatcctctgttccattttcttcatacatctggcaacaacagtcctctctttcaagtaattcttggtcatttctcttggacctcttgcatcagctgccgtgaaaggaacacatcagcatgtctcacatgttggtccattccatacagtagttaggatcattttctggtgtagcttctctatatgttgaagttgcatggactctgccccagttactttgacg

SEQ ID NO: 676562 - DNA, 283 bp, Homo sapiens
cgtcgaccaaaacactcaatttgtaaatgactacccccaggaaggtgaaattttttggtgttgtgaaatctgtgaagtagctagagtattattcattttttaatacaaagacaaggaaaatgcttgcgcattttgacttgatttgggaagcagtactttaggaaccttcattctaactggcttagtgactcaacataaacaaacaagcaaacaaataaagccaccctcctcaaaagaactatcataaaagtgtatactcagaactaataaattttgtcgacgc

SEQ ID NO: 676563 - DNA, 339 bp, Homo sapiens
ggagattaattctattggcttttagtcacttggaactgattaattttgactttctgtccctaagcacttgggatttggccatctccattttgagccccaaacggttaacccgaatgtcccctagaactttggggtgtgtcccccttaaatcagtttaaattttccagacaaaagcaaatggcatttatggatttaagtcattagattttccactgccattaattaatccctcttgattgattaaatcatcaaggatttaaattttaaaaaggagggaggatttctgggttaaaacttttatttggcccccataattaaagtaaaatgttttttatgaga

SEQ ID NO: 676564 - DNA, 849 bp, Homo sapiens
gcacaggtccctgggggttagtatgtaggacttgtctgtgggggcacacacattcaagccattcagtccactattcctcctcaccccaagagtacgctggcgtcaggtgcagtggctcacacctgtaatcccagacacttgggagaccagggcaggagggatctctttgagcccaggagctgaagaccagcctgggcaatatagtgagaccccatctctacaaaagtaaaataaaaaattagccaggtgcggtgatgcatgcctgtagctcccagcatacttgggaggctgaggcaggagggatcacctgaggcctggaggtcgaggctgcagcgagccgagcaatcgcgccactacactccagcctggcatgacacgagtgagaccctttctcagaaacaaaagtaccctgggactcctgccaaaacccgcgggccatatcggcctatcctgctagctgagaggaacagtctacggaaccacccttttctacttgcgtctctcttccaggatctgcacaactgcaagcggagcagggggtggagtcccagctagcctgcagatctggccttccgactgtacactctctaaattcagaagcgagactgcccacgggtgactgcaaggcgcacactggagtgctgtctacctgagaccacgcatggtgggcattctcccacagaccgcgctatcagaggcttcctcacacatcagcgaagggaaacctgtgcacggccatctagatgccgacgcacggcaaccagtcaccctataagctggcggaaataacggccacgatcaacaacggacttgccacagatcccacgccggcaggctagcagcccagcg

SEQ ID NO: 676565 - DNA, 1426 bp, Homo sapiens
cccggcttcgctgtgctttccccgaggcgtctcgaagccgggggccaggaccggtcacagcgccccggtcttcgcgtgtgctttccccgaggcgtctcgagtcgccgtagctgctgcgctctttacccttgtttcttggtgtcgatttctgaggtggtgttgtgtctggtggtctgtatttacgccgcatgtggccttagggtgcccttcctgtcgccttctttcagcaaacgagtcattcatgtaaataatcagttcaagatcaaagttgaagtgctgtcactaatgagaacatacaaaagagacataatacacaagagaataaaataaaaaatcaaacaaaaaaacaccagaggggcggcgccgaggatttagacgcaagtaggcaccacctcggagggtgcgccccaccaagttgtctgcctacgagaaggctacaatcaatgggcccctaagtgataggagccctaaaaagggggtggtcgctacaacccctgggggagcgacagggcgatcaatgataacgtcaccagaggcagacgcagggacgcgccacaggaatgcttgatagagagaaacccaccgtaggccacacagggagggataccccttcgagcgcggtacatcaatgagggagagcagctcgatcgtgagagagccggggggagggaacccccccatgaacaacggctgggatgagcggggggcggacaggacaacacacatttacggccgggtagaccgggacgagttaggacacccacggtcaagagcggcagagaagcgcttatatttcagcctaacgacccctctggagagacaccggagagtacactcgatatcaactcaaccttttccacagaccaacaggattgcccaataaatagacacgacgcgcgtccgcataaagagccacccatcatgccttggggaacacacttaggggcgcgtctgagcaccccgtcagttcagacgcaatagcccatactcgtcgaagggccaccagagcgtgagacgccttcgataggcgcacttctctgcgaaacagaggacttattatccccaagaaaggacctcgtgagcagcggcacactgtatgaatttattccacatcagaaaccagtgtctcaacgtaaaaccactcggtcccctgcggtgaaacgcatcaccccatcgagccattggcggagaaatatttccacaacagggctatagaagagcacagcaaatcaccattggaacggagccttcatcgggaagttctcagcacgtttaccacaaacttgagcatccacaattatgcggctcggtagtccaagctatccacaacggacatatctagcgtggacacccaacgggtacagccgtggaaccaaatatgtcgatttatctccatacgcacgcttgagcgtgctagaggtaacga

SEQ ID NO: 676566 - DNA, 533 bp, Homo sapiens
gaggagtcccggggcagagagtgagacctgtgtcagaaaaaaggaagaatgctcaatcttctcccggagcacagcctttctcaagtaagctaaaaacaaacatcctctacatggtttggagtcaaatatgggcttatccttgacacctcactttctttcccatcccatagtcaatgggtctagaaataaaaataaaagtttccccagaattaaaaaaaaaaaaaatcccaaagtggggggggctggagggtatatgtaataagggagtcaaggtttcctcagtctacagcatcagcaccggggacgggcggatccccctcagggtcacaagggggcggccaccactcactcaggcaccttggtctcctcgggggagaaggaggagcggctcaccctcataagcccagagaaagcccggcctggcatctcgagcgcccacgggctaaggcccagtcaatcacggggcaaagggggagggaataacgcagcacggaataagctcatgggatctcaaggtggggcccagggcacga

SEQ ID NO: 676567 - DNA, 320 bp, Homo sapiens
  misc_feature (315)..(315): n is a, c, g, or t
taatctgttcagccattccatgtctttggatgggaaagtctagttaattaacattcaatgttattatggataagtaaggacttactcctaccatttggtaattggctttcgggtggtttgggggtcttcgcttcttttcttcattcctgtcttccttttagggaagataattttctcggggggtacgatttacttatttaagttttaaggggatgaataatagagagtgataaggtaatttaatttaatttagttattttaaattatttttaatccttttataaagacggggtctcactatgtggcccaagcggntcggg

SEQ ID NO: 676568 - DNA, 235 bp, Homo sapiens
ggaaacccatctgtaaattaaatggatgttggatggaaaatgacattgctaaatttgagaatttctttttacccactaaagtagattgctttgtataataaaacacagggtttggaaggttttgttacagggagcatggtctgttgaaaatttttaaaaaggatttttttaaattaacttctggacatgaaatgtctaataaaactataaaaggtttaaagatttttcccttgga

SEQ ID NO: 676569 - DNA, 254 bp, Homo sapiens
  misc_feature (44)..(44): n is a, c, g, or t
  misc_feature (243)..(244): n is a, c, g, or t
gcggccgcctactactactactactactgctcgaattcaagctnctaacgatgtacggggacatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctnnactacaaaaa

SEQ ID NO: 676570 - DNA, 137 bp, Homo sapiens
  misc_feature (88)..(88): n is a, c, g, or t
  misc_feature (131)..(131): n is a, c, g, or t
ttccacctctacttgtgaaagttctgcttcttactttagcgcctggggaagcgtcatgggggagacagctgtgtgtggagcacctggnggtgctggtgtggtgttcggtgctttgcagaggttgttgcatntagcca

SEQ ID NO: 676571 - DNA, 84 bp, Homo sapiens
cttttatatcactgtgtttgaatcgagggggaggggtggtaaccggaaataaagacctccgatcttcccccccaaaaaaaaaaa

SEQ ID NO: 676572 - DNA, 233 bp, Homo sapiens
gctttgagagacgagatgggaaacttgctgtacagaaagcctagtggaaactttagtgctagatacaaaattcacacagtgtaaattgcactggactctgggtgagactgggaagtgtcctcagaccattcagcaccatgcgtgacgagctcttcatatgtttgatacaaccatatgcttgtcctacatgcccatgccaccatgcatctctgtctcgttctctctgtaggtgt

SEQ ID NO: 676573 - DNA, 548 bp, Homo sapiens
  misc_feature (222)..(222): n is a, c, g, or t
  misc_feature (251)..(251): n is a, c, g, or t
  misc_feature (271)..(271): n is a, c, g, or t
  misc_feature (279)..(279): n is a, c, g, or t
  misc_feature (281)..(281): n is a, c, g, or t
  misc_feature (288)..(288): n is a, c, g, or t
  misc_feature (291)..(291): n is a, c, g, or t
  misc_feature (297)..(297): n is a, c, g, or t
  misc_feature (321)..(321): n is a, c, g, or t
  misc_feature (329)..(329): n is a, c, g, or t
  misc_feature (336)..(337): n is a, c, g, or t
  misc_feature (346)..(346): n is a, c, g, or t
  misc_feature (349)..(349): n is a, c, g, or t
  misc_feature (354)..(356): n is a, c, g, or t
  misc_feature (361)..(361): n is a, c, g, or t
  misc_feature (363)..(363): n is a, c, g, or t
  misc_feature (365)..(366): n is a, c, g, or t
  misc_feature (370)..(370): n is a, c, g, or t
  misc_feature (372)..(373): n is a, c, g, or t
  misc_feature (379)..(380): n is a, c, g, or t
  misc_feature (382)..(382): n is a, c, g, or t
  misc_feature (386)..(386): n is a, c, g, or t
  misc_feature (395)..(396): n is a, c, g, or t
  misc_feature (399)..(399): n is a, c, g, or t
  misc_feature (402)..(402): n is a, c, g, or t
  misc_feature (406)..(406): n is a, c, g, or t
  misc_feature (410)..(410): n is a, c, g, or t
  misc_feature (415)..(415): n is a, c, g, or t
  misc_feature (418)..(418): n is a, c, g, or t
  misc_feature (423)..(423): n is a, c, g, or t
  misc_feature (436)..(436): n is a, c, g, or t
  misc_feature (443)..(443): n is a, c, g, or t
  misc_feature (446)..(446): n is a, c, g, or t
  misc_feature (452)..(452): n is a, c, g, or t
  misc_feature (454)..(454): n is a, c, g, or t
  misc_feature (457)..(458): n is a, c, g, or t
  misc_feature (460)..(463): n is a, c, g, or t
  misc_feature (471)..(471): n is a, c, g, or t
  misc_feature (485)..(485): n is a, c, g, or t
  misc_feature (524)..(524): n is a, c, g, or t
ttcgcctggacaagctcatgtttgcaggagcaccatgtcttgctcgtctcgcgcctcctcctccagggctggaggcagcagctcagccagggtgtctgctggtggaagcagcttcagcagtggaagcagatgtggtctggggggcagctcggcccagggcttccgaggaggagccagcagctgcagcctgagtggggggtctagcggtgcttttgggggcanctttggagggggctttggtagctgctcantagggggtagtatattttgngagcttcngngctgctnttnacattnatttttttttttttgctagctttngcgttttncatgctnnatttggcanggnttgcnnnattcngngnnaatncnngattcnncnatgnagctactgnntgnttntacngctnttgtngtngtatnggaggtggtgttngcgatgnggngctttncnctnnannnnaaaagcanagcatgcagaagcncaatgagcgctttggcaattagctagacaatgtcagagngctttatgatgctaacactgatct

SEQ ID NO: 676574 - DNA, 119 bp, Homo sapiens
attcccatttaactcctacacataactacatagaatctcttgtaatcccctgtgggaaataaaaaaactgctatattagaactagcagagccccagacgaacagtacacttaagagaga

SEQ ID NO: 676575 - DNA, 280 bp, Homo sapiens
gtgcgtggcgacggcgcagagagactcttctctacaaaaaatttaaaaattagtcaggtgaggtggtgggcctgggtgacaaaaattacaaaaaaaaaaaaaaaattttaattcaccaaaaaaaccaaaattattccataaaaaagtgtccaagggccttggtctttcctcaaaaaccttaaaaccacccaaaaaccttgaacaaatgatataaaaagggagaaaaaaaaggacaaccagcaccaaactccacaccaataaatgggcaatgcgccgtcgc

SEQ ID NO: 676576 - DNA, 377 bp, Homo sapiens
ttctttcatgcacatctagtaaggaacgctggtgtaacccaagtctaagcctagagagccgtccggagctggcctctgcatgcatgcactgaatactaaaagtgacatgctttacttcataaaggaatgttgtagctttaggttctgtgggggagggaaaaggattaaactagggacaagcttgattctgtaggaaacacaaaacatacgtatttacctccgaacgcagcacagcccctacatctctggatgcagaaactatgtctgccggaagctggtgataacccctatctggaacggcccttttaaagtctgtaactctctaggagcttgtacactcctggtagttggactgtccaccatttggagttagttag

SEQ ID NO: 676577 - DNA, 347 bp, Homo sapiens
  misc_feature (61)..(61): n is a, c, g, or t
  misc_feature (154)..(154): n is a, c, g, or t
cagaggtggtgtctcccatcagtcagggatcgtgagcggatgagctgtgtcggatgtcgtngcgcggtgccatccttaatgtgactcagctggtacagaagcgcacagccgatcattgtgactcatacttaatctgttggctggggctcattgngcctgagtcaaccagcgtctccgcacagaactcagacacaccgctgctcccccctgcagtgccctgacccttgctgccctgcctgtcacgtggccctgcctatccgccccttagtgctttttgttttctaacctcatggggtggtggaggcagccttcagtgagcatggaggggcagggccatccccctggct

SEQ ID NO: 676578 - DNA, 156 bp, Homo sapiens
tcatgtgatgctctttgatacctggaagcaacgttagactgtcggaggaaatggattgttcatggtcttactcataactgggtggtttgagtggtgactgaatgtctgtgcttttccgtgtgtgtgctgccacgcacagggcttgtaaattgcaga

SEQ ID NO: 676579 - DNA, 414 bp, Homo sapiens
  misc_feature (17)..(17): n is a, c, g, or t
  misc_feature (27)..(27): n is a, c, g, or t
  misc_feature (45)..(45): n is a, c, g, or t
  misc_feature (87)..(87): n is a, c, g, or t
  misc_feature (214)..(216): n is a, c, g, or t
tgagtatgattttattncccccatgcngccagacactctggcagnttcaggatagcacgccgaagcatctttagaaatgttaattcnggaggccgggtgcggtgctcacgcctgtaatcccgcactttgggaggccgaggtgggcggatcacaggtcagagttcgagaccagcctgaccgacatggtgaaatacaaaaattactaatatacaannntaatatataaattataaatatataagaatactaaaaatataaaaaattagccaggcatggtggtgggggcctgtagtcccagctactcaagaggctgaggcaggagaatggtgtgaacccgggaggcggagcttgcagtgagccgagactgcaccactgcactccagcctggatgacagagtgacactcattccgtct

SEQ ID NO: 676580 - DNA, 465 bp, Homo sapiens
aggtgtgtcagcccactgagtctctgggaacaagcccaagcaaggtgcccgtgcttggtttaccttcctctcaggctttagtcctgtccccagaaatcaggaaggccccacttcagcaagctctcctttccaaccttgcagcagcagcagtagcagccagaagcagaagcatcagagctttatcctttggaagcgtggcacgattccgctgtcctctggcctcgcggctatctgcccccgtcggctctccttgaggccctcctcggccagcatggtgacagacatatttcatgtatagattcctgtagttggacagcgctgctggcagtggctcatctttgctgtctcctcgcgtcgtgtacgaacaagacccatcatcagctttgcagtaaaagccagtcctgggataccagctgaactcccagtccgcatagaggagagtgctaagttcactgaacacatcct

SEQ ID NO: 676581 - DNA, 453 bp, Homo sapiens
actcaaggccttgggaaagagggtggaggtggctggggtagggggcgttctgacgtgctcgtggtcttccatagatcatgagcgctctcccaccagaaaaccccacaaggctcacatcatgggtgacccctgggatctggccagagggtccctgagtctccagagaagaccaagaatgggaaaggttaccatggcaacagaaactgagcccaaagccctagaagatgaatacagcgtaaaggccaggcgtggtggctcacacctgtaatcccagcactttagggggctgaagcgggcagatcacctgaggtcaggagttcgaggccagccttgccaacacggtgaaaccctgtctgtactaaaaatacaaaaattagccaggcgtggtggtacgtgcctgtaatcccagctactcaggaggctgaggcaggagaatcacttgaacccaggagg

SEQ ID NO: 676582 - DNA, 395 bp, Homo sapiens
  misc_feature (34)..(34): n is a, c, g, or t
  misc_feature (43)..(43): n is a, c, g, or t
aaggaagctcgaagccctttaaccagaataaaanccgttagtngacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaata

SEQ ID NO: 676583 - DNA, 408 bp, Homo sapiens
  misc_feature (5)..(5): n is a, c, g, or t
gaagnaagacgacagaagggggtgctcaggtgtacaaaacattcacacagttttaaacaatgaacactgatggctcctgtattgcagtaggagttcagtggcatataaccatttctagaatgtgtccattgtgctaatcaatgtccacctgtagcatgaaaccctggctctgaattatgcagataacctcatagaaattgtaataaggcgcctacagctatgtttttttttccattttggatatgaagaaactgaggccttgtgggcacatactaggcttatctaagggcactcagaaaactagccacagaagcagtataaggactccaggccctctgattcccaggccctgccctctagaggaagggaagaagttgtgtgtgcctggttaatggtcattgacccctt

SEQ ID NO: 676584 - DNA, 105 bp, Homo sapiens
actcaatgctcgaagtcacgccgcatatacgccggacggaacatcatcctcgaggtgacatcaacaaggacagccggtgcgagaccacgcctgcggctatcggat

SEQ ID NO: 676585 - DNA, 713 bp, Homo sapiens
  misc_feature (22)..(22): n is a, c, g, or t
  misc_feature (65)..(65): n is a, c, g, or t
  misc_feature (76)..(76): n is a, c, g, or t
  misc_feature (95)..(95): n is a, c, g, or t
  misc_feature (99)..(99): n is a, c, g, or t
  misc_feature (103)..(103): n is a, c, g, or t
  misc_feature (112)..(112): n is a, c, g, or t
  misc_feature (117)..(118): n is a, c, g, or t
  misc_feature (121)..(122): n is a, c, g, or t
  misc_feature (125)..(125): n is a, c, g, or t
  misc_feature (128)..(128): n is a, c, g, or t
  misc_feature (130)..(130): n is a, c, g, or t
  misc_feature (134)..(134): n is a, c, g, or t
  misc_feature (136)..(136): n is a, c, g, or t
  misc_feature (153)..(153): n is a, c, g, or t
  misc_feature (167)..(168): n is a, c, g, or t
  misc_feature (173)..(173): n is a, c, g, or t
  misc_feature (177)..(177): n is a, c, g, or t
  misc_feature (182)..(182): n is a, c, g, or t
  misc_feature (204)..(204): n is a, c, g, or t
  misc_feature (212)..(212): n is a, c, g, or t
  misc_feature (292)..(292): n is a, c, g, or t
  misc_feature (480)..(480): n is a, c, g, or t
  misc_feature (517)..(517): n is a, c, g, or t
  misc_feature (530)..(530): n is a, c, g, or t
  misc_feature (565)..(565): n is a, c, g, or t
  misc_feature (572)..(572): n is a, c, g, or t
gaggacctcaccgacctccacntcaccatcgagggccctgagggaccccatatgctggaggtctnttccgcatganactcctctggggaggactncccngccnccccacccnagggnnacnnccngancnagancntccacccgaacgtgggngccaatggcgaganntgcgncaangtgcncaagagggactggacggctganctgggcanccgacacgtactgctgaccatcaagtgcccgcctgatcccaccctaaccccgagtctgcactcaacgaggaggcgggccncctgctcttggagaactacgaggagtatgcagctcgggcccgtctgctcacagagatccacgggggcgccggcgggcccaacggcagggccgaaaaccggtcgggccctggccagtggcactgaagcttcctccaccgaccctggggccccagggggcccgggaggggctgagggtcccatggccaanaagcatgctggcgagcccgataaaaagctggcggccnaaaaaaaaacggncaaaaagcgggcgctgcggcggctgtagtgggctntcttccnccttccacccgtgaccccaacctttcctgtcccccccccccaactctgtttttaagttatttaaattatggctggggtcggggagggtacagggggccctgggacctggatttgtttttttaaataaagttggaaaaccca

SEQ ID NO: 676586 - DNA, 155 bp, Homo sapiens
gtgccactcagtgactgtcacagggctcagtgctgtcagagagggactatgagagcctcgtcatgatgcgcatgcgcatgtgggctgagcggcaacagctgatcgcacggctgcagcaggcagaccatgaggggccgactacgtagccccagctc

SEQ ID NO: 676587 - DNA, 363 bp, Homo sapiens
tttcaaccagcaaagccttgggcccccccggggccttcaatgggaactgtgaaacaaaactctccgtggtccctaaagggttgggcctggaggggagccaagaacagcccccggggcccgacccgttggtagggcctttccccccaaaggaacccccgcctccaccggtccctgggcctcctgtttcccccccggcaccccggccggccactcccagtttgcccccccccccccagccccaacctttcctgtcccccccccccaactctgtttttaagttatttaaattatggctggggtcggggagggtacagggggccctgggacctggatttgtttttttaaataaagttggaaaaccca

SEQ ID NO: 676588 - DNA, 449 bp, Homo sapiens
agtagaactcgagcgttgtacccattcgcgaaatcacgtcctggggaagcccgagagtgatgagatgaatgtgaaggtgctggactttgagcacttactgccctatgctgcagagcgtggccaatgaacagggaccaggctacctattaggatcatgtcgaaggacttcgggtgttttgacaaggaaggaaatggcaccgatcatgggtgcagaaatccggcatgttcttttcacactgggtgaaaagattacagatgatgaagtagagatgctggtggcagggcatgaggacagcgatggttgtatcaactataagagcgttagtgaggcatatcctgtcgtggtgacggtgccctctggggcggacctcgtccgcatggtgctgaatggctgaggaccttcccagtctccctcgtagtccgtgcctttcccttgttgaaatcgtgat

SEQ ID NO: 676589 - DNA, 236 bp, Homo sapiens
aagggtcatggaaaagggtgcaatagaagagtaatcatcaggataaaagttgttggtggctgttgagctctcatgaagttgggctcagagaggttgagcgacttgctcgaggtcacacagcaagtatatgctggaggaaccgggatttgaagccgattctgcgtgaggccactttgatgtgttctgactgatgaacaaagctgccagtgtgggcagctggaggggtaccgagctcg

SEQ ID NO: 676590 - DNA, 900 bp, Homo sapiens
gggcgctcgcaccgccccgctctccagccaaggctccgtggctgaggcatttgcttggctgcagcctccttccgacctgcctggcgggacccagggaccaagccgagccgagccgcggggcccgctccggcccggccatgagcgcggccgcatgatgcgtccctgcctcggccgctgcagatcgccgccgccgccgccgcaggccgcggaggagccgcaagcgccgggcgaaccccgcccgggcctcggatccgatcaacataggacagtatgcaccttaagatcctgaagaaacgggcacaaaatgttcaagtgatgtcttagaacataccttgttgagggtgcgtcacgggcaaatcattgcagccatcaggacacaggctccgggacgtcgagcatcatcctctcctggctggaaacacttgaccaactattgaactcttcatcgtcctccttcctccgcaggctgacgttggttgacccgggttctgggtccatccgtgcacggcttgccggcattgatctgttgctgtcattgacgtggcttctggtcgcccttatgccgaacttccgtgggtgacctctccgtacattgctgcttggacatttcccaaaagaactttcctggatacctccttgatgagtccaaacaggaggttcaattctttataacctggcttagcgccgttgctttgccccctaggtacataccccacttgagaacaccatgctacacccgacccctgggggcaaagaccccaaaaagggcaacgctacgaaacgcattccattggcacaggcttgccagctgaacgcccggggacaagtcatataaaaaagtgccccaaggtgctggcggctattacaacccaaccgcggcccaccaatgcagtattggca

SEQ ID NO: 676591 - DNA, 932 bp, Homo sapiens
taatggacgcttcctaactttctataaaatcgcccaccaagcctctcttgttgttattacacaacactcctcatgtggtacctctctccttcgaaaaaatagttataccctggcgcggctctctaaacacccctgcttataaaggttcctcgtgtctaataaaacgcactcctctcctctctttctgttgttgtaaccaaccaccctctcacttgcttctgctcacctcccgcggggtgtttttccctccccacgcacagatatctgtcgtttttatataagggcggagacaaaataataatggtggttgccccccctcattaaagaggtttcctttcacaccccccccgtcttgttttttctacacaaaaagagggtgggcctttctttatcgcaacgaaatatttttctctccctccgcgctcatatgcttgccccacaaacaaatttgtgtattaagaacataatgttgcgccccacacgggaattgtgttctccccctaaaattgatttcttgcgccccccaccaagtctggtgtgggaaaatttgttgcttcttctgctcctctcctccctttaatggttgttcccctccgtacaacaccctcttcgcgggctatatctaatatttgggcccgcatacaatctctctctctgtgaacaagcatcagcgcctccacagaagttttggcgctaacacaccttcgtgttttctcgaagacgctgttttttgccccacacccgctgttctatcaaacccctctctgctggcgcccgctttttccccacaaggatgtgctcactatggttatcacaactctgtgcctgtatacaaccaccgagcccaaaaaatgttctcctgtaaaaaaaactcgggcccccaatccccatatatttgcgcacccctccttcctgcggccccataacccggc

SEQ ID NO: 676592 - DNA, 106 bp, Homo sapiens
tgaggtacctagaggttcccacacaatcacctgacaaattacctgcgtctatatcaccacgtattagaagtatatgttttagcatgtccagttacggtacaactaa

SEQ ID NO: 676593 - DNA, 246 bp, Homo sapiens
  misc_feature (7)..(7): n is a, c, g, or t
  misc_feature (35)..(35): n is a, c, g, or t
  misc_feature (45)..(45): n is a, c, g, or t
  misc_feature (83)..(83): n is a, c, g, or t
  misc_feature (93)..(93): n is a, c, g, or t
  misc_feature (96)..(96): n is a, c, g, or t
  misc_feature (113)..(113): n is a, c, g, or t
  misc_feature (134)..(134): n is a, c, g, or t
  misc_feature (142)..(142): n is a, c, g, or t
  misc_feature (154)..(154): n is a, c, g, or t
  misc_feature (189)..(189): n is a, c, g, or t
  misc_feature (202)..(202): n is a, c, g, or t
  misc_feature (207)..(207): n is a, c, g, or t
  misc_feature (209)..(209): n is a, c, g, or t
  misc_feature (211)..(211): n is a, c, g, or t
  misc_feature (225)..(225): n is a, c, g, or t
tttaagnctgatatatggaatgtttggtgaacctncctatcaacnctgagactggaaacccaaagtacagcccaaatacattntgttcaatcnccntcaagagccatttttcnttttgggtgggaggtgggcanatgggttnagggtgggaagnaaatactattatgcagggtgttttgggaggggggngggtaacataaanagcantntncaggcaagttttgntattaaaattgtgtatactgt

SEQ ID NO: 676594 - DNA, 354 bp, Homo sapiens
atctcgctccatggtcggctacaatcagccacatcgcctcgtagtaacagccattctcatccaaccacccctgacgcttcaccggcgctgtccttctcataatcgcccacgggctacacatcctcattactattcatgctagcaaactccccctcacgacctgcactcaccagtcgcatcatactcctctctcacggccttcaaactctactcccactactagctttttgatgccttctagcacgcctcgctcaccctcgccttacccccccatattaacctacggggacaactctctgtgctagtaaccacgtggctcctgatcacctatcactctcctacttagcggactca

SEQ ID NO: 676595 - DNA, 858 bp, Homo sapiens
gggacagaggcccaactccagtgacgccccagctggcccagacccctcctctttccctcagaggctgcagtgaggtcagggaaaggcagtcctggtagaggcctgtcctggtgactccagtgttggcccctgagtggtgtgccctcctcatgccggcttcaagactgagggacagggcagccagttcatgcctcgggatccacctgtggctccatgtcccagacgcaccctgtgctggagagctgtgcctcctgtgcatctgcctggctgctcctgcacccctggggtcccaggaatgggcggcccagccccagtggacaggaaagctaaggcctcagcgatgccggactccccagcggaggtgaagacggcagaagcgggaaacagcagaaagaagaggagaaagagagaaggaagagaagaggaagaaggaaagaagagaagaaaggaggagaagaaggagagaagaatgagcagaaaggaaaggagggaaggagagaagaaggaaaagagaaagaggagaaggggggaggagggagggaggaggagaagaaggaggagagaagaagggaaggggaagaggagaggggaggggacagaaagagggagagacaggagcgaggagaggaacgacgaagagaaaggagagcaaggaaaagagaggagaaaagagaaacggaagaagagaaagagaagaagagaggagaggagggaagaagggagagggcaaaagagagaagagaaggagacagggaggaagagggaggaggagaggaggaggaaggaagaggagaggagagaagagagagagggggagagagagaagagagggagagagagaagaggggaggagatagc

SEQ ID NO: 676596 - DNA, 586 bp, Homo sapiens
  misc_feature (495)..(495): n is a, c, g, or t
attaggagtatttttttattttgttttctccctaccattctgtttaattactgctttcttagaattttcttttacccttcaaaagagactactttaatgtaattattctatttgttgaatgttctacattagttgaacaaatattctattgttgataaacaattgtttatcaattcaaggaagaaaagagacctttttcatactgagattaaatatacttgttttttacatcgaactttcctttttttttttttttgtgacagagtttctcttttgtcgcccaggctggagtgcagtggcacaatctcatctcactgcaacctctgcctcccgggttcaattgattctcctgcttcagcctccggagtagctgggattacaggcatgcgccaccacgcccacctaattttgtattttcagtagagacagggtttctccatgttggtcaggctggtctcgaactcccgacctcagtgatctgcacgcctcagcctnccaaagtgctgggatttacagcgtgagccaccggacccagcccacgcatttttacataaaaagagatccttagtccacccaaagctgatgt

SEQ ID NO: 676597 - DNA, 1089 bp, Homo sapiens
aacgccatctctgctgttttacaaaaatagccacacgtggtggtgcacacctgtagtcccagctactcgggaggctgaggcaggagaattgcttgaatccgagaggcggaggttgcagtgagccaagatcgcaccacgcactccagcactgggcaatagagggagactgtctcaaaaaaaaaagaaaacaagaatagagtgagtcatgatggatttagcatggcccatggcctgtggaaaatataatggttcaacctgggcattaagggtttaaaacttccacccaggcgcagtggttcaggccagtaatacccagcacttagggaggccaaggcgggcggatcacgaagtcagcagatcgagaccatccagtggccaacatggtgaaaccacgactactactaaaacaaaaacaaaaaaatatacccggagactctgccaggacgagacagaccggaaatccaaccaaagcacacatgagacagcgatagaccagggcaccagacacaaagggcagaaacacccaccgtagggacacacgccacgcgactacgacgcaagaagaattgggccccaaagcgcacacacacacgacatggaggcaacacagacgatgtagacaccacacatacacataccaacaaacacaccaacataaccataaaacgaaacatacaacacccctaagcggacaagcagccaccgggagtcggagaacacgaagacacagagctacaaacagaacgaaacagaaaagagcaacgagcagagaggaacaacccaacacacaaccacgatgcacacagtgagacccaacagcggcgagtgccccacagacagacgaagaacccgagagtcacataaacaaaggcaagaagagcggaaagacacacctccacctcatcaaaaacactcagctcgctcggtcgcggacaatagacggggccgtaccacaacaacaaacaaccaagcatggaaaccgaaatgagaagaacaaccataaagcggcagtcatgactaaccaagacgagcgcaacaacaagcggatccaggaacacacctaaagaaaaagccccgcccacaaagcgg

SEQ ID NO: 676598 - DNA, 405 bp, Homo sapiens
  misc_feature (39)..(39): n is a, c, g, or t
ccgtgcccccaagtgggatttcccccccccggtatgcanggtcaattccctacatttgaaaatcaattaaatcccattaatgcaattcaccccacatcagtaggctaaagaagagaaatcacatgatccccttcaatagaggccaaaaaagcatttaataccccattcatgatttaaaaaaaaaaaaaaaaaaaaagccttccagcaaactaggaatagaggggaacttcctcaacttcagaaagaacatctacaaaaaacctgccactaatatcatacctaatggtgaaaaacttgaagcattcctactaagatcagggataaggcaaggatgtctcctcactactccttttcagcattgtactggaagtcctagctaatgtgacaaaaaaagaaaacagaaaa

SEQ ID NO: 676599 - DNA, 222 bp, Homo sapiens
gggagaattggatggagagggctcttctggaacagtgggtatccttccttaggggcaaagatgaaatggagctagctgaactagacagagctcggggaatggacaaactggttcggggggggggataagatgtataatcagagagattccaccacaacaggcaaggccactttggatcatggaagaaagacccaaccttaattcccagccttactcttctcc

SEQ ID NO: 676600 - DNA, 1208 bp, Homo sapiens
tggaaccacacaatttattaacaacgcactgacatgggggccctcgttacactaaccagcccccaccccagcaactgggtgcacatttctcctttaagcgcaggaacttggcgccctcaagggataatatttcaggagaacataaactaaacaaagaggcccggagcaccgcggcggcctcaccacccgtgcaactcccacgacacctatggcgagagggccgacgcggtgcgcgcggcactcacagacggcctcacgagagcctccggagaccactacgcccgtggcccaacacataggcgcaatcaccggcctcataccacaccacctcacacagaaacaactcacccgggcgcgcgctcgcaccggccgggcgcccgtgctaactcccgagcccacatcccgcgcgaactttgcacgctaagaggaccagcccatcccaccacagtgctccgcggcccacggccgcgcgccccctcgccccctccccgcaccctccagcgtgtgacctccacccgtgacctcggccttcccccaaccgcggcccgggcgactccatagcgccgcagaccccacccaagcacgccacaaacccttcactaccccacttccccctgcggctgaccaccgccaagagatcacaccccacaggcccctggagaaacaccacgcgacaccactcgcacaccgaccacacacacggagcccaacacccatcatccaccctagccctctccctgcattcgcgctcccctccatgccagctttcaccccccctcttgtcttcgcgccccaattaactaaatcaacacgtgcgcccgctaaccgtcgtcctccctcccatttctgcatccactgtggctctcctcaccgcatgtactaagcatttggctctctccgcgcttctcccgaccgcgaccacagcaccagcggaaaacgacaccccgcggaccacacgcgcgccccaccgcctcgtgaaccacacggcactgccgcaccatcttcggatatcccacccttcctatccccctgcggtactcttcccctcccgcgctccctctctcctgtatcgggggctctctacacgcctctacgcgccatctcttctacgcgccctgcccccgcagcctctccccttccccagccatcgcccggcagcaccctctacccatacgttgttcctctctgctgggcctctaatatagcct

SEQ ID NO: 676601 - DNA, 120 bp, Homo sapiens
tacgaggatgagcatattttctgggctgcgctcttcgttgcccagtttccgctcattggtcgcgtctcctccccccacccaccattcccgctgcattctcggccgggctctaggcgccat

SEQ ID NO: 676602 - DNA, 898 bp, Homo sapiens
ggctgagctgggcggagcagtgaaaatccggcgcgcgcagtctccagcccaatttctacgcgcaccggaagacggaggtcctctttccttgctaacgcagccatggctcgtgggtcccaagaagcatctgaagcgggtggcagctccaaagcatggatgctgaataaatggaccggtgtgttgctcctcgtccatccaccgtccccacaaagttgagagagtgtctccccctcaatcattttcctgaggaaacagacttaagtatgccctgaacaggagatgaagtaaagaagatttgcatgcaggggtttcattaaactcgatggcaaggtccgaagtgatataacctaccctggtgatcaagtgcggtgtcactcagcattgacaagacgggagagaacttcccgtctgatctatgacaccaagggtcgctttgtgtacatcgtatttacaacctggaggaggccaatgtacccagtgtgtgcacggtgcgaacgatcttgtggtgggcacaaaaggaatccctcatctggtgactcatggatgccctgcaaccatgcggttaacccgatcccctcatcaggtggaatgataccattccagattgttaggagactggcagatactgatttcatcaagttcgaccactggtaacccggtgtatggtactggggtgtacccttaggacgaatggggtgatcaccaaacagagaaggtcccggttttttggcgtggtacgtgaacttcatggcacctttggccccgccttccacactttgtttggcggggcacaccggtttctcccgggaaggtcgtcctttggagggaaatatggccacagtggaatgctccaatcttgctcaatgtgggtgcagcaaaaaatcgcgcggatggcggt

SEQ ID NO: 676603 - DNA, 869 bp, Homo sapiens
gcggattcgatgcgtgcgtgggtcagtgtaccgaggtacattgccgggcggtatcggagagggggaaccaatgtcacatgtggctgttggtccgtggcaaagaattgccactgcagtgttccggagacctgcgatgtggggggcaagctcgtcaacctgggactctcagcagggcacactacggggacgtccttgacacaacggcagcatatcggcagagacggaacatgaagccgtcttaacctacaacaggtgtccagggcacgtgtcggcctccgttgacctactgggacgaacgcttctatccaagcaggcgacggacacaggacaacgactctacgacgcgtggtactggacacctaacctggcaacctggatgcggggctgactaccactacgactactactcaacgtccccacgggcacccacggatgcctggctgaaccaatgggagccggtcgggccacacactcacgcgaaacccctggacgctgccgccccacggcggacactggaactgctagggagcccttacctccggcgactacctacgggtggacacagagtcgaaaaaccttcacacaagcacgggcatcgacaccactaccaaagcccaaaaccatggacacgccacactgaacacaactggcgccacacacggaaaaggggcacacacacggaactgaaccgccataccacaagacaccccaataggaacccatggacgaagcacccaaagagcaccgacaaacccctcgaccaagaccactccgcagccccacggagaggggctggacaggaccaacagggagacaaaccccagcgcaactggccaacgaaaccaggacacgagcattgaccggcaaga

SEQ ID NO: 676604 - DNA, 157 bp, Homo sapiens
cacgatcttgccattctgcttgcccggcctctgcgttctgcattacgcctgatttttggaagtgatgtggttttgagtgttggcagcccagtgtcacaaaggaccatatcttagaaatgaccccagatgtcaagaatatgaacacgtggctgctgtt

SEQ ID NO: 676605 - DNA, 124 bp, Homo sapiens
ctgagatcgcacactgcaagccagcctgggcgacagagtgagactgcgacacacacacacacacacacacacacacacacacacacacccccaaagtatttcgaccacgtgcgcgcaaatatgg

SEQ ID NO: 676606 - DNA, 184 bp, Homo sapiens
aggtacagatgctcgaacttcgtaactcatggctcatatctgatttcctgaggagaatcgtgtttgtaacgagttacaggatagtttctttcctggattttaaactttagttaacattgtgaaattatggaggagttatatagaaaaaaaaagtgaacataaagtctgatgggagaagactgcg

SEQ ID NO: 676607 - DNA, 1723 bp, Homo sapiens
  misc_feature (385)..(385): n is a, c, g, or t
gcctcgaccagttcttctcttcccgtcctgagtgtggcggtcgggtctcgaccttgtcgacagctcctatatgcctctctgttcctcctatccgccttttcgcattcgacgcccatatgcagcgccatccctacgcgctcgataggtggtggtcaacgggagcgcccatgtctgccttttcctgtgtctcgggtcctgcagtccgtggccgtgccccggcgagtgtagatgatgggaggtaccgaccagttgaaatcggttgcatgaggcgaccgaggcgcgtggatcaggagacttggagtctcgtaggtcatgggtagtaacatggtcagagtgacattgggcagaggaaatgattccttcattattgagactcgaaagaccnctgtgtagcttatcgagaatggatgatgagtgtgccatctgactacaacagacaattaggagaggattaaaatgatcacaagagaggacttttataataattaccccaggagattcaaaacaggcgcgaaaggtccaactaggggggacgaagtgatatgagagctagggaatattggtaaagtaactattgtaatttactctcaaacgattttcacctataataggacataaaatggtggtacaaagacatagggtatcaaagaaatggctaggcgtagtgtaattaacagtggaggggtaagagcgttcggcctaaatacattgggagtatcttaacaaaggtggagactgaaaggggggaagacattagtgttactaactaccacgggggcttgggcaaccacacatccttcagcaacagaggggtttccccatagtcccgacgtaggaaaggccaaagaaaacggccccttgggaccattcataacgccgctttaaaatggggggactttcggtattggaacacacagacaggctacagccgttccacagagaaaaaatttcccccctataaaggatgggtaaattggttgggcccaagacgttatctgggaattgtaaaacaagaagggaagttccaaacgcaaagagcttttgttgggaacaggggccgactttgtgaatcaccgtaataggaaaaaagaaacccacacaaaattggtgcgaacagacatggtgtgtgtatttaagagaaccacaatttattggggaaattggaggggcgttcaaagagacacgacgttatgaacttgagaagaattgtataacagtgagtgatacaagtggccctacgtgtgttcgaccgtaagttattagaccggaaaactgtggacgtgtaacttaacattatgagaaattaacaaccagcgggtggattttattgaacaaccccatattagtaaatgaaagaactatcacagctattatacaaaggggtgaaacaaccattaggggaccagacgaaattgtggtgcgagaagaggccgcacatagcagtagaataccacagataaaagtagtatcgtggagcaaacatcggcacccaaggagagttatagcacacgaagtaaacagagagacacaaatgaggaggcgacccacaatgtcagctttaactactacgccgggagtagaaaccaaatgcgagcaagagggagacaaacagtagtgtgtaagcaacaacggtgacagcagacagcacgtcagcaaacaacagacgtgcatcgccatacaaaaacacaagcaaaaagcagaggagagagaaaggacacaaaaa

SEQ ID NO: 676608 - DNA, 123 bp, Homo sapiens
cacggtgtatcggcgacactttccagaggaaggtcacggtggtgataacggccacatctaagaaagctccaagaagacactctggcctataccacaactattcatgtgagaaatagcgacgtg

SEQ ID NO: 676609 - DNA, 315 bp, Homo sapiens
  misc_feature (1)..(1): n is a, c, g, or t
ntagcacaacctagggtcagttttgcaggtggtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 676610 - DNA, 626 bp, Homo sapiens
  misc_feature (539)..(539): n is a, c, g, or t
cactgctggtggaatgtaaggtggcacaaccactgtggagaacagtctggcgattcagaaattcaaacagtactactaccctaggatccagtgttccacctccgggtgtacacccgaagaagtgaaagctggaacgccaaaagattgcacgtccctgtccacgcagcactgtccacagcagcaaaaggtggaaacaacccacgtgtccttagatgagtagataaacaaaccaaggtgcgtctttcggtacaatggaatattactcagccttgtaaaggcaagtgacacatgctacaacatggaggaactttgaggacattattctaagtggtagaagccaatcacaaaaggacaaatgctgtatgactccatgaatcttgaggtgtgcctggcacagtcagattcataaagacaaagtagattagaggctgccaggaactggggggaaggaatgacttagtttctaatagggacagagtttctgcttagaatgcttaacaagttctggatatggtgcggatggttgcacattttatgtnatatatgttttatgacaattaagaaatgacctgtaagcctgccatctggataactccagtaaacacatcttaatttatgtgaaaaag

SEQ ID NO: 676611 - DNA, 960 bp, Homo sapiens
ccacctcggggcggcgttccggcgggcgggagccaggcgctgacgggcgcgggggggcggcgagcgctcctgcggtgcgatcaggctccggcgtctgcgcttccccatggggctggctgcgggcctgggcgctctgagatgtcactgctgttccaagggcacacgcagagggcttggacttcctggcgagttgcctttgtgagaagctggcactatttctttcaattccatctcttagttttccataggaacatcaagaaatcatgcacaactttggtcatgccgagttgactgccacttcctcgatgaaggttttactgccaaggacattctggaccagaaaatcacctgcagtctcttcttctgatgataacggatgccttctatgtggcagaccctgggagacccttctaccacgacccccctctgaggtggttaaaagctctccctcgtgtcacccccttttatgcagtcacatgtacctgatacgcacacgcctcgtgaagacccttgctgctaccgggaccaggctttgactgtgctagccagactgaacatacagttggtgccaggagtctggggggtgccttcccagcaggcaggcattcatcttactgcccacatcccttgctacgcaagtgtattcctcaaaattaagtatttgctggttacttcaatgcagttccacgcatgcgtgacccttttggacagtgaccgttgcgttgatgacagttggccagagccacatcccacggcacagctgggtgttgcggattgccacctgatgcttccaggccagccgcgtctcacgtgaatcgttggcccgtcagacccgcggctcttgggacgggcgacgcagcaatacgtgttgcgggcggacagtagcagcgcgtcgctccgcctgtgcgctctgcgggttagcagggcaaggcccatccgcagggctcgcatgtcgcccgc

SEQ ID NO: 676612 - DNA, 668 bp, Homo sapiens
ctggagactaactgtgagctactaacacgggtggaacgatagcttttgcaatactcggtttgcatgtgctgaaatgtcatctgtcttctgagtcaacactcccgaactggtaaacaacctgctcagggcatctggtgaacgaagctgtagacagctcgttctgcctgtgagcgatttgtcacctcattctgtaggactggtcaccagcagaaatgctgtctcaaaggatcccggggagaaagcgagggccgactctcacttcaatccacgcctatgaagatggcagttcataacctttattctgcttcagctggctctttaccatgcggttgaaagatcccaagacgacaaagaggggcggagacccgggtacaaagatcacagtctcgggtatctcatgactcccttagccctctcacctccgacggagtaccccaggagcccgatctcagactccagtcccttcagggaccagcagtcggacgggtccgccgagaccttggtcggtcccatcaggctctcaacagttgctgcctctacagtacagacagagcatggtccaaatgcgagggggccctattctggatgaggaacgaacgtgtgcaagcagctccccggagcatatatctgggtcccttattcggtcatcggcggtgtctgccagcagg

SEQ ID NO: 676613 - DNA, 134 bp, Homo sapiens
  misc_feature (121)..(121): n is a, c, g, or t
catctagctcgtcccgtcagcctctaacagtccaagtctgctcatgccatactcactgtggaccccccaagccaagctcccaagctttcagcagcttctacacacccagctcctgcacctncagtggcctcttt

SEQ ID NO: 676614 - DNA, 953 bp, Homo sapiens
gtgtctgtggtcggaggctgactcacgagttattgcatcgagcttttagtgtcttctgtattcaacaccgataaatagagctctctgctacagcaaaaatcatatgctaagattacctttccacggtatgtccaactgaatacgtgttgtagtcatccattaagcaattccatgccgacctctgaggtaacgtgactcccttgtgaagtgaggcgagcagtctacaagagactgggatgaatagactgatgcatacgtgaattgcccgttggagaggaggttccgtccagaagaaattaagtcatttaatcacgaattcgactaccaacagactcatgtctgatggtatctgggtgtgaactgtgaaagttgcatatacgttttggttggtgcaggaagagatgtacctttgaagtccagatcccatgtggatgattaggacgctatctgttatgtgtcagaggaagaaactataggatgttctgaaaagagcagtgcatgtggtgcaatttatatacacgcccatgcgttcaaacattattgcgaggcgactttgctctttaaagtggtggggataactttaaagttcctttgaaatcagtttgttgaccatgagtaaaatttccgaaaatgtgaatatgtaggctaaactggttcacgacaaattatgctgcgtcagcaaatcttgaaatgacttgtgcctttgaaaattaagtcctgatctaactagccattaaactaggctcatcgtgggcacatcactaaggtttatttaccctgtatattaaccgtgcttgacaactacgttttttggtaccccccggatgttatgggcacagctcgacaattattacgaagacaacacaatagtcggcaacttgccagcggggaagcgagggcacaaccaccgagatatggaacaaaaggataaaaaagcgctccacacgataagc

SEQ ID NO: 676615 - DNA, 157 bp, Homo sapiens
acaaagtcggttcctttgttttcatggaaatgtcagacaactatgaaaagctaaggaagcatgtcgcactgaaggtctggctctggtaaattaggcagagatgttctcagcagcaaaccaggtaaaactctgaccatcgtgaacgcattacttttaa

SEQ ID NO: 676616 - DNA, 809 bp, Homo sapiens
  misc_feature (327)..(327): n is a, c, g, or t
gctttagaagcctggcgtggcaatccctgacgcaccggcgtgatgcccagggaagacagggcgagctggaagtccaacctacttccttaagatcatccaactatggatgatgatccgaaatgtttcattcgtgggagcagacaatgtgggctccaagcagatgcggagatccgatgtccctgtcgcggggaaggctgtggtgctgatgggcaagaacaccatgatgcgcaaggccatcgcgagggcacctggaaaaccaacccagcgtctgggagaaacgtgctgccgtcagtatccgggggaatgtgggctttgtgttcaccgaanggaggaccctcagctgatatcagggacatgttgctggccaataatggtgctcagctgctgcccgtgctggtgccattgcacccatgtgaagtcactgtgctcagaccagaacagctggtctcgggcccgagaagactgcctttttccaggtctttaggtatcaggcactaaaatctccagggcaccatggaaatcctgagtgatgtgcagctgatcaagactggagacaaagtgggagccagcgaaggcacgctgatgaacatgctcaacatctcccccttctcctttgggctggtcatgcagcaggtgttcgacaatggagcatctacaacctgaagtgcttgatatcacagaggaaactctgcattctcgttcctggagggtgtccgaatgtttgcagtgtcttgtctgcagattggtacccaatgttgcatcagtaccccattctatcatcaacggtacaacgagtcctggctgttgga

SEQ ID NO: 676617 - DNA, 120 bp, Homo sapiens
aagaggtgatcattctctgaggggctgagatgtgctaccgcgattgctactaccgcattagcttggctctctgtctcacagggtatctctaagactaggggcttggtatgtatgtggtca

SEQ ID NO: 676618 - DNA, 189 bp, Homo sapiens
tgcaatgcgaggcatagttgtttgttctgaatcatctattgtgacaggttggtttatgagtgcgaataccgaggctcaagggagcggacgcggcctggaagcggcaaagtggctgatcgtcgccgttctgttggttgtgactattgtcggtctctattactaccgtgatttaagcctgccattgggtgt

SEQ ID NO: 676619 - DNA, 217 bp, Homo sapiens
ccgggttatatagagaaaacttctctgcgtactttcataaacaacaggtccctgtgtgactgtgtcaatatagtgttcttgttttgagatggagtctccctctgtcgcccagactacagtgaagtgacacaacctctactcacttcaacctccgcctcccaaggttcaatgcgcattctacccgcctcagcccttcccgaggtagccacagactaca

SEQ ID NO: 676620 - DNA, 367 bp, Homo sapiens
agaccatggtgagggcgaactcagccaggttggggtgatcttgtgaggttgggtgacctgatcatggggggatgtatctgtgctctgggcagcatctcccttgggatcctcagcagggagacagggaccaggcagcacagtgctgccagcaggaggatgcccacgagacagaagacggcattgtcctttcctgctctcctcaagctctactcaagctctgtctcttctggcaggcacaggagagtggcctgaaggctggcaggaggttgccgcccctccaacctgtaattcctggcagcagcagcagctaggccttcctcggaggcccgaccccctcctccttcttgggtcagcctgggtctccata

SEQ ID NO: 676621 - DNA, 887 bp, Homo sapiens
  misc_feature (174)..(174): n is a, c, g, or t
  misc_feature (182)..(182): n is a, c, g, or t
  misc_feature (189)..(189): n is a, c, g, or t
  misc_feature (219)..(219): n is a, c, g, or t
  misc_feature (279)..(279): n is a, c, g, or t
  misc_feature (286)..(286): n is a, c, g, or t
  misc_feature (290)..(291): n is a, c, g, or t
  misc_feature (307)..(307): n is a, c, g, or t
  misc_feature (365)..(365): n is a, c, g, or t
  misc_feature (371)..(371): n is a, c, g, or t
  misc_feature (387)..(387): n is a, c, g, or t
  misc_feature (396)..(396): n is a, c, g, or t
  misc_feature (606)..(606): n is a, c, g, or t
  misc_feature (619)..(619): n is a, c, g, or t
  misc_feature (621)..(622): n is a, c, g, or t
  misc_feature (645)..(645): n is a, c, g, or t
  misc_feature (658)..(658): n is a, c, g, or t
  misc_feature (675)..(675): n is a, c, g, or t
gggtggtcgggctgcaggagaagatggggtctccacaggagtaaaagttcctcgtaattttcgcttgtgggaagaattgaagaaggacaaaaaggagtaggcgaggtacagttagctggggccttgaagatgatgaagatatgacacttacaaggtgacaggcatgattatggngccaccanggacaanttatgaaaacagaatatatagcctgaaagntagaatgtggacctaaataccaagaagctcctccgtcagtaagattggtacaaaaattantatgacngganntaaataattccagtgngatggtggatgccggagcattaccagtgttagcaaaattgcaaaattcatatagcatnaaagtngtacttcaagagctangacgtctantgatgtccaaagaaaatatgaagcttccacagccaccagaaggacaaacatacaaaattaaatttaggtggatctcaaacttgtgtctaaaatcaacaaaccttctactcatgttaagtgtccttgattaacatattcacaagtgcaacaattacacattaaagtacacagaattccagctggtaaaacattgaactgactttgtaagantatattaatattntnnaccccattatgtttcaggtaccngggggcaaaatgncgccaattttttctctngaaggcactgtctttaaaccataacttgggtctcgaaataaatccagttacagatgaaacgtgtgagactgtcctgcgggacctgttttcaacagtaatttgaaaggaggtgttcccttacttgaagacggggatgtcaacagcgccacattcccgctatggcgcggggcccaacaaagggtggcaaaaaaaggggcacgtgttgcaaatta

SEQ ID NO: 676622 - DNA, 139 bp, Homo sapiens
cccaggacttacagaaaaggtgtaacctggctctaaggactttaagccacataatggtagtagacctcccgttttatttgacatggtgaataagctaccactccttattgtaccatatcggcaggacagagctcttaac

SEQ ID NO: 676623 - DNA, 167 bp, Homo sapiens
ctgcctgaggcactgcactgtgatcaccacagataataaagttgccatagggcagcttgagctgcttacacaaagggtacctcatgacatctgcagtaatctctgggatggacaccagttcattcgtgggttttcatgaccctgtgtattcccgtgaccgtcatccg

SEQ ID NO: 676624 - DNA, 426 bp, Homo sapiens
tcagccaatggttgagctgtattcccaacatctagaataatctctggctcagagaaagcaagcagtgtttatccaattaatgagtactcgtttaaagttgaacgtgaacattggaaccctcttgcgagtgcaggtagaaatacgaaatggtacagccactttggaaaacaggctggcagttcctcaaaagttaaacatagttatctatgacctagcaatcccattccaaggtatataccatagaaaaatgaaaatatatgtctacacgaaaacttatacacgaatattcatagcagcatcattcgaaatagccaaaagttttagaccacctaaaactttttagcttcaagtactctgcaagcctccttggaacgaaatcatattacgaaaagtccctagaaagtaaatttagtctaaatagggaaa

SEQ ID NO: 676625 - DNA, 1052 bp, Homo sapiens
ttgagacaagctctacgcaggaacctctcaacgcttcggaggccttttgcccaatggagatctgcatggtaccagtggtgtatcctgggcctgtggagccaggacaggctgcgtggtctaggtgttacattgtgaaacgtgtcgtaaagccatatcgattgtatcaaacgctcaagactagcatccgcttctgctcctatgaacatgcttaagacacttttaccagagaagcttctccccaggcagaggagatcgctgacagaagaaacctcgggccaccacgtgaggtgagcagcaggaaatgccaacaagccctggcagaatctggagagtgtcctcagccacctggaggacttctttgcacggacactagtaccgacgagtgctgattctccttggggtgctatgccctaagccccaaggagttctatgaactcgacttggtctctgctggccccctacagcgtggaccagagcctgatgcgcaggccgcttgtttgcgccgtctcttccgagccatacttcatggctgatgcctttagtcgagcttcacggctcctcctagctcatgggcaccgtcgtcatggttcacagggacaccgcaactgtggagaagattggtttcgacccaagctcaactatcgagtgcccagccggggccataaactgactgtgaccctgtcatgtggcagacttccatccgaaccacggttgggaagactacatttggttccaggcaccagtgacatttaaaggcttcgcgagtgaatgagtgcttcttaatcctaaaaacaagggctgaattatctttctccctgtggggctgaatcacccatctggtttggagctagagatgtcgttcccggtgaaaagaacgcaaggcaactctccttctgggttgtttggcttccctttgaatttctgaagaaggtgaagggatttgccttgactgtgtgacggttaccctgcggaacacacatcccttgaatccaaggtgtttccccaggggtgggaaggctctatagggttggcacacaagtggcctaaaaccc

SEQ ID NO: 676626 - DNA, 1045 bp, Homo sapiens
ttcgttgcttcggtttcagtttcctaataaaagagaaataaagtgcttactagctctcattgtagacaagaacgtttgggtgcggatgttcccatggattgggggattgtttatccagacagtatcgactgtcacaagagatgagtttattaaaatacaactatgtccaaagtaataagttcctaaggtttgggaatcacagaactagttgatgacacatatgaatttgaaagatcatttggtgtggccttaggggcggcgatgaatgaagaaactggaacaactttattggtgtatggacaagtcttattattacttatagaaataactgtaatgcattgaatttgtgtagaaacatgggtcgtacgtgtgattatatggggactatctatcctgggaagattagtaccctttgggggtatgagtgacatgaaggatttatagaactttggacattatttggaattccctcttatactgggcgcgggggtggttgtgactatcatggatattatcacggatgtggctataacatatttatggttcaaagaaatatctcatagtatggttggtcaacatgttaataagtaccccttgtatctgtcaagaacttttttggacacaatagatatttgaaatctggggcgcctcgtaaatatactttaaagtcggtggttaaactggttgaattaaaataacctttttaggtttggaaccaaagctgctccccaaaagagacgcgatactacggctagggcccgacggcggttttaccaacgacgtgcacagaggcacaaaccgccaccatggggatccgggcgacggacaccccaccctgcggggcggcgcacataatggcaccagctacactacgagaaattgacggcctagggaacactaacatcaagcgagcatggctcaccacggccatgatgcggcgacagtgcactgggacgaactaccctcttgacgcgtctgaacccccccgaagcccagggacaacacacatagagtcgcacgactacgcagcgctgcgcagccaaac

SEQ ID NO: 676627 - DNA, 393 bp, Homo sapiens
  misc_feature (393)..(393): n is a, c, g, or t
aactaatacaggaacagaaaaccaaacacctcgtgttctcacttataagtgggagctgaaaaatgagaacacgtggacacagggaggggaacagcacacactggggcctttctggggggtgatggcagggggagggagagcatcaggataaatagctaatgaatgtggggcttaatacctaggtgatgggttgataggtgcagcaaaccaccatggcacaggtttacctaagtaacaaacctgcatgtcctgcgcctgtgtcccagaacttaaaataaaattaaattaatataaaggcagctgaatattgtacacaggtttttcatatggcctgatttgagtgcatatggttaatagggtgtcaggttgtttgccaatttatatcttggctgn

SEQ ID NO: 676628 - DNA, 494 bp, Homo sapiens
atccctgcagaggagtttagtataacgtccaacaagattgaaagttattcgatagatcgctggtttgattctacaccctagcctggatcattctcatgatcggtagcaacaccctgtgattggaatactggatataacttcaaacccctcgcatatttaagaagcttagttttggcaggaatgtatctcactgactcattcctggaacatgttaggtgggtctggatagccttgagagcctgtgttttaatgataacaaactggttacagtccctcagcttgccctgcaaaaaagttctaaatttgaaattcttagacctcaacaaaaaccccattcacaaaatccaagaaggggacttcaataaatatgcttcggttaaaagaactgggaatcaacaatatgggcgagctcgtttctgtcgaccgctatgcactggataacttgcctgaactcacaaagctggaagccaacaataaccctgaacgcctctgca

SEQ ID NO: 676629 - DNA, 253 bp, Homo sapiens
ccattgctcagcgctccatgtctctactggaaatgcaaagattagccaggcgtgatggctgacgcctgtagtcccggctgctcgggaggctgaggggggagggttgcttgaacccggggggcggaggttgcagtgagctgagaatgtgccactgcactccagcctgggagacagagtgggattccgtctcaagaaaaaaagaaagatatttgcacaaaatatctaggggtaggacctgggagacagaggacta

SEQ ID NO: 676630 - DNA, 295 bp, Homo sapiens
ttccagatgaccaagtaaataatactattcaaaatggaggatgagattgacctatctaatcaggactcaattggaaaaaaaagaatataaaatgtcttcaaagaaactaaaaaccggtgaaagaacaaatgataggatgataaaaagtcagaagccacagacaactgaagaatcggatgtatccatagatattctaacctcaagcgaaccgtttccctcagatgacgaaagaaagtacatggctctcattcagacgaaagcttatattttagtaaaaccacttaaatctagaaaa

SEQ ID NO: 676631 - DNA, 826 bp, Homo sapiens
  misc_feature (270)..(270): n is a, c, g, or t
  misc_feature (615)..(615): n is a, c, g, or t
  misc_feature (673)..(673): n is a, c, g, or t
cgggcctgctgttgtccgtggtctcctcggtgctgccgtctttccccgccgccgcttctgtgttctcccccgtgcccctgtcgcctggctcttcgtcctttcgtgtcgcgtccggctgctgtgcgccgctctggggtcttcgcggtcgcgcggtgcggcgtgttgcgtgggttgtgcctgtcggcgttctcttcggtgtttgtcttcgcgtctgccgctctctccggtgccctggctgcttctcttgtggcgcggtcttcgtcctgggtngcgtcgtggcttgccgtgcggctcgtccctgcccgccttcccgcgccgcccgctggtctgggccgtgcgggtgttctgtcgctgtctcgcccgcgccggggcctgtctgcggctcgccgcgtgtgcccgtgccggtgtgtcttgtgtctgtggtctcttgctccgttcttcgctgcgtcgtgttgccgcgcgtggggtgcccctcttggtgtgggcctccccttccttctgccctgcgcgctggcgcgctgtgggggccctctggtgctccgcgttcttgcgtcgtgtctcgtcttcgtggctgggtgctgtgcggcgtgtgcggcgcggctgtgttcctctgtncctttgggccgcctctcggctctcgtggtcctgctggtctcgtgcccggtgtccgggngaccacccgctgctctccgtcggtcctgctcctggtggggctggggctggctcggtgtgtgctcgcgtctctcccgtgtgggccgctgtccgcgtctgcccgtgggctgtttcctgctggtggtgtgtctgcggcttgtggtctctgccccgc

SEQ ID NO: 676632 - DNA, 207 bp, Homo sapiens
ttattatattactgctgttagagaaatgaatgagcctacagatgataggatgtacatgtggtgtatgtatctggcggctagtccgagtaacgtcgggccatatcctggataggccgacgaaagtgttgtcgggaagaaagttagatttacgccgcatgaatatgatagttgaaatgcatcttggcgtcactttggcactagggtgta

SEQ ID NO: 676633 - DNA, 290 bp, Homo sapiens
  misc_feature (47)..(47): n is a, c, g, or t
ccaaagaacctttgggaggggaagcggggtgaatttttttaagattngggaggatttcccccccccgtcttttttaaaaccccagttgtgatgtggaggaaaagccccctccaaaatggacacaacccccaggttgcctttttaacttgggcattccgggccaatgcccccggcctttgggtttttaaagggccccccccccaatgggggggccaaattttcgggtttgccccgggatattaaaaaaaattttttgtttgaaaaatgaaaataaaaccccccttggggca

SEQ ID NO: 676634 - DNA, 227 bp, Homo sapiens
  misc_feature (67)..(69): n is a, c, g, or t
cagtaattgaggtctcttccaaatctatcagacccaaagacatatccatgattatagccaccttgtnnnatcatagcctccataccctccaccataggcaccacggcttcatcctttcatacccagcttctctgccaatgctattataccctctgccagcccccggcttatcatagggactggccgctgcatagccatgagctttcgaggaggatcatagtgggtcg

SEQ ID NO: 676635 - DNA, 159 bp, Homo sapiens
gagaaatactgcagccgtgatgcactagaagcgtcagctgcgcggctgtggcactcgcgacgtcatcttttcaaaagcaacaccatctgtattagccttgtgctttctcgctttggacgtggcacctttgaactctgttgcattactggaaattctctt

SEQ ID NO: 676636 - DNA, 702 bp, Homo sapiens
  misc_feature (375)..(375): n is a, c, g, or t
  misc_feature (413)..(413): n is a, c, g, or t
  misc_feature (429)..(429): n is a, c, g, or t
  misc_feature (483)..(483): n is a, c, g, or t
  misc_feature (643)..(643): n is a, c, g, or t
tgacacaggttctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaggtaaactacccaaccacatgccacgtaatatttcagccattcagaggaaactggtttctctttatttgcttatatgttaatatggcttttaaattggtaacttttatatagtatggtaacagtatgttaatacacacatacatatgcacacatgccttgggtccttncataatactcttatatttgtaatcaatgttttgagcantcccaagtttaggganatactcttgtaatgtaatgcttttgaaatctgagcaatcctttgctatacattnttaagcattgtgctttaaattgtatgctgtcgttgaacatgatactctgtgtgcgatgagagctatacagtgatatgtggttctctacgtatcaacttgcatgatggtcagaacaaatggaatcagagaagtcctccaggttgacaggttacctaagctngttgctttcttggcctgtatccggtgaggcctagaaagttgaactctttgattttcttt

SEQ ID NO: 676637 - DNA, 134 bp, Homo sapiens
acaagactgacctcaaccatgaaaacctcaagggtggagacgacctggaccccaactacgtgctcagcagccgcgtccgcacatggccgcagcatcaagggctacacgttgcccccacactgctcccagtggcg

SEQ ID NO: 676638 - DNA, 133 bp, Homo sapiens
tgggtgctctagaggatccggtcatgtatacatgaaggacatccactattcgggaaacaacagagtacaaaacagcaggcttgaagtgataaagcagtttaaaagagaaatgaagatagaacgtggttcacat

SEQ ID NO: 676639 - DNA, 300 bp, Homo sapiens
gctgggactagaggcacaccaccatgctcgcgtaatttttgtatttttagtagagactgggtttcaccgttggccaggcgggtctcaaactcctcgtctcaggtgatctgcttgcctcggcctcccaaagtgctgggattacaggcgtgagccactgcgcccagcctgagtttcattttttaagtcacatagcagtagtccttatttcagtgctagaccctttgaaatgcgatgaaagctatatggacccttcgctttgttaatataacatatgcacacatacccaggagccgggggatg

SEQ ID NO: 676640 - DNA, 178 bp, Homo sapiens
tgaacgagaatctatgggcaatagactctaccagacacttggtctcacgggtccagggtccgtgatcttgcagcgcagaccttctccagaaccatcgatccagatatacatggcctggactggctcaccctgaggcagggacatgtacacctgcttgatgcctttatttaagtgggaa

SEQ ID NO: 676641 - DNA, 937 bp, Homo sapiens
caaccttacaacaaccagcacccccttaaaaaaaaccaaaagctgagtcagttcaaccccagcttgttagccacacagaactgttccactgcatggaggaagctcaactgaagatcgaggagtcacaaagaactgactgaattcatcagggctaaaatctacaaaaatatactcgccggctcgtggagggccatggactgcacgttccaatggaaataaatacctcctccggatgcccaccgccgtctaccccaaacaagacatcctttgctctacctcatacacccatcctatgactaccataatcaattcccatcaaccacccagaaccccctgcccatcgacataaccaaagcacacccatcccaaaatcaactcctacaccacatattaatttacgctgatccccgatcacgagcaaccttcacactaattccacccctacccctccacccactcacaccccatccacaatccatatccatcacctccacctccctcccatccccaatccacacccataactaacatcctcccatctacacacaacaatccacactcccctatctatcaaccctctacctattatttgtttacccccattgcacatcccgcccctatatcacacgcttccgaccacctcaaccaccctcccccgaatacgactactcgtcctacatatcatacatacatacaatacgctccaccctgaccaaaaccgccaaaccaatttatccatggcacgctatctaaccacccaactcatagtaacatacaccaactacatacccaccccaccactatccatacaatgacgcgcccacccaacccgcctcgccaggctcaactttcacccctaacttctcaattatgtcaacgcaaaccctctatatatcacgcccaactcatcaccacattaccatcactaatcccccgg

SEQ ID NO: 676642 - DNA, 220 bp, Homo sapiens
tccccccgccggtctcactgtctacgcagcttaaagacagcgagccccagagcagtcccctacttcaaagatcactctgcgtcacgtggactttattacgcacaaaaaaagatcaagcaaacccggacttgttaacgagtgtgctggttatctcctttaaaggacgagcgagtgtttctgtccacatttccagaatacggtccgtaagacataaccgcgg

SEQ ID NO: 676643 - DNA, 3118 bp, Homo sapiens
gaattccggcagctgactagtcttgtgattggggtcctgggctgataaaatcattccaaatgacgagcacattgataaagacgtccgatgaggaccgggagtccaaattcggctttgtttttgccgtatctggacctgtggtgacagctgaacgaatggccggttctgctatgtacgaactggtgcgtgtcggttattatgaactggtcggagagatcatccggttggagggtgacatggcaacaatccaagtatacgaagacacctcaggtgtgacagtaggcgatcccgtgctgcgcacaggcaagccgctgtccgtggaactgggacccggaatcatgggcagcatcttcgacggtatccagcgaccgctgaaggatatcaatgaactgtcaaatagtatctacatcccgaaaggtgtcaatgtgcctgccctgagtcgcactgcacagtgggacttcagtcccgtcagtgtcaaggttggaagccacattactggtggtgacctgtacggtttggtccacgaaaatactctggtgaaacacaagttgctgctgccgccccgtgccaagggaactgtcacgtacattgcagaacctggaaactacacagttgatgatgttgtcctggagacagaatttgacggcgagcgatcaaagttcaccatgctgcaagtgtggcctgtacgtcagcccaggcctgttacagaaaagttgccagctaactaccccctccttactggccagcgtgtgctcgactccctattcccgtgtgtccagggtggaacaacagctattcctggggccttcggatgtggcaagactgtaatatcacagtctttgtcaaaatactcaaactccgatgtaattatctatgtaggttgtggtgagcgaggtaatgaaatgtcagaagtactcagggatttcccgcagttgtcgttggagattgatggtgtgactgaatcaatcatgaagagaacagccctggtcgcaaacacatcaaacatgcctgtggctgctcgagaagcatctatctacacaggtattacactgtcagaatacttcagggacatgggttacaatgtatccatgatggctgactcaacttcacgatgggccgaagctcttcgagaaatctcaggtcgattggctgaaatgcctgccgacagcggttatcccgcctacctaggtgcacgacttgccagtttctacgagcgtgccggccgtgtgaagtgcttgggtaacccagacagggagggctccgtgagtatagtgggcgccgtgtcgccgcccggtggagacttctcagatcccgtgacgacggccacactaggtatcgtccaggtgttctggggtctcgacaagaaacttgcccagcgaaagcacttcccatccatcaactggctcatctcgtacagtaaatacatgcgtgctctggatgacttctacgacaagaatttcccagagtttgtcccactgcgtacaaaggtgaaggagattttgcaggaggaagaagacctgtctgaaattgtgcagttggtcggtaaagcttcattggcagaaactgacaagatcacacttgaggttgccaaactattaaaggatgatttcctgcaacagaacagctattcaccatatgaccgtttctgcccattctacaagacagtaggaatgctgaaaaatatgattgctttctacgatatgtctcggcatgcagttgaatctactgctcagagcgagaacaagatcacttggaatgttattagagattctatgggcaatattctgtatcagctttcctccatgaaattcaaggatccagtcaaggatggagaagcgaagatcaaggcagactttgagcagcttcatgaagacattcagcaagccttcaggaacctggaggattaaagtggtagctgccagtggttctctcggtgcagttgtcacatttggcaagctctgtagggttgccgagtggcatcggtgctagacacctgagcattcctttgccacataaagactaaagcaggtggaatttcagttgtaaaaagctggttccattggtgctaagattatgttgtgcccttttctgcttctcacattccaacagaggaatttacttccagttttcttccattttcctcctcattttaagtgtcggtacagaggcaataatctgataactctgtaccgtcacttacaagcagggagaatttgtaattattacaaatcccattatctctgtgcaccacagccttgtaaattcatttgtcccaggactccctcttgtgtgtacgtgagattgccgtctgtatgtatgtacacaccgtactgcagtatttgaagtcagtcagaaggtgaattacaccacttactcattgtgtcacgtagcaagtgtgcaaactgccatccattgtcctatttattcacataactagttttctttgcatttccagtgttgcaaattgtgtttagaaaattatgccatcgagactggtcgaacctcacattgtaactcagtatttacacacacgtttacttgctacagaaatgtagaaaaaataattgttgtatattgaaagtacaagtgacaaagttgcatttaaaatggtgaatgtattttatatttcttttgtagacacaagagttaatgcattttgcttaatggagatgtatgtaaacctaaaatagcagtttgtgcacaaattatgtatatgtgaaatggagatggtttctaatttgctgattgattgccagtattaatttaaacaactgtagttgtgggatgtagtgggaagattttttttttcctataaaattggtggatgtatgtgtcggagattttgattgtatgtgtaaaatagtgatcccagtaactgtaaagctttagaatacagttactgactgtatagttgtacaggtgttgttacttttaagaatttattgacacaaaggtgaaagtctattattgtattgtaatgtttaaagcatttaaggtttaaaaatcctacttctgtgtataaatgttaccattcctcatataacataactgtgtagaaatacagtcaacttcatgttcattagcatttcactgttgtcacataaattatgcccggaat

SEQ ID NO: 676644 - DNA, 281 bp, Homo sapiens
  misc_feature (236)..(236): n is a, c, g, or t
ccagttaacagaacagcagaaaaaattaggatctagttgacagagatggaaagctcaccttataatctggaaatacacattcttttaaaacacacatagaatagtggatgaaaatctgcacaaactaaaactagcctcaacacatttcaaagaatcaaaatcgcattagaccacattttattaacactttttttttttttcaaagaaccagcgtctaactctgtcatctaggcggnagtacaggggtgcaatcatagcttactactgcagcctcgaactcc

SEQ ID NO: 676645 - DNA, 1706 bp, Homo sapiens
gaatgacagacggatagacactgcatgattgtcgtggtcccacatgagagctgacagtaagccggagccagacacagaccatggagacgatcacgaggatgcagctcagacctgccgtgcctgaccgacatggagcgatggatttgactggtagctcagacttcgattgtatataggattgcaaactgttctataagagaatccatcacaatcaccagatacatatcatacacatcccttcaatgattacccacgagggtttgcatagcaaaaaaaagacagcagggacgcaaaaagaagaatacaacaaggacatgaagaagccgagaaaaaatccaacgagaacaatagcaaagcaaaggaagcaaccatcaccaagaagagtcacaaaccataggaatagagaacagacagataaagtgaccaaaggactaattagcaccaaggacattagggaccaaagaaaaagaagtccatagcgaacatgacatgaaccagaggcgtaaaaggcatccacaaaaagaacccacatgatatgacacaagacatacagagaacaaagacagaccaaacagtgatacagccaacaaaagcgacaataaacaaccaatgacggagatgtgagatcaaccagaattcgttcacggacataatataccataaaccaggataaaatcacggcacaaacaacaagtggtaacaccacatgcaactagtaaacttcatcacaacactcgcaatatcatgagacaaaacgaacaattaaaatacccacggaatcaccccatataattagacattgagatcaggcatgtaccaggaacaggctaaacacaatcaggagagtaaaaaccacccgtccaatacagcaaaccacgcccacatagggagacaaaaccacgaagtcactaacaactaacgaacgaacacagcacaccagttgcggaaggataaggagacaaagcaaacccacatcgggaagagaactacgacaaagaccatgagaaacgaagaagaaagtaaagccaagacataatatagacgacatacaacagaccacaagacacaaaaaacatgtaccacaaagttaaagggaaactggggacaaaccagagccacagcggaacagaactacaacaaacacgcgaaaatacccctaaaccccaccccatacaacaaacaccggacaataacaccaatggaccacgagggctaacaaaaagtagacaaacgacagaggtgcaaacgacgataagagcaaaaagcaaaaaaggcagaaaacaacaaacacggaacacatgacgcaacgacacgcaaaacccagcaagagaaacaacgaggaacacaacaaaaaacccagagaacaaagcagacaccacagaaagagaacccagagtagtcgaacaacacagagaaataaaaagaaaggacgcaaccgaacccagaagagaaaccaagtagcacgagacagctgaggagcacgcaaacgaagcagagacaaacagaaaagaggactagcagagaaggcaggcgaacacagagaagcgaccagtgaatagcacaacggaagacgagagcgagagagaggacagacagaagacgacaagaatgaaaagcagaaaaacacataacacatagagtaaaacagtatgaagagcgcacagagacgcacagaagccgagagaatgaagacacgcgacacagaa

SEQ ID NO: 676646 - DNA, 445 bp, Homo sapiens
ggtcgacctttagacaagccccaggtgatgtgactcttctgcttactctctactcactgatgtaattgtgacatatatcttgccccagcttgtagttgctatgatgattctcacaccttgaaccaggcaataaaagagttactctctctcctagctaggcttaggaaaacaagcacaatccttagtctcctctttttgccaaggtcctagagaattaccactctctcacatattgtataaagctctcgggtggcacagacagtgtcatcaaggaacaaaatcacagatgatattgtgttacttttttttttttggagacagagtctcgctctgtcacccaggctggactgcagtggcactctcggctaactgcagtctcagtctcctgagtagctgggactacaggcatgtaccaggaagccaaactattttttgtatttttagt

SEQ ID NO: 676647 - DNA, 723 bp, Homo sapiens
attctttttttaaatcattttgtgacagtttagcaaggcttgtgataagcaagttatggtatggtaatatttctagtgtccacgtttcttcacatgtctggtgtatgggaactactaactccatcaggaccttgcctatagtaggtactcaacatttactgaattaaatcaataaacatttttaatgaattacggtacaagtcagacctctgtatctgtgggctctgcatctgcaaattcagccaaccatggatcagaaatattagaaaaatggaagaacagtccagcaatacaagtaatatgaatatgctttaagtatactgaaggatttgcgtaggttatatgcagatactgtaccattttatataaggaacttgagcatctgtggattttggtatttgcatggttcctggaaccaatcccccagggatactgagggactatagttgatcataccacctgattttagagattttctgagtctcagaagttaattaagtaaactacaatagtctgttcttaacctcggaggatacattccaagaacctcagtgaatatctgaaaccacagatagtattgaatccaatatatacacggtaatatttttttcctatacatatggatctattaagtttaatttctaatcagacccagtttttacggtaataataattagtgcaagactgggcatagtggttcacacctatattttacaccttaac

SEQ ID NO: 676648 - DNA, 102 bp, Homo sapiens
gcccaaacccactccaccttactaccagacaccttaggccaaaccatttacccaaataaaggataggcgatagaattgaaacctggcgcatagatatagtac

SEQ ID NO: 676649 - DNA, 422 bp, Homo sapiens
  misc_feature (136)..(136): n is a, c, g, or t
tcccttattctcggggtacgcctaggacccacctcggccaaaatccctttcctattattattcaccgggggaaatctgactttctttccacaacactttctcgggcctatccggaatgccccgacgttactcgggntcccccaggcataccccccctggaaccccttatcatttggagggtccttcatttctctaaccgccggaatatttattattttcctggtttgggaagccctcgcttcgaagcggaaagtccttatggtagaagaaccccccctaaacctggggggggtatatgggggccccccccccctccccccctttgaaggacccgggttcattaaattttgcccaaaaagggagggatcggacccccccaagctggtttccagccccccccctggcccccctggctttttcca

SEQ ID NO: 676650 - DNA, 202 bp, Homo sapiens
cttcagtgaggccttgctgaagaggatcaggacctggctccaatttctgctgacaggcatctatcctttctctggtgacaaaataacatgtgattgatatctgatgtggctccagggacatttgagtgcaattgagagttcgacagtggatcctataaaagggacatgactacagcacatgtgctgactgagtgtaccagtt

SEQ ID NO: 676651 - DNA, 127 bp, Homo sapiens
  misc_feature (123)..(123): n is a, c, g, or t
atgagtcgactggttcgcatgtttgccaggttggcgtgcacgtagtgtagtccggctcaaggcaacctccacctcctgggttcaagcaatactcctgcctcaccctcttatactagccaggtnacta

SEQ ID NO: 676652 - DNA, 1348 bp, Homo sapiens
  misc_feature (345)..(345): n is a, c, g, or t
  misc_feature (411)..(411): n is a, c, g, or t
ggtcccgcaacaggaaggttaccgtgctctacgtgctcacgctcttctcagtctcctaaccgccgtgactggcagtgaaggtgaaatggtccacagggcaaaggcggctcgggagattcagccgttgaacgcaaggctgtcgacgagtagatggccattggtggtagttaacagagtaaatcaaacaattatcaacggcaagaaaggacaatggacactgacacgttgttgcaaagggaggtagcgtatttcggtgtctggatcgtacgtaacgatcggaattggaacagttagccaaactgactttccctttccgctcagctacagcaaggaagcgaatgaatngctgaaccttttgattgaatgatccaatagtcacgagtggaacattgacttgcggagtcctttcgnccactgtaacacacttttgattcactcttcaacgtggacttgggtacttcagtatccataaattacttaatgggctcatatcggtctaatcgcggggacagcatcccttggtacgttcctccatggttgtaggtgtacccgagactattgccaattggagaggaagtactcgatctgttctctccagtttttattgaatgcgccctattatatgagatctttgccccaaagggatttctgcgttcgtcgactaaacaatgggccattcatcggggaatcttggaacctcccccttaagaacattgatggggaacggttttgctacaaaacggaaagaaactggaatttggtataccgccaaccttgacaaggccactttggaaaagatacatgccgaaattatattcacccctttttgaaggacttagcagattggtgcctaggaaaggacaggttggccgaaattgtgtccatttttaaaaacataatttctcaccatttcttggaattcccaaattggtccccttcacctgggtggggggaaaccttttggaattaagggaaacagttccagattgggttggcacaacagaattcagaaagagattggaaaatttggctaccaagtgccttgtggcgaagggacagaggcaagtccaattgttttggggggaacggaacacttcctacctaaggttggcattggaccttggacccacgaagggttgtattataaaacctgtgaaagtccgaggagaccactttccgttttcaacatgggcgataccccctgttagcaattgtagggaaaggaaagcactctgaaaatagattggggcggtggagaaaagacaattcgagtataccacaagccgtgtgtgcccgagacgcgcacgaatttgccgtttgccctataggcgcaagataatatccccgt

SEQ ID NO: 676653 - DNA, 328 bp, Homo sapiens
  misc_feature (78)..(78): n is a, c, g, or t
  misc_feature (150)..(150): n is a, c, g, or t
  misc_feature (158)..(158): n is a, c, g, or t
ctttagcattttaaatatgccatgccatgggccggccgtgggtgctcacgcctgtaatcccagcattttgggaggctnaggccagtggatcacctgaggtcaggagttcgagaccagcctggccaacatggtgaaaccccatctctactnaaaatacnaaaatcagctgggcatggtggtgtgcgcccgtaaggccagctacttcggaggctgagtcaggagaatcacttgaacccgggaggtggaggttgcagggaggcagaggttgcagtgagtcgagattgcgctactgcactccagtctgggcaacagagtgagactccatctt

SEQ ID NO: 676654 - DNA, 356 bp, Homo sapiens
aaaggggggggggggggggggggggcccccagttgccccccaagggcccgggggggaaaggaaattttcccccaaaccccccccccccccttttaaaaaggggggggggggggggtcccaaccgggtgggttccatgggccccttaggtttggggggaaaaagggggggaaaaaaaccccgggcggggtacccccccccaggggaggggggaggtttgggggcccccctggggtttttttttgggggggggggggtttagggaatggggttttaaaaccggggctttttaggggggccccccggccccaaaattgggcccgggatttggggcccccccaaaaaggggaaaggggga

SEQ ID NO: 676655 - DNA, 403 bp, Homo sapiens
taggactgtctagaataaaaatgacagatgggctgggtgcagttggctcacgcctgtaatcccagtcactttgggaggccgaggcgggtggatcacgaggtcaggagattgagactatcctggctaagatggtgaaatcccgtctctactaaaaatacgaaaaatcagccgggcgtggtggcaggcgcctgtagtcccagccacttgggaggctgaggccggagaattgcttgaatctgtggggcggagtttgcagtgagccgagatctgcgccactgcactccagtttgggcgacagagttgagactctgtatccaaacaacaaggaaaaccaagttttccgggcttggcccggttgctcatgcctgtagtcccagcactttgggagtccttgtgggcgtca

SEQ ID NO: 676656 - DNA, 87 bp, Homo sapiens
acgacagccactttgggctttggagccccccaggccccagtagataatctcagtgataccttgaagaagctgaagataacagctgtt

SEQ ID NO: 676657 - DNA, 184 bp, Homo sapiens
  misc_feature (135)..(135): n is a, c, g, or t
cgttgctcgatcactgtactggtaccagacagacatacagaccaatggaagcagaacagggacctcagaaacaacaccacacacctaaaccatttaactcttcaacaaactctgacaaaaacaagcaatgggaanaaggatctcctcacttaataaactggtagtggtaaacacaggctagcca

SEQ ID NO: 676658 - DNA, 254 bp, Homo sapiens
cccccctagaggatcccccacgctcagcagctgaccgacctcgccaggtgctggggcgattggtgttcagcgcgcgcggtggccgcatgagctctatctctctgacgtggcagcccgggcgcatcgcattagcgcaagcccgtcacatctagcgtgcttcctgacacagaccggcgggcgctgcagcaaatccgcactcagcaacgcccctgtcaatccgcacctcatcaccgcgcgaggctcaaagcggtctg

SEQ ID NO: 676659 - DNA, 171 bp, Homo sapiens
gttaaaacatgccacgagtaaagccaaaaactggagaaacaacttcaaaaagataaagaaaaggttgaagatttaaaagtatacctcccaagagtaacatatcattattgaaacaacaccagaaacatgcctcgagaggaaaagagaaggagaaaaatattaaagggagtt

SEQ ID NO: 676660 - DNA, 612 bp, Homo sapiens
acctgcagcgcaagctgtggtgccaccaagcaggaggaggaggctctgctctcagagatggatgtgacaggtcaggcttttgagtgacatgcaggaacagaatcgtggcggctgcgtacagcagattgcgggaaataggatgatgcccaactttaagctaatgtcagagcggatcaaggccaaccagattcacaagctgctgcgggaggcagaaggatgagttgggcgagcatggtccttggcctcaagtcccaggtgtgatgcccatgctgcttgactgtgcagaacgctggaggagaaggagcgagccttgtctgggcagtcctctgggggttgtggagaaggatgctgatcgctgtcgcagctcaaggccctggtagctcaacaaagctggaatggctgtagcaaggccgcccagctggccgatggacctgaagtgtgcagctgtgatgcacgtgccatgactcgggctgcagggaggatccaggccctgccctggcagagagccgggctgctcgtgagaaagagagcttcaagtctcaatgagggctccaggaggacgtctcacggctgcggcgcaggctggaaaaagcagcaggaaggtggagggcc

SEQ ID NO: 676661 - DNA, 219 bp, Homo sapiens
cggaatcctgaatttgacgcgtctcctttcagactgctcccacccctaattatctccataaagagctatattaattgggcaggtgtatgcgtacagtcatctcagcttctaagaacccctagattcttctttcaattctcctttctccctatcatacaattgagatgtttgtcctttgcaccttccccaagatagcaaaggtgatacaaatgtggaagg

SEQ ID NO: 676662 - DNA, 223 bp, Homo sapiens
ggggggggggtttttttcccccccaaaaaaaaaattttttttttggggcgccccccggtttttttcaaaaagggggggcccccccttttttccccaaaaaaaaggtttttcccccccccggggggccccccccttttgtttttttttcccaaaaggggttttccccccccccgggggggttttttttttttttgccccccttttttttgggggcccccccaca

SEQ ID NO: 676663 - DNA, 701 bp, Homo sapiens
caacccaggggaattatttttttttcccttaaaccctgtttaaatggaatttattcacccatcctttggggggggccaaaaccttttttttaggaagggatttggggacttaaattccagttttttttggggggttaacacccatatttttttatttttgaatccaatttcgggttttgtaaagccccgcccaaactttaacacattttaaacaatcgggggggcggtttttttttttggaagttcttccaaaattataaatttgtctttgttaaacactaatttgcccgccaattttttaaaaaagaaattttactccctttttttaggggattccacttaatttttataaaacaaactttagtttttaccctaatagtgtatattttgacagaaattttaataaaaaatttccccaacattagttggggaacaaacccaaatgggcttttaaaagagaaacaatttgtttttggggggaaaaaagttttatacctttttccccggaattttctgggccaaaaaggtaaaaaaactgtgggcaatttttttgttttttaaccaaacaaagcaacagattgggttatcacttgggtggaaaaagaaagttgtaaaaggtttcccatattgaaattagggctaagataattgtttatttctgggaaacgggaaatttatttcttttttggttatagggaact

SEQ ID NO: 676664 - DNA, 445 bp, Homo sapiens
gagagagagagagagagagagagagtgatttctcccttccctttccttccttcttctctccctctccactctctttctctcttttctctttctccccctcctcttctctctctctcttctaccttttttctcttcatcttctcctctctttctcttctcctctcccttgctcctcttccttttcttatcttcctcctctccttctctccttcttcatccctcttccctttccctctattccccttccctcttttctctttttctctctccctctttcttttccctctccctcttttatccccttccctcttcttctctctctccctcctatcttctctttaccccttcccattccccctctccacgtctcctccttcccctccctcctctttctcctccttcctcttctctctcccttcctctctcttccttgcttttttttccc

SEQ ID NO: 676665 - DNA, 774 bp, Homo sapiens
gcagctttcgttgaagtttagaagataagaaacatggcatcacattaccggaacatttaaatatgatgacatgtttcggtaatgtgatgcctcaggtctgcctttttttctggagaataaatgcagtaatcctctcccaaaaaaaaaaaaaaaaaaaaaaaaaaacaaaaaacaacaacaaaaaaaaaagagggggcgcgcgcgcgccccaaagattctccccccggggggcgaccccacattcgcggcgcgcgcccccgcgtttctctgggacacagagggggcgccccataaagggagggccacattatataaacagcccagagcgccacgcgagcgccgcagcgcctatcacaccacccccgcacgaaccggggaaacacacgagcgaccacaccccgcgagaacacccactggcgcaaagagacaccccctaaccctgcgcgcggcgcgcagacacacacgcgggcacacaaccaacacccaaccacccccacacacctcacaacccacctgagcgggacaactcataccaagactctaccaacaaggcgtaaaacacggcgggaccacacacaccgcccaataacccccacccgcaccggaacaaccagggaaaaagcggcaaacacaatctcaccgcaccattatatatacccccggggccactcgcacgaaaaaaccgaagaccacacctcaccacgaaccacaacaccagccctcgacccccccccccacacccaccgcccaccaccgcccgccgcggcactcccc

SEQ ID NO: 676666 - DNA, 153 bp, Homo sapiens
tcactaacattgacacacatctgttgcaaatcagttgaggtacccatcatgactagactcatttggcgggaaacaccaaatttacatgccaattggcacacagaagtgtgggtatgggggaacagcgggtggaacgctctggtgggagaggat

SEQ ID NO: 676667 - DNA, 216 bp, Homo sapiens
ggaccaggctttccatacacgggccaggactgtggctctttgctaaaccaactctgggactcagctcccaccgacaaagaaaatgggtctcattctgggctccaggattgtctccccactccagcatcccaaactggtactcactgacccaggcccccaatcctgggcttttacagagcctccatgagtcaagccccctccccacagagagagcgt

SEQ ID NO: 676668 - DNA, 712 bp, Homo sapiens
aagtagctaggtacgaggcgggttaatcggccgaggagtcccaggcatttctcgtgtgtgtgtgtgtgtgtgtgtgtgtgtgttgtgtgtgtgtgtgtgtgtgtgtgtgtgtgtgtgtgtttgtgagagtgagtctctctaagctcatgtccaccccctctctctctgtctctctctctctgtctgtctcaccctctctcagagagtgagtgtgtgtcggtggcatctctctctcttctctctctctctctctcgttgtgggtgtgtgttatactacgagagccaatcccttctcctcgcgcgtgtgtcgtcgtgctccgctgtgaacgtgtgagagacgatataggagacgtgtcgtctcacacgcgccggcgtggatcgtcgcgcggggcgtggcgcgctgtgtcccccttccccgaggtctggcttatagggctccccgtgtgagaggtgtgtctctggtcgcctcgaagaggaggcgtgagccgcgcgctcaacacagatatcttggaacaacactacttctttggtataatatgtatgattctgagacgccgccgtcgcgtgctatcgtagagagagagacgaaaaacaagaggggaatcttgtatacgtgacaccccacgagaggccgtgtgtgaaagagaacagacgtgctcgggcgaggtaacacaatagcacaagaagtgctcctggacagtgcaagaggttg

SEQ ID NO: 676669 - DNA, 694 bp, Homo sapiens
  misc_feature (359)..(359): n is a, c, g, or t
  misc_feature (530)..(530): n is a, c, g, or t
gacggacgcatagtatcggaacattaacaaacgaatcaaaattatgtgtggagtatgtggctatacaagcaatgatgaccgagtcggagcatgaaacttactccaaaagggaatcgagtactatcatggcgtgacagcacaagcatgacttgggttgtcggggtgccgtcaaccacccttatgtaaccccaagtgaaagaaggaggcgtcagccgtttgcacttcttggggagttacaagcccacacttcaaaagctactaggcattaagtggggtagttgacacggaatatacgtcgttttgggtgaacgttttgttgaatggggaaatggatcaaataaataaaggttcatgatgtntttagaattaggaaaagcggcgttctcgtttcacggtgaacgccgctttgtctattctctggtcgataaaagtccgtaaatggccgagaaatctttttgcccccatccatattgcttcgccaagccgtatagttcttttgcgacgttagcaagcggcaaagaaacgtcgtnttcgtaggccgattgtgcaatgagctgcaagtcttttagcatatgttcaagaggaaattctgtcgcaaagtggttgcggagaatatgttcctttttcccgtttaaaaacggagcggttgttggaccgttcagcaaggtgttgactcaccgttctttgtctaggc

SEQ ID NO: 676670 - DNA, 87 bp, Homo sapiens
ttaggtatatacatctctttacaatactgaaagctaccactacagttccagtgtacatattccttgcatctttttagtcgttgtctt

SEQ ID NO: 676671 - DNA, 129 bp, Homo sapiens
caaagggctggtgattgtaaaaattttttttgtaaagtaaaagttgggggtggggggggtgctggctgcaaaaatttttggctttttttacccctattgcccccggcaataaattgtttttatatgcca

SEQ ID NO: 676672 - DNA, 548 bp, Homo sapiens
gaaggggtgatgcggtaggtacctggcaggcccccgcgttccacacccgtcacaccagtgctgagactgtcgggggttcccatcggggagtcatggtgatatgctgactctctgaattcctaggccattggggaactgtggtgactgaatatgctcagagcaccctcctggcttctttctcttctggctggacgaacgtctctacagagcatttacacactcaggctttgctgtacgaccaagtggccgaggcgctgaaggcctaggaataccatggactttgcatgccttggatagtctagctggatgtgaaattcaggccttcacatatttccttcagaactctgaggatggaagatcacagttgtctggcagaaatccctaaaacaggttaaatcacgttttaggaaatacgtactactaaaaggaccacttcatttatgctgtacgtcagaatcataatctggcagaaatgcaagtaagttaaggtaaagctaggcatgtatgtaatttggtttctctgtgtcactgaggtaaaggtctcatgt

SEQ ID NO: 676673 - DNA, 109 bp, Homo sapiens
tagggtgatgatgtggacccacatgcacaagagagcacagcaaatgctcagagcagcagcaccactcccagtcagcacagtctcagcagcagcagcagcagcagcaaca

SEQ ID NO: 676674 - DNA, 331 bp, Homo sapiens
gtgagccagatgcgcactgactcagctggcacacagtgatgactctgtaccaaaaaaaaaaaaggccacttggcacccgggagagtgtggtgagagtgggccaaattatgtccaaaagattaggagaggtaccttagtaaacctagaataggattgtttggaataggccagtaagactaccaggtaaggcagctctccaaatcagtttatatttgggaaaaccacagagggatgagcatattctgaaggcactaaaggtattgaaggggacagggccattggtcgggggtagggccctacattatttaaaattgccaaagagcagggagac

SEQ ID NO: 676675 - DNA, 340 bp, Homo sapiens
cgtaatcagaccccgtagagagtatttcactactcagcagctatcgatgcagttgacatccatggaattccgttttcggaaacctgtgcttacaatgcaacacaatgtacaacatgttactgatgactatgtccagctctgatttcgcgagtggatcctgtagcttcagacattggtactgagaagatcaatgatttcagagctctccactctcacttacgtatggaaggtgctgctccaagacagctccatccttgtgtcacagcgatgactttgcattgtgcacccattagaacatactacacagaggtcagagattgttaatggactactgctgtgt

SEQ ID NO: 676676 - DNA, 116 bp, Homo sapiens
  misc_feature (105)..(105): n is a, c, g, or t
gtcatctttggaaagtgagataaccaaggaaataatcgaaggagttagggagatgattacgtgataatgactttgggcgcttaacctttgatcccgggtatgctnaagaagctgac

SEQ ID NO: 676677 - DNA, 108 bp, Homo sapiens
  misc_feature (5)..(5): n is a, c, g, or t
catgnaactaggtctgtcccaatgtatgggatggcggatagtaagtttgtaattactgtggcggcactggcccccaacaggcatcaccccgctaaatcccctagaagt

SEQ ID NO: 676678 - DNA, 535 bp, Homo sapiens
cgacaataaccagccgcggtcggtacacggccatgacctgcatcagcagggtgaccagggtggccgacttgcctgcgccggtcgggccgaacaacagcagatgaccgttcatagcccggtccaggcgtgacaacggatcaaagctcaacggcgaaccgccacgattgaacagggtgatacccggatgtcctgttcctgtgcttcggccccagaccggaacgaggttcgctaggtgttgaacaaacatcaggcgggtgtaccagttgcgcgtgtcgcgggccgggttgtaagccatcggtaaccaacgcaggtagctgttgcaggcggcgatctcatcgccttcgcgtaccggttgcaagcccgcacccagcagcgcattggctaggctgaccgagcgctggtgcagttgctgttcatcgtcaccgcgcacgtaaaacgccagcgtgccgcggtacagcttgtgctgacggccgatgatcgcgcgggcttcttcgacatcctgacgggtctgggtcgagccaataatgctgtgggc

SEQ ID NO: 676679 - DNA, 145 bp, Homo sapiens
ggcccttaaccctgcagacgcatatgctggattatatcttgttccacttggggcagcatcatcggcactgatataatccgcatagctctgcagggttaagggctccgggagggccaagggctcccggagggtaaagggctcccgg

SEQ ID NO: 676680 - DNA, 775 bp, Homo sapiens
atgtcgcctggctggaagtccatcccagagatccaggactgtatgaggaaaaaaggcttgcggtgaggacttcaagcagctggagtccttcgtacatccaggacgcgtgctggtacatcagcgtcgttcgtatatggccaagggcttatgatggtgtggccagagagggtgtttgataatacacagtaaagattctagccagaacacaatcatacaaggtgtggcgagaggatattccagtgaactatatgaaggagctggaactggtcagcaaggccggcttccgggcccttctctcgtgcccccgtggtacctgaaccgtatatcctatggccctgactgtgaaggatttctacgtagtggaacccctggcgatttgaaggtacccctgagcagaaggctctggtgattggtggagaggcttgtatgtggggagaatatgtggagcaagacaaactggtccccaggtcgtggcccagagcaggggctgttgcgaaaggctgtggagcaacaaagtgacgatctgacctgaccttgtgctatgaacgttgtgtccacacttccgactgtggagtttgctgaggcgagggtgtccaggaccaaagccctcaattgtaggctttctgtgagcaaggagtttgacacaagacctgagtccaggacccgaggagggtgctgctggaggtgaatgggaatgcgagcccgggttcacggggatcctgggcaggggaaggagcccttggcttgggccctggttgtgcccttgtgctgcgaa

SEQ ID NO: 676681 - DNA, 1651 bp, Homo sapiens
  misc_feature (39)..(39): n is a, c, g, or t
  misc_feature (57)..(57): n is a, c, g, or t
tgaggaggtgaagagcactacgaagacgcagcgcatcgnctcccacagccacgtganagggctggggctggacgagagcggcttggccaagcaggcggctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagt

SEQ ID NO: 676682 - DNA, 229 bp, Homo sapiens
  misc_feature (148)..(149): n is a, c, g, or t
cccggagtgacccaggtagataacaagtccggtttcctgcagaagaggcctcatcctaaagctgccgcacgtagacacacagcactggctaacggtgcccagttattgctacttgggagcgctggaccctcgacctggttatatctanncccgtgtccccatgaactcccttgtacccagttgaccaacctggcctgtagcttctcacaggcgtaccatcccatcccct

SEQ ID NO: 676683 - DNA, 418 bp, Homo sapiens
  misc_feature (13)..(13): n is a, c, g, or t
  misc_feature (17)..(17): n is a, c, g, or t
  misc_feature (20)..(20): n is a, c, g, or t
agccacccaagtntggnganttataggcgttcaccaccacgcccggctgacttttgtgtttttggtggagacggggtttcgccgtgttggacatgctggtctcggagtcctgacctcaggtgatctgcccgcttcagcctcccagggtgctgggattgcaggcgtgacacccatacctggcccgcctgggatcgggggttcgggaccagcctggccggcaatggtggggccctgtctctactgggaatacagggattggccggctatggtgacgcacttctgtggtcctaagctactttgggaggcttgaaggcacgggaatcgcttgaggccccgggaagttggaagaattgccattaagcttgagatttgtgcccctgcaacttccagtctggaacgggggagtgagactctgtct

SEQ ID NO: 676684 - DNA, 1574 bp, Homo sapiens
agcctgggaaacacagtagggctccacctctacaaaaaacacaaaaattagccaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagt

SEQ ID NO: 676685 - DNA, 926 bp, Homo sapiens
  misc_feature (622)..(622): n is a, c, g, or t
aagaagaaaattaaaatttcctatcactgcattttgataaaatataaaatgtatcaattaaacacaattaggatatacaatgactacattatcatcaactaaaagatactaccatttatttaactaattacctatcattaaacatctagaagctgttatccaggttctcagttttataaataatgatggccaaatgaccattatggtcaactcttataatttttgacccagaaatgtcaactccgcctttttatgaagtatttgatacgcactgccaaattatctccagaaagacagtaccaggttagaaccacaccatgctgtaaattgataaagccatgttggagacaacttgacaatatagatagaacaattgatcacctagagtgaccttatttaaagaaatatttaaaatagtaaaaatttggaaacaatctaaatattcgttaatccaggaattcatatatttgtcacacagcaataaattcatacatttgtcacacagcaagaaaaatatatgagctagatctatacataacaacatagatctctgaaaaacagaatgtcataacattgagtgaaaaaatcttggtaaaagcatacatacagaatggaatcattnatgtaaaattttttcaaaacaaaataaaaatatactgttgtggatctttacatacataggggaagtacaaaatcacgtacagaaagaatactcgtacttcgacatgacggttaatctctgcaaaaggagactagggaagagatgtaggagttatacctggatccatcatactaactttattcacaaacaattttggagcatagtaagataacacggtatacatttctcacaatctaggacacagttctcaatgtatcacgagagattctgggggacatccaagcctcgtgagtaccgtgacggg

SEQ ID NO: 676686 - DNA, 1034 bp, Homo sapiens
  misc_feature (141)..(141): n is a, c, g, or t
  misc_feature (801)..(801): n is a, c, g, or t
ggcatcgcctacccttataaatatcaagcataaaccttgccctcatacagtctatcatcgttgcacaatctcgtagattgtactgactatccttgacatgtcgcatgtctacctggtgaatcttcgaagggacctaccccntttgcacatattctcagataaggcctcctagcttgcacagactaaccacaataatggatcccactcaatatctacaatgccatatcaattatttagaatcccaagatcgcatgtaccctctatgaggtagcccgtcgtcaagtccctccttaaagtgacgctccgtggcttagacatgtagtatttcaatttcacaacttcctattaacgcatccatctatactagagcgctactagcccatcaatactaggcatgtaccattgatggtgcgggtgtatcttgagaaagggcataacaacgttcaggaataagagtcacctgttcagaatacaatggcctatcgaatgaggaggagtaatccgtattaattacctcagaagatctaacttcggcgaggagatatgactcgaggcctgttataacagtgccaagcgtagaccgataggcctcgcaatttgaggtaggggcgactgatccgcaaggggtggatcaggcccgctgggatcgcctaaagtcccagtccataaggcaggttccggaattgcgcgcatcaggagtagcaattgacctgaagctcacatcagttctaatatagacatcggagacaggtattcaagcagcttatatcgaaaaacgggcgtccagttgtacctcctacnagactcagagaattcgagtttgttagccatgtgagggattacgctccaatttgtgaccccggcttccggggtacagtcatgtgccacttcacaatgcgtacggggcagattcttgaaccacacttgtttaacgcgcgagagagataaagagggcatacgctgccctggtaggtcaaaaacaaatgttggcaaataacatgggcgacacgaacatcaggttagcacgtacttgc

SEQ ID NO: 676687 - DNA, 1775 bp, Homo sapiens
  misc_feature (39)..(39): n is a, c, g, or t
  misc_feature (57)..(57): n is a, c, g, or t
tgaggaggtgaagagcactacgaagacgcagcgcatcgnctcccacagccacgtganagggctggggctggacgagagcggcttggccaagcaggcggctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagtaaaaaaaaaacaaaatatgcttgcggccgaatttaagctcacttggcaattggcctaaaggaaggggtttcaattaatggccggcggttacaacggcgggcttgctggcggtccccttggtggg

SEQ ID NO: 676688 - DNA, 1794 bp, Homo sapiens
  misc_feature (39)..(39): n is a, c, g, or t
  misc_feature (57)..(57): n is a, c, g, or t
  misc_feature (1776)..(1776): n is a, c, g, or t
tgaggaggtgaagagcactacgaagacgcagcgcatcgnctcccacagccacgtganagggctggggctggacgagagcggcttggccaagcaggcggctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagttttagatgtacagagtcattgtgaacatacaatagggagttcccatgtatcttgtacccagtttcccttcttgttaacgtgttacatcagatagcacatttgtcccgtgaatgaccaataaagangcattattaaaaaaaaaa

SEQ ID NO: 676689 - DNA, 207 bp, Homo sapiens
tgtaacggtctttacctacttatggctgatcgtatgtcatgtggcagaaaccaacgtgacatgtaaacgcaattatcctccagtttaaaaaatgacaatatttcttaaaacagagactacatttttttacaagacaaaattatttcatttcaagagattagaggatttcatcacaggaaagaaacaaacaagcatgtttctatgaag

SEQ ID NO: 676690 - DNA, 1593 bp, Homo sapiens
  misc_feature (39)..(39): n is a, c, g, or t
  misc_feature (57)..(57): n is a, c, g, or t
tgaggaggtgaagagcactacgaagacgcagcgcatcgnctcccacagccacgtganagggctggggctggacgagagcggcttggccaagcaggcggctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggtta

SEQ ID NO: 676691 - DNA, 169 bp, Homo sapiens
gggtcgctctccccccctctttcttcgggttgtgtgcgtctccgctttcgtgatgtgaggaactctggggtgggcgacgggtccaactcgcgttgtcatctcccaggttggtacaccccccccccgtttccccagccacactccacggccagggtggaggcagatgtct

SEQ ID NO: 676692 - DNA, 1570 bp, Homo sapiens
  misc_feature (39)..(39): n is a, c, g, or t
  misc_feature (57)..(57): n is a, c, g, or t
tgaggaggtgaagagcactacgaagacgcagcgcatcgnctcccacagccacgtganagggctggggctggacgagagcggcttggccaagcaggcggctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagt

SEQ ID NO: 676693 - DNA, 1366 bp, Homo sapiens
  misc_feature (39)..(39): n is a, c, g, or t
  misc_feature (57)..(57): n is a, c, g, or t
tgaggaggtgaagagcactacgaagacgcagcgcatcgnctcccacagccacgtganagggctggggctggacgagagcggcttggccaagcaggcggctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagcaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagt

SEQ ID NO: 676694 - DNA, 234 bp, Homo sapiens
ccgatgtgcgcgtctcctcagtgaacaagtttacatttaaggcgagagttataggtcagccctggcaacatagtgagaccctatatctacaaaaattttaaaaagattagctgggcgtggtggctcatgactatagtcccaaatactcaggaggctgaggcaggaggatcacctgagcccagaagttcgaaggttgctatgaatgtgccggtgcactctagcctgggcagtaga

SEQ ID NO: 676695 - DNA, 1494 bp, Homo sapiens
  misc_feature (39)..(39): n is a, c, g, or t
  misc_feature (57)..(57): n is a, c, g, or t
tgaggaggtgaagagcactacgaagacgcagcgcatcgnctcccacagccacgtganagggctggggctggacgagagcggcttggccaagcaggcggctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacaggtcccatgactcaatgaacatgcttgtccagctcatctggaaaacctgttgccttcaaataccatctcatcgtgtcaacaccatatgatgacagtgcacccccacaagagtgggggggactgcacacaaaggcattctggaacttaaattgcagaccatggacaactcccgtggggcttggaccgggaccccaccttggaattgattaccccggcaagaccacgacgtgcggcacgcaagcacacgagcgcgcgaaaaccccgcgggaaaacaccacacaaagcgacacacccctctatgtgtcgttgtgcccccaaagaaaacaggctaagaatacacctcaacacacccgtgggcaacaagacaacatctataccacagccc

SEQ ID NO: 676696 - DNA, 874 bp, Homo sapiens
ctaccatgtgacttaacctgattgccctcagtttggggttgcttattgggaaagcgagagacaaagagttacttgtcacgggaaatatgaaaagcatggccaggatgcatagaggagattcatagcagggagacaaggaataggctcagatgaccccatgaaggcatcatccaagtctaagaacaagcctaccactgatataacggaagtcagcgggagctgggaagagatggaaggatagggcataagcacgacaacagcacacaacaggaggccagatgaacccatgcgcgaaccagaagacacagagtgagacaacaagcacagggaacaagcacaagaaatcaacagagccacaccaaggcacgccagtccacacaaccaacacaagataacacacaccaccaagccaccaccacagcacccacaccaagagcccagacaaccgccacagaataaaaccaagaacacacaaaccaatacccaaagacacaacagaaacaacaagcaacaagccaagcgacgcaccaagccgagcacacgacaaaagcaccggccctgacagcacaacccaggcgacaccaccccaacagcgacagcacacccaccaccaacgcccccccagcccgccgcacgatgcgccccactgccccacccacgtcagcccaagccccgcatcaccgacaggcccccgcacgcgccccacgcgcaccgcaagcgacgcacccagacagccagcgccacgacgccgcccccgacaccgacgcaccccccacccacccggagaaccacaccgcaagaccacacgaggacagccacacacacaggacggaacgaccacccccgcccccgcgacagaacgcaccagcgccaa

SEQ ID NO: 676697 - DNA, 1402 bp, Homo sapiens
  misc_feature (39)..(39): n is a, c, g, or t
  misc_feature (57)..(57): n is a, c, g, or t
tgaggaggtgaagagcactacgaagacgcagcgcatcgnctcccacagccacgtganagggctggggctggacgagagcggcttggccaagcaggcggctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacaggtaccctctagggtcctctacgtacaacatacaacagcttcgcaatagccagcgttggaggctccaagaacgagggtcctgtggctatgtggggagtaagcagcagagccaggactgccactcagagctagttcacccttgctgccgccattcgaacccagagctcctggcccaaacagtctggaatgttctgtactgtgcttctaggacagtgacttgccaggccaactctgggctggggctgtcttggctctgtcaggagggcctcttctcaggctttctctcaggaggc

SEQ ID NO: 676698 - DNA, 1073 bp, Homo sapiens
agcgggctgctccagggcgggtggggtgggctgagccggagcccgggccgccgccgccgccgccggggagaggccgaacgcgcagcctggcgctggtgtccctgtagatgatgctgcggcctgcctgggcggtctggtccccgtccgggtcgaagccagtgggcgcgctggcgatgtgagccatgagtcgctgacgtggactgctgtcgcctgtgaggccccgtgcccggcgtgtcgaccggggccccctggtgggcgcaggtgccttggacagcgcgagcatgctgcacagggtgttcgcacttcgttgctctgccctgcgtcgtggttgctggatgctgtatgatgagtgagctgccgtgcaggcaagtccatgctcgacccccgtacaaggcccgtcattgccgcgacacttgggtcccttggaacccgaaccaacgaacggaagggcggcatcgaagaccgaccggggccacagtaacggaagctacggccgatagggatgctggacgaggagacagcgggaagaagcacaaacgtaagaccgggggaccaccattgaaagacaccgagaggagataccacaagaagggggccaaagggaaaacagggaacgaagaaggggaaacgacaaagacggagcagagacaaaagaacgagacagaccaccaaggagaaacttagacaaggaagccaaggaagaaagcacacaaaccaggaacacagggacaagaaaaaccacggaggagaaagggcacagaaaagggagggaccacaaacggcgccagcgcggccagacaagcgacagcccgcagagcacgaagaaaaacggacgacagagtgggagcggcaaagaacaaacaagggaggaggccggaagagaagagaggaggacaacacgctgcggggacaggagagagaaggagggcggaggggcaggaaacaccagaaccggaacgaacgcgggcgagaaagagaagaacacgagagagaggaacacggcgaggacaagcgaacgggacaaagcagaccgcgacgagacggggaggggcaaggagccgagacgagagcag

SEQ ID NO: 676699 - DNA, 433 bp, Homo sapiens
cacagtcagacttagtagtgaaccttgggacccaaggaatgacatagaggcgagttctttgagttgtctatgtgcttatatattactgacctgtagctgaagaggctgttcacccagaatagtcaatagttacaggctctgatatggttcggctctgcgctctcacccgagactcatattgaattgaacttccataattcctagatgatgagggacagacccataggatgataatttgaattatctgagcggattaccccatactgttcttgcgtgagtgaataacgctttatgagacctgatgcttctatacgcggttcccagattcgtttaattctcattatctcttgctgccaacgagtatgcccctttaggattgaactctgatagacaggcctttgtcagctaactacactgtgaagcctttctcgtc

SEQ ID NO: 676700 - DNA, 177 bp, Homo sapiens
actgggtgtatgcctcttcagtccatctgccctccagagtaggggtttctttcctgatagttagcaggtttagaggctgcagcttgagctacaatcaggagggacattggaaggattagcagcttttaacaaatgtttaaatatttagctttgttatattgtgtagatcctgctaac

SEQ ID NO: 676701 - DNA, 216 bp, Homo sapiens
agaagaaggaggttcctgctgttccagaaaacccttaagaaaagcgaggaatttcgcagagctgaggatcaagcgcctaagaaagaggtttgcccaaaagatgcttcgaaaggcaagaaggaggcttatctatgaaaagcaagcactatcacaggattataggcagatgtccagacctgaattcgaatggcgaggatggcaagaaagctggcactt

SEQ ID NO: 676702 - DNA, 416 bp, Homo sapiens
  misc_feature (317)..(317): n is a, c, g, or t
  misc_feature (324)..(324): n is a, c, g, or t
  misc_feature (352)..(352): n is a, c, g, or t
  misc_feature (377)..(377): n is a, c, g, or t
  misc_feature (407)..(407): n is a, c, g, or t
gcacaaagactaaaggtagataaatccatgaagatgaggaaaaaccagcacaaaaatactgaaaactgctgggtgtggtggctcacgcctgtaatcccagccctttggaaggctgaggcagacggatcgtgaggtcaggagtttgagaccagcctggccaacatggtgaaaccccgtctctactaaaaatacaaaagttagccaggtgtggtgcatttataatggttggtgccagctactcaggaggctgaggcaggagaatcactttgaacttcaaggaggcggaggtttgcagttgagccaagatttgttgttcntttgcantccagcctgggaccaacagagttgaaantcccgtcttcagggggaaaaattgnttgaaatttcccgaaaaccaggcttgcctntttttcctt

SEQ ID NO: 676703 - DNA, 529 bp, Homo sapiens
  misc_feature (398)..(398): n is a, c, g, or t
  misc_feature (427)..(428): n is a, c, g, or t
  misc_feature (447)..(447): n is a, c, g, or t
  misc_feature (467)..(467): n is a, c, g, or t
  misc_feature (486)..(486): n is a, c, g, or t
  misc_feature (513)..(513): n is a, c, g, or t
tttcggcacaggggacaatggaatgagagctctccaaggtcacaggctattaactcggtcctttcatgggtaaaactaacccctttgaagggaatgcagtcccaatcaaagtcagtaataaaagccacctcagagatatggctcatgagcatgcagttcgaatgatttcttcaccacctgccatgtgcttggtactgtcctgggtgcaggcgacaacaagactcatgaaatggtgtccctgctctaattctgggacagaattagagcagattcacttcaatacaatgtgggatatttggggacagagacatgtcatcaggggcagcagcaaaagccatctggccatctgggatgaggtggatggatggtgaccataatgatgggctagtgtttattgngggcttactctgtggcaggttttgctcanngcacttcacatggcaccanctgattcattctcacaacancccgtgaagctggtactanctttatttcctttttaaagttggggtnggggtgcgactgaggt

SEQ ID NO: 676704 - DNA, 1024 bp, Homo sapiens
gaacactactaccaccatgaaatctacttactgatccttacctttgttgcagctgctgatatgctagccccctattgatgatgatagacaagatcagttaggagggctacatctagtagaggagaattctagtacccactacacaggtagtaccttcgaattactaggctaccactatctagcgagtaggctacccatcatacagcagacacagataggagtaggatgtaccagcagcgtacagctagctaccaaagtacccgacgataccgaggtagacgacctgcggacgacgcacacacaatcagacagtacactaggaacggcggaactgacacacgtatcagtcatatgcaggcccaagaactcatccagcacacaccgcaaaagtacacacagacccggccactcgtggcaccaagtagacactccgtgcactgaatccaaagctactaccattacgacactaggcacgtacaatacagatttccacgacgattagtaccagcacatactactactagacacccaactaggcaccgcatacacaaagactagactagtgcaacctgagatacccctcatatcttcccgagcatgggggccaaacaaccatccttgagagtatcttgggatgacccgaacataaccacagaaccgaagacatagcaagataggccttgggattggctcccatggatgacatcggaacgacccaaggggccttgcagcatggatgcacacggcccatccccctaacccccctgagaacaaacggcaatgtttaaccccaaaaacacaaacacaaattgaattcacccctaggaactgcataacagggagccacattccccactcagcaacaaagggaggcaacggggccaaacacaggggaaaacattaacccactatgtgacgccaaaagcacgctactgacgatcataaccctagtgggcattagtaggaacacacatagattgagagaaacaagtcaccgcaaaaaactgcaggcaaacgacaaagc

SEQ ID NO: 676705 - DNA, 233 bp, Homo sapiens
tccagtacccgagcatgcatgcatgcgtgcgggtcgacgtgtatccaccactgcgctgcatgcatccctgaacaagtaccgacagacacgtgaggagccgagatgacctccaaatatcgttaagctggagcctggtcgacgtgtattcaccaatgcggtgcatgcctccctgtacaagttccgtcgacacgtgagcaccgtgctgacctccaaatatcgataagctggagcct

SEQ ID NO: 676706 - DNA, 460 bp, Homo sapiens
ggagaccggtttatttgttctctattggcccagattcctttcacctggtaaacatcctacctcttcagcaaaggaagtcctctagcagagccctcatggacgctatctgtccccgtggcagcacctgcagtgtggaaggcagtggtgaacggacccatgcactatgtctagaagacacaaggatgagccagcccacctgatcttgttacttacaaacttccaagatatactcgggtttatttttggtctgaaaatggaaaggctcaaataatgaagtaatcttttcatattggagttttacatggccatgaaaatatttcttattctgaagactgaaatagaggaagcttgagagtcttgtctttcaaagcagctctctgtatctgcttgaattaaaagatttgtgggactgaaaatcatttaatcacataggcaacccccactttaaaaagcagccttt

SEQ ID NO: 676707 - DNA, 933 bp, Homo sapiens
ggcgggaagccgggaactgcgccggaaagtcccccggtctggggcccggtgacccagagtaagcctccaagaaggaggaggaggagagaaaggcggctcttcccgtgccccttaccagaggcttcggtgggcccacctttgttggaccctcctgggaccgggccctcagtggaactggcgtccccacgcggggggggcgtcccccgcaccgtgggggggccgggggccccggtgcgtgaccctggatgtcgccgacgcacgcccccgttgggttcccccatagggctgatggaaattccccctggtgtggacggccttcttttcctttagaaacccagagttgccttcgggggttttccaaccgcccctatgtggcctcaggccttggaggcgtttgctgcggagattttgtcacaatggtcatattacccccaccagtggacatacaggcgggcgggaggtgggggttgaccccgccggggtacctgggcacaaggccacccgtggtctggcatgtgggcaatttgccggtttaccacggacaaagcaactcctttgagtgaacatttttcggaacggggtgctcgccttccaaggggaggttccaaaaatacagcggtggaacaactgccagcttgtacatgattacacgcaaaaccaaggccagaccacggccccttggggccatcgtggggacccagaggagtggcgggaacaaacagcgggacttcaacccagaattcatcctgacggccaggcttaacaaacaacaggtgtgcacatcgaggggatgttcgtccagagtggcactaacgggggtgaaaggtctttggacatcagcctagctggtgagatgacccgctaggtgggccaagttctggggcgactgaccaggcgggacactttgccatagagccaattggaactaaagtg

SEQ ID NO: 676708 - DNA, 220 bp, Homo sapiens
cctgtaaacccttgggggcagggcaggggcgggaaaataattggggtgggttaaatcccccctgggggttggccccccccccgggccaaaaaccccccctttgggggcgggggggggggattggggggttccccccccaggggggttttttgggtcccccccccttgtttttttttaaccccccttttttttttaaaatgaaaagttttttgggggggta

SEQ ID NO: 676709 - DNA, 595 bp, Homo sapiens
  misc_feature (81)..(81): n is a, c, g, or t
gccctccccgtcaccaagaagaacgatgacattacctcccttgctagcacgggtgaacgagtccaatgcatgcaggtatgnccaccactgggcttgaagaagttcgagaccctctcttactttcccacctctcaccacagagcaattgctggccgaagtcaactaccttctagtcaagggatggattccttgcttagaatttgaagtcaaagacggatttgtgtaccgtgagcacaacaaatcgccaggatactatgatggtcgctactggactatgtggaagttgcctatgttcgggtgcactgacccagctcaggtggtgaatgaggttgaggaggtcaagaaggcttaccctgatgcttttgttaggatcattgggttcgacaacaaacgtcaagtgcaatgcattagtttcattgcctacaagccttcaggctactaaacttaatttgagaaaatttgtgcattatataattaggctttgttttctgctttcatgttcaaaacttttttccccttgaattttcggatgttttaagtgtatcatgggaatgtcgagcatatttactctatgaataattatattttgtaaaaa

SEQ ID NO: 676710 - DNA, 145 bp, Homo sapiens
tgggctgtccatgtgctgtggttggtctgacacatgggcacttcggtgcatcaacttcacagcaagggcaacatgggcaggggcaggcagtaacagcaaggggtttggcaccagtgcaccaccagcttgcagcacagcagggtca

SEQ ID NO: 676711 - DNA, 892 bp, Homo sapiens
atggctggtggcagatgcctgtcggtggcctagcccgtggtctggacctggggactccccagaatgggccctgagggcgagtgctccggagcgtcggcggaaggcgcacgggatgctgaagctttactacggctctcggaaggggaggcggtgtggagcgccgggggcctgacccctggacccgatgatctgaactggggcgcacttcgacccggaagttcacctagacaagctgcgtagagagtgccctctggcccagtctgatggacagtgagactggacatggtgcggccggaatccgggctctagacagcgaatgcagaccctggtctatgagaactacaacaagttcatctcagccacagacaccatccggcagatgaagcacgatttccggacacctggaggctgagatgtgaccgggctggccaacaaatgcagtgatcaccgacttcggctggctctgcatcagcgccacgctgcaggaccgcacgagcgcatcaccaagctggcaggggtccactgcgctgctgcggaagctgccagtcctctttgagctgccctcgagcctcacaagtgcgtgcacctgtgcgcctatgggcaggcggtgcgcataccagggagccgagcgcagggcacgtggtgcaagtatgaccagacagcttgccatcgttccggagccaatccagggaggagtgccagggtcatacaagcgcccgcgtggccagaagctgggggagcagctaaaggacgggcggacacaggcgcccggacgacgaaaagttcgcgagagcagccgccggccctggggagcatggagcagctgccagactactggcacccagggtcgttgggaagagctagaactggggggtgcgcacccggaccagtt

SEQ ID NO: 676712 - DNA, 226 bp, Homo sapiens
  misc_feature (64)..(65): n is a, c, g, or t
  misc_feature (94)..(94): n is a, c, g, or t
  misc_feature (96)..(96): n is a, c, g, or t
  misc_feature (144)..(144): n is a, c, g, or t
ctctagaggatccttattctcacccaccccggggcctgcgtaagcaccggggctgaatcggcannacaggctctctcatccccgacggggtatnangctctgtggattccaaatggcacatcaggctgcattcctccatgagcnggctcttgagcagtgacaggacataatcaatgtgttaagaagtcagagtcagtgtggaaaatgaggggtgggtggagagcgg

SEQ ID NO: 676713 - DNA, 265 bp, Homo sapiens
agagacaaaggcactatttgcagaaacagtctgacgggcagtccaaactcttgggacggaagtaacttcctggtaaactgtcatgatggctggtcgaggagaaggtcaacaggcggagcgagaggagacagagaatgctacagataatacatcacagtactgagaactgtgtggtcacacagccatgagtatgtcggggcctcctctgtgctcactaaagacacaattctaatatcatcatcatcaacattcttgaagcgccaag

SEQ ID NO: 676714 - DNA, 946 bp, Homo sapiens
  misc_feature (188)..(188): n is a, c, g, or t
  misc_feature (675)..(675): n is a, c, g, or t
  misc_feature (756)..(756): n is a, c, g, or t
gactcatccggtagccatcggacaacagtattttgatttatatatgcatagtatgtacactacttgcagagatacatactttcaatataaagatatgacgtgcacgatagctgacgtcagtttgtaaacttctagaatagagaatcatccggaggaatatcgccctcagtagacatagtaattgctanaattaagttcagcatgcctgatacagacagtgcaaacaaggcttcgcttcacttcgctacaagacgctacacatgattgtggaatcctacctctatttgaatctgcacatcgatatattcttatactacaacatgcacagttgaagtgtgcggcagcacaagaacgtgcctcaacggtctagattctacgctaaagtgcgtgggagactgcagtgaggacgataactccttctgggtctcgcacgcatgcagatctttcccgaccctccgcccaagtgttgtcataacggcctgtaattgccaacactgtctttgacaagcacgtctcccagatcgatcaggcctagggttgagcttcacagaggtgttgcacaatgccacaagaatatgagccaacaatgggccagattatattctctatgaagtatcattctcaaagtaaacaacagaacgggggtcggtattggccaacttcactctgttgtgngtgcaccaagagcagcagagttcgtaccaagacatcgtcgcagtgcgaatccaacatctatttgactgcactgtgcgacgnctagacaacacataaacgacaataatcaccccagacaaagagagagctgtcgtgaaagtcacaaacagagggcgcttcgttgaatagcaccaaaaccagtaggacgtccttaagggcactggaaacaacacttttgtttaaggacgatctgtctttaacacagactacccgcagttcatctgcgatcttc

SEQ ID NO: 676715 - DNA, 287 bp, Homo sapiens
tgtcagctgagcctcctgccctcccccaggaacatgcacgctcactttgcttccttgtgtggtggcctttttttaccgatccccttttttattgttacataccggagccgccacctcctacttcccttcacccagctgggcttcctttgttggagtcaactgttgatgcttccagtccatatttgtttcctctcttcctgcgcccacctttgccattcttatgtattgaatgtactttgtataattttagtgtaattgttattgagaatatataattttacaatcat

SEQ ID NO: 676716 - DNA, 81 bp, Homo sapiens
ggccccgcagcagctccaagaaggaaccaagagaccgagggcgggcgggtcggtctcggctgcttcaccgggttattttat

SEQ ID NO: 676717 - DNA, 140 bp, Homo sapiens
ttttgggcgtcgtgctccagtcatagcccgtgggctctgggttgctgcggacgtcacagctcaaggatggcactcagatacggccagtagtgtaccagtttgtcatcagtagccaggatgatgagacacattcatggagg

SEQ ID NO: 676718 - DNA, 129 bp, Homo sapiens
ctcgcgaacgtgttatccatgcactgggacagactccaggcttctcgtcagtgcctcgcaggatggtaaacttatcatctgggacagctacaccaccaacaaggtccacgccattccctctgcgctcct

SEQ ID NO: 676719 - DNA, 251 bp, Homo sapiens
  misc_feature (5)..(5): n is a, c, g, or t
  misc_feature (24)..(24): n is a, c, g, or t
catgntcatgccgcaaacgcagtncagatatgtaatgacttaagtgcctatcagcagatgagtggattaaaataatgtaatttatatacactctgaaacactatttggccttaaaagacgaaggaaatcttgtcatttgtgacaacacagatgaacttggagggcgttatgttaagtgaaataagccggcacagaaagggaaatagtgaattatctcacttatacatgaaatctaaaaaagttgaacttac

SEQ ID NO: 676720 - DNA, 716 bp, Homo sapiens
cactttcctcatcctttaaagtgaaatctgactttgcaaaagacattggagccaagttgggtaaacatcttggcagggacatgcttgtgttggtcagaaatgagatgaggccggccgcggtggctcacgcctgtaatcccagcactctgggaggctgaggcgggcagatcacctgaggtcaggaattcgagaccagcctggcaacatggcaaaaccccatctccactaaaaatacaaaaacttagccgggtgtggtggcgtgcacctgtaatcccagctactcaggaggctgaggcaggagaatcgctggcaatcccaggaggtggaggtggcagtgagccaggatcgcactactgcacttcagcctgagcaacagagcaagactctgtctcaaaaaaaaaatcaaaaaaaaaaaaaaaaaaaaaaaaaaactgttggggggcggcgcacagggcccccagagaaaaaaggttttcaaagcaccacttcgggtggggggcgggggcgccccaggagggttaactgaggacactggggacacagggtggcccaaggggaagaccccggccactaacgtagggggtgggtttctccccaaaaaaaaaaccggcgggccggaacccgctgtcttgaagacaaccccaggagggggccgggggccaacggggtcctaccaggggggccagcggagcagaataaatacacggcgcagaggc

SEQ ID NO: 676721 - DNA, 524 bp, Homo sapiens
ttgcattgatctacgacatgttctcacaccccatgagacatgagctcagccaggtcaattgcaatgtaagtccaaggcacatgtgcgaacagaatgatcttggtggtcgaataccaagtgtcacgcatgtgcatctcagtgaagtatataaacaaggtggcacgggctcaaaaagcccgtctcatgaatggtataataagggcagtgttctggaccacttgaaaatgcgcgtggtctaccagttagaaatccgttatatacattctcccagtccacagtctcccaaatgaagcagcacatctacacagtccgagtgaagcccaaccggctggagttgtttaaggtacggtttccaacctgataaactgtttaacagtgcttgatctatccaaatcaatataatacttggcgcatagggcaatggaccttttaaaaggctctgagattcttcattaacacaaaggcaacacatgttgaagaacaccaggaacagttatatcctaataaaaaaatgcctacttaca

SEQ ID NO: 676722 - DNA, 126 bp, Homo sapiens
ttgcagacgcttgcgcacactgcacacacatacacacacatgcacacacacatatacacgagagactacacactactactatacacacccagtggcacagacacacagcaaaaccatctcagcatc

SEQ ID NO: 676723 - DNA, 279 bp, Homo sapiens
aaatggggagaaagtcccccaaatgggggcccccggccccccctcccaatttattccctaacctgcaaacctttccaacttttcacgtcgggcctttgagaattctttccccctttcctggtttccccccctcagacccgccccgttcccccagtcccttttgtagtccccttaatttaaaaggagcccctgctcccccggaggggacccggaattttgccctgtttcccccccgcctgtgctttaaacccctttcccttattaatggtttttaatcca

SEQ ID NO: 676724 - DNA, 412 bp, Homo sapiens
aagtctattctcatagacagcttgacgttgcatggctgagtcatttgtcagagtgctctggctttaaatatacctccaagtcttaagacacatgaacttttgaggtgcaggaatcagcaattttaaaaggcacaagtcttccatccaaggtcctgggcgccctgtagatgctgttcgaacggcgatatgtgctaatgttatatgctaaaccccacaccagcgtcctccccaacagcagcgtggcggaggcattccgcatgaacggggagccctggcgtccggtggtggtttgtttcaagtcataattgcaaacgcgctctacagctcctgcgtcaagtgttggtgtttggaacgtcccgtattggcgcgtacagagcagttaaggtgcatgagcgcggcccaggaaacggtg

SEQ ID NO: 676725 - DNA, 458 bp, Homo sapiens
ccccagactcacgggaaacttaaaagccggttcacgggctgggctggcccttcctaagcctgagggcctggcacccttttccaaagcagaaaaagaaaaaaatccaaaagtgcagaagagaagaaccagcccttcaggaaggaagaacgactgggcctttccgcccaccttccgcagctcaaccctgtccggcacgctttgcatatgatgtggctgtcatcttatgtctggcctgtgctgtcacccaccgggatgtccacccacaagggcagggcctggtctaggctgttcctaacagccacgtgggtcagggaagcgttcgttggctttgggcccaagaggtggggtgtgtctgtttgcgtgtgtgtgcatatatgtgtgtctgtgggtgcatgtttgcatgcatgtgcatgtatgtgtgtgcatgtacgtgtctgtgtgcatgtgcctgcatgcat

SEQ ID NO: 676726 - DNA, 472 bp, Homo sapiens
  misc_feature (1)..(1): n is a, c, g, or t
ntctgggaaactgcaactttaaatgaaaggctgtatagtaggtcctcccagtaaccattttcttcaccatccatttcattatgatgttgatgaaaaaaggaattggttttgttttatgttgttttgtttaaagtcacagtttccaagaacctgtccatggtactgaggacttaactgtagtaatatttaaaactgcatagtgtaacttttgaattttccaggcttttattacatctttgtcttgttaatgatgcagcaaattcaggaaaacttattacagcaggttaattcactttgttcaacatttgatctcagagttttagtccaccaagttgaggcatttctctcaaatggattgatttgagacttccaggaagaaatagtgtctggttagtagttcctaaaatggcttctgatgaatttccgctgaaggagcagtggagtacatgccagtacgaaggcaagtagaaag

SEQ ID NO: 676727 - DNA, 427 bp, Homo sapiens
  misc_feature (29)..(29): n is a, c, g, or t
tcaacacgctacttcctaacatgctgatngcactttttccaatatagaaaaaaaagacttttataaaaattgaaatacattaagtcctcacataatgttgtcaataggttcttggtactgaggacttaactgtagtaatatttaaaactgcatagtgtaacttttgaattttccaggcttttattacatctttgtcttgttaatgatgcagcaaattcaggaaaacttattacagcaggttaattcactttgttcaacatttgatctcagagttttagtccaccaagttgaggcatttctctcaaatggattgatttgagacttccaggaagaaatagtgtctggttagtagttcctaaaatggcttctgatgaatttccgctgaaggagcagtggagtacatgccagtacgaaggcaagtagaaag

SEQ ID NO: 676728 - DNA, 124 bp, Homo sapiens
ctacagcagcagacctagaacacttgcgaacaattgagaaggttatctagcactactacatgaagtgaatgttcctagacagaatgtttgactaactacagtgtcattagatccacaatgtagt

SEQ ID NO: 676729 - DNA, 859 bp, Homo sapiens
gcggacgcgtgggtcgacccacgcgtcgactgtttagccaagatcaacaagcaacctatttaggtgtgccccaaaccttttcctccgaccccactaacaacccccctcctaatactaactacctgacgtcctaccccgtcacatactcatggcaacagccaatcgccacttatgccttaggtagaacccactaatcacgcgacattagaaaactctgacgcgtgctgctatgatactaaagtactgctccgtgacaagatcttcccgttgaataaatgaacgatgtcacgagccactatgaatctaactcatgagttgtctatatgcattcttgctgaaaaccagcgactgtgataccccgacgctgtggtgctaagtgcattcacctcgatagagcgcaaaccacgccatgacaccgcctcgaagctgctaaggcaccattcacctttgcctaatatctaacgaccccctagtacagtgcgtcccgttctccccttactgcatctggcgactaaagttctaccatctacgacgaagctagcccttcagagctccactcataaccattctgtactacttcacgtctccacatggcgcccaagggaactgatcaagatctccttgaggccagactatacttacagtactgaacgtaagcctttaccacaagagtatgcctctattattaagctctacaacgaaataatccgtcgtattaaccggatcctcacaggctatatgcacactccgcggtaacaggcgcccaatgatcggcaaaagcccccacaatgcggcctgggggtccaacctaagattacgtatggcccggcaaggttacttcctttaaaagtcgtagggc

SEQ ID NO: 676730 - DNA, 514 bp, Homo sapiens
aggatcccctcgtcttttgataggctattgggagagtgcctttccctgatgccggctgtcaccaagtattattttagagagacagttaacaaccacctgaccatcacctgatggttgcctgacattcctggtgtgtgttgaggtggaaccatctgtcctgcctattcctgactagctacctactgtaacaaaaaagacaatgtattacttattaagaattctcaactgggcatggtgtcacgcctgtaatcccagcactttgggaggctgagacgaacagatcacattaggtccggaattcaagaccagcctggccaacatggtgaaaccccatctctaccaaaactacaaacgtagccaggcgtggcggtgtgtgcctgtaatctcagttactagggaggctgaagtaggagaattgcttgaacccaggaggtggaggttgcagtgagccgagatcttgccactgcactccagccagggtggcagaatgagactccctctcaaagaaaaagaa

SEQ ID NO: 676731 - DNA, 335 bp, Homo sapiens
catttgtaaccctctgagataccccatcatcatgagcaggcacgtctgtgtgcagatggccgccatctcctgggtgacaggctgtctgactgctctgctggtaactagttgtgccctgcagatccccctctgtgggaatgtcatcgaccatttcacatgtgaaatccttgcagtgctaaaactagcttgtgtgagttccctgctcgtggacatggttatgctggtggtcagtattctcctgctgcccatcccaatgcttttgatttgcatctcgtatggcttcatcctttctacaattctgaggatcggctcaacagagggaagaaacaaagctt

SEQ ID NO: 676732 - DNA, 244 bp, Homo sapiens
agctctctctctctctctcgtgggctctcagagaccagcctgggcgacagagcgagaccccgtctcaaaaaaaaaagggtgccctcttagattatggggaagttcattgggggggaccccatacagtttttttcacaggcctgccatggtgacccatgcctgtttccccagcttttggggaggccagggcatgagggttgcttgcgctcgggaattaaagaccagttggccgcctgggcaacat

SEQ ID NO: 676733 - DNA, 213 bp, Homo sapiens
tctagagtatccctacactttgattggttcagccctaaatccaatatccaataccagcctctctcttgagagtttaacggtatgacaggagtggctcacgtagcaaattaacaaatgaagtactctgacttaacatatctgtttctttcggatacttcatcagggttgcgactggagacaaaccggtaccgatgctcgaatcctgctaatcgt

SEQ ID NO: 676734 - DNA, 380 bp, Homo sapiens
ggacacggcgaggcattcattgtgaggtctactggatgagggccatagttgagacttggagacattgatgcatactgtgccatgtgccataatttatacatataatgtctcgttgactgtataccttgtggttgaagaaatgtaatcgtgaaaggaagagcagatggtatttattgggaggcctgttgcttgtaaagtataagctattgtcacttgtaaaccattgaaggccattacttactatatactgactcatttgtatgacttgatttcactggtagactctgttccactttcaaccttgcatgtcagattctgccatgagtatttatcggattctctgatgcctgagactgtacatacagtgaccatgtgttggt

SEQ ID NO: 676735 - DNA, 632 bp, Homo sapiens
tcatttccaacctacaatgactattgaagggcaggccgctcgtgtgggcccatcaagttattcccattctcataaattcctagatgcggcacattcccccagttgagtagccaagacgattgccctcaaaggacatggtgctgtatagaaccggtaaatgactttctcgtactagagcgcacagagagttacgcatgcacactaaggaagtcgttcagatgtcatctcaatggtcactgttcgtaagtccatcttggacctataatagttatgtgcccatatcagatagtttggtataacgattaggtaaatgtcatatcctatcggactgggcgttttgcaccttgaggtgggctgtaccatatcctacgagtgacagatgattgttcctcaagtacttgcatctgtgcagtgcatattccttagtgtcagtacctcaaggtctgtctgtcacgttcatgggttgatcgttaaggcacttaattccatgtgtttcagctcatagtacagtcctcatttcctatgacaacatagttatgatactgtagtagcgatctgtaggttcatgcgaatagcatgtcctatgacgccctatttcagtaggttcagagtttcagttcttcttggtaaac

SEQ ID NO: 676736 - DNA, 381 bp, Homo sapiens
aaagttcaattaaaatggtttacttaggtcagctttcccattttacagataacaaaactgaggcccaaaaacaaggctaacatacccaaattttcacttgtgtatcagatatttaaagctgggaaaggccttaaactatcaaaggttgaagtgttacatcacaaaattattggcagtgctggacccaaaactcagatctgaaaaatacccttcactgtgagccatgcagaaccattatgaccagactttgatattaagtgaatttgtcctatgtgtatgatactacctaatattgctgtactctaagttcttttaataagtttttaaattatctttcatttatagattctgtcaccactttaaaaaaaaagttggcggccg

SEQ ID NO: 676737 - DNA, 193 bp, Homo sapiens
cggggtacttagccaggcatggtgttacgcatctgtggccccagctattttggaggctgaggttgaaggatcacttgggcccattaggcagaggttgcggtgagctaagatcgtaccattgcactccagcctgggtgacggagtaagactccatcttaaatacaaaaaaagaaaatataaaacaaaaacatgt

SEQ ID NO: 676738 - DNA, 882 bp, Homo sapiens
  misc_feature (869)..(869): n is a, c, g, or t
agctttatcaactgaagagtccatttaacagcataattgtgggaagactggaatagggctgaataaatgtgttgaatctctaattttatactttcttttcctgaggaacttgatttttctggtccctggatcgccttgtcaaaatggggtctgttccttttactaccactctttgagtccatatatgaaatcattaaagtgggatgatcagttttttataaaaatatatattttggtccaagaaaaaaaaagggcatacatatgtgattattggtaaatcaaaggtaacgggaatgtatatacttggctaagggttccagcaacagtgcttattatactatccaaatttttatgggtacacaaaacctctttaagcaatgggtgatgcgccatgggacttttcccagtgtcttctgctgtaattatcctgtgcagaacctaggaagaacatctcttttcaggactgctctatggtttccttaacaagaaaaaaattcgtgtgggtttcaagcagtcattatttacaattggcggtgattaacttggaaggcttcctttccggtttatcccctgtaagccattcactttacagtcagggaaccggtccggacaaaatatgaattcaatccctccctggcgtgtctgcaaggggtaacatccattaacaccctttaagttaaatataagtggtgcaccttcactgcggctttagacttaacacagacatcgcacggggtagctgatacccgccgtgagcaatggtccatagggggtaaattatgtgcggaccgggcgcacactatgcgatcggcagggaaatggacggttgtcgggttctgatgccgaacgcaggggacattgtccgggcnttccacaaatgtt

SEQ ID NO: 676739 - DNA, 200 bp, Homo sapiens
ctcggtcctcatatctctctttttttgtctgaggagaatctggttcaacgcttcactttacatactgcttgtgatagggaagcaatggaggagatgctccaccagttgttggctgcaatttagcaagggccacttggcacaaatttaatggctccatacaccctccagaggcgcctttttgtcccagattctattccaag

SEQ ID NO: 676740 - DNA, 119 bp, Homo sapiens
gcctccaggattctgttcggcagcctgcctgattcttaggggagagcagagacccatgttctgaacatagaaggagggtggtgggaagagtacgaggaggaggagcaaggaagaagaca

SEQ ID NO: 676741 - DNA, 298 bp, Homo sapiens
atccccgctcagccaatggtagatgcttcagtgaggcttctggatgagaatggctgctactactagggctatgtggctgattgaagagtatgctatgagcgatttcagcgtctgtttgtctgtaggccgcatagagcttgttattaacttatgcctcatagggtatagtacaaggtaaggggtaggctattgtgtgttgtcatgggggttgagaatgcagtgtgaggcgtattataccatatccgcctagttttaagagtactgcggcgtgttctattgaccccgcgtactgggggct

SEQ ID NO: 676742 - DNA, 254 bp, Homo sapiens
ggattccctttctttccttttattttaaaaaagaacaggacccctcttttaagatgctgtcttacattaatgagcctctaatggaaagaaggtatgagttgccctgaggattagaatagtggtgcgttagtggccttatctataaataccctccccttaattgaaagctaagaagggaatgttaatataatatatatttatatttgatgtaatatgggcatctgcagattttaataaacaagggctattgctga

SEQ ID NO: 676743 - DNA, 150 bp, Homo sapiens
gctcttgcttctttctacgtgaatgaccgtcatatggtaaattaacctaatcatgaccagatgacctttgggcaattactaaccaccaaaaaaaaaggttatcctcttcttctgagtagagactctccctaaggtttttatttcgatggg

SEQ ID NO: 676744 - DNA, 548 bp, Homo sapiens
  misc_feature (56)..(57): n is a, c, g, or t
  misc_feature (170)..(170): n is a, c, g, or t
  misc_feature (483)..(483): n is a, c, g, or t
  misc_feature (542)..(542): n is a, c, g, or t
aaggggggctgtggttcttatggctgctcccagtccagctgctgcaagccctgctnntgctcctcaggctgtgggtcatcctgctgccagtccagctgctgtaagccttactgctgccagtccagctgctgtaagccctactgctgccagtccagctgctgtaagccctntagctgcttctcaggctgtggatcatcctgctgccaatccagctgctacaagccctgctgctgccagtccagctgctgtgtccccgtgtgctgccagtgtaagatctgaggctctgactgcagactgcaggtggcctgactggtgaagggcccggctgcccagcttccttgccctgggttctctggtgctccactgtctccactgtgtcctcactggcttcatccactccacaccagtgctcccgaaactgactgaggaccccttctggctcattgcctactacttctcctgaacttcctctccctgctcctnactcatttaagatcaaagcggccactgaggcccagagcagatagacccttagacctganagtggt

SEQ ID NO: 676745 - DNA, 294 bp, Homo sapiens
agaatcgagctcggaccccccgactaggccgacagcatatagaattccttattgacgtacttacttgcctgattggacatttgcctggagctcatgtctgagaccgtctggtccgccccaggacctgcacattctcccagtgtctggagtaggcccagaaacagcaggagagtcttcatcatgcctccaattctggagtcttggcaggcctcggtcagcgggaccctgtgtccgtgccgctgccttcctggggacgaccgccgcagtcggggtaggtcggggggggatcctcta

SEQ ID NO: 676746 - DNA, 219 bp, Homo sapiens
  misc_feature (84)..(84): n is a, c, g, or t
gtatctaggatccacggaaggtgagcacatggcatgaaggctgtacatgacacggaaggtgtacatggcatgaaggtgggcatnggcacaaaaggttgggcattggcacaaaaggctgtacatgagcacggagggctgaacatgggcatagaaagttggatacatgggcacggaaggctcatacacggccaaagaaggctagtcacatggccactcaat

SEQ ID NO: 676747 - DNA, 407 bp, Homo sapiens
ggcccggggaatttgggggggtttatggggggcaaatgggcccccggggattcggaggttttttaaggggaaacgccccttttggggcacccgaggggcaggcctattgggcccccaggaccaaagggggtggcccccaaaaggggggggccggggcccgccccagccccgggccttcccgggccgcccccggggcttggccctgggggggggtttttttccgttttccccgattttaaagggggggtttggaccaattcctttatttccgcccgggggggaggccttaaagccccctttggccccgtttttccgccccttaaccccggccccgggggggggggggggggttttttgggccccggggttttttttaacccgcccggggaccccccggggccccggga

SEQ ID NO: 676748 - DNA, 935 bp, Homo sapiens
gttgtccggtatgtgctgggtgaagcgggatcgcgcaggtctgcatgaggatctcggcagcctgagcgggaggtgcgagcaaagaatggtcgagttggattctgaggaccggagtgagcctgtctcactggctccgtaccatggatgactcattgaactagtggagtggtgctggtagctttggacttttgagtaaagcatgtgttcgtatcattcccatctcactacagtcaatgcattgatgcctgctcatgcgtgtgtggccaagatagctttcaaggaccggggttggaaggtctcacgcctacattcactagtgtccagtttaggcaccatgttttgctctaatctccacacacctctaagttaatactggcttccatgacaatactatgagatcatcgattccctcattggaggatatcacgtatgtgttgaagcccactttgcacaaacgcagcacaattgggcatactgtggacaatgcgaagcccatcattgtcccgggcatatcgatggtaccagttatctgccgggtatagggggactgaataacataaaggccagtgattatgccgacgcggtcttcaggctctatctaatgttgctcgtctccggaactactttcgtgaggacgagcaattatagaaccatcaaatgtctccaggggatattcatgtgcttgttggggcaaggcgtctgggagagctgatgagcaaccgcttggcaatccgtcgacatgtccaggccatgtgttttcgccatgagatggttcgggcgatggcactttggagttagagagactttagatcccaaccaggggtgggccgagttctcgcttgagcgaatggctggccagtctgggggcgcgacaaaaatcaaacttttccacgttcccggtcgtgcagtctcaaagtccactgtcgggaaaactg

SEQ ID NO: 676749 - DNA, 99 bp, Homo sapiens
aacccccccccccccccccccccccccttttttggggggggggtttcccgggcccccccttttctttccctttcaattaacccccccccttggtgggga

SEQ ID NO: 676750 - DNA, 284 bp, Homo sapiens
gggggaaccccttgggggggggtgggccccctttggggttttttctctttttggggggggggggggagaaggggaaaaatttgaatcccgttaaattttttttaaacggttttttagggggccggtttttggaaaaacccggccccctttttttttttggttttgggaaaaaatttttttgttggggggaaattttgggggggggggggggggggggggggttttttttttttttttttttcttttggggggggggaaaaaaatgggcccccttttttttgtta

SEQ ID NO: 676751 - DNA, 1302 bp, Homo sapiens
tccagcggcccctcggctaccctcgtgtccagggccgcgagcggcctgccctgcaccatctggctgtccctgactgcctggcctgtggccgcggtgctgcatgcccgctggtgctctgctgtatgtgctgcctgacctgcgtccctgagacactgttcgcctctatttgggcgctcctgtgcttagtgatgtgctgcctgccatgccatgcacgtggtgcccatgctgtgatgcccactggaatggcgtaggcacctgtgatgtgaatgccttgtgttgctttgccctgtgctgctatccacgcaagtcgaagccacttactcattcagctcggaaggcgccaaagtcacaccataactcatgactgacaggtgcgtggctcgtccctgattggggcaaaaacccgtgaggtgtgatcccttggctcatgacactgaattcgctttgtgactgcgacggcgtggcgaaaccgtgtgtacctgaatgcaactgccaccgacattgacaagcctgtgctttggtgaaactgcccctttatgctacagcgccccatgagaacactgcgccaatgtggttctgggccatgacaactttccaaacagggaaccggactttgaaccttttcctgaccaaccgtggaacttccttccaaggaacgcccttcgcggggctggcctgtgtgcctaaaccgtcgcctcgtgtgacgttggtgatccaacgccaagagacggttcccaactgcacacccatggaccccccttcaagtgtgccccttcaatttccaattggtgaccgacgtgcacacggcgttcgactttccacaccccttttcgacgcactccctatatgcccctgggcccccaattccccggtggagacacccatggacttcctattccctgctggaacggctttggcacgcggttccctttgccaccagggacaacttctccaaacctttccggcccgataacaaattcggataggggccatttccataaccggggtggcccctatcctaaccatggtgaaaccttgtcggcaggacatcaacggcatatattggccatttgcgacaaccaaccactttgtcgcattgtgcccggcgcttcccccttggtgaacccacgctgttgccttagaaacaacaacgtggcccaaagcaagggcaacttccccctgaacgggacagacttccctgtggagggcaacacgttcacagcacttccgtccgtcgttcctccccagagtggcttttgagataggtaaaccttcctgaccaacgcaaactgacaccctcct

SEQ ID NO: 676752 - DNA, 142 bp, Homo sapiens
tcatagatggagtgacatgtctgttatttcacttaaagcgctaatcagagggagtgtggtcctcagagtgagagaaagagatagagggagaggagggaggaggaagaagaggaaggaggagcaagaagagaaggtgcacgca

SEQ ID NO: 676753 - DNA, 684 bp, Homo sapiens
ggagacaacaaggaccacgggaggaggtgtgggagagaagcgccggagcagcgatcgcccaggaccaagtccgtgtccaggcgttacggtctcttggcctccatctttgggtgcgccttccgggctgtctagggcgagcgaaggctgatggtgtcctagcgagccagggagagtccaggccgcgatagggagggaatctccctcgactgaaaaggattctgacaacgaaaatgaagtcaggccctcatgaacatgagagtgtggattgcctgcgtgggttattacggtgtagacctagtcgcggggagcttggtaagttcgcaaggaaccctttgatggaggcttctcttagtctaaagagtagaggatgtcgtgctggaagtcattcgagtcaagggttgaaagaaagtcactttgattaccaggattgagaagggagattgctgctcattgtttgttgacccggtatgttttgcttagttagatgttgggttccaagtgtaaagtgtcaggggacccttcgtgggaataatttaaagggggcacaaggaaggataaagctggttggtgtctgggaaactttgggtttgaaactgggtctacagaagtgacggcgattttgaccctggttcaaaccggtatctttgaaaggattggtccaggaacaacgtttggtggatgacc

SEQ ID NO: 676754 - DNA, 533 bp, Homo sapiens
  misc_feature (191)..(191): n is a, c, g, or t
  misc_feature (202)..(202): n is a, c, g, or t
  misc_feature (234)..(234): n is a, c, g, or t
  misc_feature (266)..(266): n is a, c, g, or t
  misc_feature (481)..(481): n is a, c, g, or t
  misc_feature (515)..(515): n is a, c, g, or t
tattcctaaatgtatactcccccgaaaattcccttctaactttttcattccattatttaacatttaacacctattctgtgcctggcatggtgctagattcctgccctatagcagttacatcttgggaggaagacaggggaccatggctgccgttactgtttgatcagtgtcagcctttgctagtgcaactnacaggcacccnactcagggtggttgcagagagctgagatgaanagttcagtgcaggtttccaggaaataaatctnaaactgcactttgaaagaagagggaagccaggtgcgggggctcatgcctgtaatcccagcactttgggaggccgaggcgggcggatcacctgaggtcgggagttcgagaccagcctgaccaacatggagaaatcctgtctctactaaaaatgcttagccaggcatggtggtgcatgcctgtaatctcagctactcgggaggctgaggcaggagtnacttcccgggaggtggagattgcagtgagctganattgggccattgcacttc

SEQ ID NO: 676755 - DNA, 1039 bp, Homo sapiens
  misc_feature (672)..(672): n is a, c, g, or t
  misc_feature (680)..(680): n is a, c, g, or t
  misc_feature (682)..(682): n is a, c, g, or t
  misc_feature (686)..(687): n is a, c, g, or t
  misc_feature (690)..(690): n is a, c, g, or t
  misc_feature (698)..(698): n is a, c, g, or t
  misc_feature (711)..(711): n is a, c, g, or t
  misc_feature (715)..(715): n is a, c, g, or t
  misc_feature (722)..(722): n is a, c, g, or t
  misc_feature (735)..(736): n is a, c, g, or t
  misc_feature (739)..(739): n is a, c, g, or t
  misc_feature (744)..(744): n is a, c, g, or t
  misc_feature (756)..(756): n is a, c, g, or t
  misc_feature (759)..(759): n is a, c, g, or t
  misc_feature (761)..(761): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (773)..(773): n is a, c, g, or t
  misc_feature (781)..(781): n is a, c, g, or t
  misc_feature (811)..(811): n is a, c, g, or t
  misc_feature (814)..(814): n is a, c, g, or t
  misc_feature (819)..(819): n is a, c, g, or t
  misc_feature (858)..(858): n is a, c, g, or t
  misc_feature (954)..(954): n is a, c, g, or t
  misc_feature (1009)..(1009): n is a, c, g, or t
tttgtaatgcctttctgcaagacccttcaccggtgaccgcatgaaaattgttccacacctggaggttagccttgaatccgaatctcggggattcctgcagttgcatcacggcatgaacggttcggtgcagtcaagtaccccgactgtcccagtgtaagcatgcacaatcgcagttctgtactcgccaccgtaacagtcatcgcgtgtgaggaaccaggatcatactcagcggcatgcattctttcatagcacgatacactgcgcactgtgggcaaacatcttcaccctcgcttggaccaagttgtagaaggcggttaccagtcatccatgtcgaacgcaggtagctcatccagtagtcacgttccgccttgaagacctgggcactcctgaggtcttgggattgcgtctggtgaggtctatttcacccaccgtttgacagggtcagtcaattcacggggacagtgctagaggctgcgtcatcatgaagaccctaccgcctttgagtgagaatccctgctgcccacagtggagcttgccatccagagaacacgggacgatttctggaccagttgggcacactcgctggagattctgacagactgttgatgatcggagaagaagatccgcgactcaggacaggaacacgaggcggatggaggcgtcttgccaacncggccccngncttnngtnaccagccnatcagcacacggntccnactgagnatctcagaagatnnggnccgcntctcctccatcntcngncaangtncanangcgagggnacagcccagcgccatcctgaggatcggtgnggntgagnggggcttccaggtggcccttcccggcacacattccattngttgagccacagtcctgccccccaccccaccctccctacccctccccagtctctggggtcaggaagaaaccttattttagttgtgttttgtttttntatagagccccaggcaggctagtaaacaagttttttacaatcgaagagggccaancaagtcagtgctagttgctcagttttttct

SEQ ID NO: 676756 - DNA, 607 bp, Homo sapiens
ggcgcagaagtgtttctctcctcatcgtcggcggccccataacccctgtctgctctgccccaggagcaccctccgtccttctgtcgtgtgaagcgaccccccccttcctgattgagagaaccccccctgcaatgtttggctagaatcatttggtcggcggcggtaggctggcctccagccgtccttagttgttcgtcctgcgtggaagaaaggtgattctccttccaggggtgggcccacccaccagctggtctcctatgaggcgcccgctctccatcactatcttcacccgctcacaacaattgtgcgcgcacaccctctccgccataccccctctcttctgggctgcataccgcgctcctacacacacttttctcttccccgacacccgtcttataatcttcgcttctctcaccgccccccacacactcacactgtgtgctaataaaatcctctgctctctatacattgcaatacgcccctatctattatctcctgagaggctttcttagcgcacccctcactagtttctccccataatattactccgggccccccacatatatgcgcgtcttttctcccgcccatcaaattaaaacaaaaataa

SEQ ID NO: 676757 - DNA, 207 bp, Homo sapiens
agacaatattaagataaatatcatcacaatcataatctcagtaatcaggacacaaacacgcggaaggcgcaggtcctctgcctaggaaaaccagagaccttggttcacttgtatatctgcgtgaccttccctccactatgtcccatgaccctgccaaatccccctctgtgagaatcacccaagaattatcaataaaaaaataaatta

SEQ ID NO: 676758 - DNA, 339 bp, Homo sapiens
  misc_feature (115)..(115): n is a, c, g, or t
tcccccccagccctgcctgcctgtggttttggccagggagcaaaccattaggggccctggcacatgcccaaattgatcctttgggtgacagttttgtatggaaaacagatgctgncagaattgtagacttccatgccacacaaaaaggctaaatatttactccaatgggtttccagttcagtttgaagtcaatcaaatttttggattttcggggtccccctgattggttttgctaggaattctgtaaattggacatttgcaaaatgggggttttttttccttttggacaatttgaaactgatgcttcccctttcctttaataaactattcaaaatcaga

SEQ ID NO: 676759 - DNA, 283 bp, Homo sapiens
  misc_feature (25)..(25): n is a, c, g, or t
  misc_feature (27)..(27): n is a, c, g, or t
  misc_feature (29)..(29): n is a, c, g, or t
  misc_feature (57)..(57): n is a, c, g, or t
  misc_feature (67)..(67): n is a, c, g, or t
  misc_feature (159)..(159): n is a, c, g, or t
  misc_feature (161)..(163): n is a, c, g, or t
  misc_feature (166)..(167): n is a, c, g, or t
  misc_feature (170)..(171): n is a, c, g, or t
  misc_feature (173)..(173): n is a, c, g, or t
  misc_feature (194)..(194): n is a, c, g, or t
  misc_feature (208)..(208): n is a, c, g, or t
  misc_feature (237)..(237): n is a, c, g, or t
cctgggtctagccagcctgggctgnangngtcaccgtggcttctctggcctccaggntccccctgcnccctcctggctctcctggtgaacaaggtccctctggagcctctggtcctgctggtccccgaggtcccctggctctgctggtgctcctggcanannnggnntcnncngtctcctggctctttttggcnccctggtccgggcncccgccactggtgatgctatcctgttgtnccccccgtctacctgggactcctgtcccctgtctcgagccgttccg

SEQ ID NO: 676760 - DNA, 404 bp, Homo sapiens
cttttttttgtttaaaaaaagaaaaaaaacttttaaaaaatggggttataaaaggtcccccaagggggggtttaaaatttttgggggggttaagtgggccttttcacaacagggtttttcctttgggattttttattttgatttttgcccaacccccctgcggtttaaaaggccccttttaaaaaaatttttttcccaaaaatggcttgggccccgccccccaatggggggaatccccggcccctttgggtttttttttggaattgcccttttttattggaattttgttcccgtttttttttaaattttttttttttttcccgggaaaggaaaaattttgctccttttttaccttttaaagtggccaagttttttttttccaataaaattaaatttgtccccca

SEQ ID NO: 676761 - DNA, 312 bp, Homo sapiens
tccataactgtgccatcaacagatgaatgcatacagcaagtgtggtatgcacacaagggagtactattcagccatataaaggaacgagatacagtcattgcaacaacacagaatgaacgggagatcatggtgttaagtgaaataagtcaggcacagaaagtcacacagggcatattctcactaatctgtgggatctagaaataaaaatgatagaactcacggagatagagagtacagggatggttaccagaggctgggaaaggtagtgtcgggggaggaaataagggtggttaatgggcacacattatggag

SEQ ID NO: 676762 - DNA, 187 bp, Homo sapiens
accgctgatcgcttaaggaaatagggctcacaattaaggagtaagtaggtgttttatttaagactaggtaatactcttcatttatttatttatttattttgagaccagtctctgtagcccaggctggagtacagtggtgcaatcatggctcactgcagccttgacctcccaggcttaagcggatcag

SEQ ID NO: 676763 - DNA, 361 bp, Homo sapiens
cagagtccaaacagtgcccagagtccaaacagtgcccagagtccaaacagggcccacagtccaaacgggccttactttatcaaaggtttaagaaggacatatgggtcttatatgacaaactgtttccttcattttaacaaatttccaataatcctgtcaaccatatttctaaattttcccccgaattctaagcagagtctgtaaatcgcaagttaacttatgcacgcttaactatcttaacaagctttgagtgcaatagatcgaaaagttcaaatctgaccaagatgttgatgttggataaaacaattctttgctccccacctttaagttgccagccctgctacagctacctgtggagcaa

SEQ ID NO: 676764 - DNA, 151 bp, Homo sapiens
  misc_feature (11)..(11): n is a, c, g, or t
  misc_feature (92)..(92): n is a, c, g, or t
  misc_feature (97)..(97): n is a, c, g, or t
ggggtgcaggnatttggacgagatttaaacccaaaacaaaaaaaatctacagtttgtcacataatcagtgacaaaaaacactaataacagtngtttntctaaatcacgcactaatacatttttttttaatctcgaagggcaagttatgtga

SEQ ID NO: 676765 - DNA, 219 bp, Homo sapiens
ccgggggaaccccctttttttttaaaaaaaccaaaaattttttgggggccaggggccggggccgtttgttcccccttttccggggggggggggcggggaatggggtcccccccggggggggggggttccttttaccccggtttttgggccccccccccccctggggggccgggggggaccccctttcccaaaaatttaaattttgaaatttaaaaagga

SEQ ID NO: 676766 - DNA, 201 bp, Homo sapiens
taatgtgtggtgttatgaatcgacataatcggaaagatatacccaaaggcatctaacgggcatgatttcatcctcgtcgcgattgactatttcaccaaatgggtaaaagctcagtcatacgcggttctgaaagcaacacatgttgcaaagttcattccgaataacattatgtgctggtacggaatcccgcactccatcaca

SEQ ID NO: 676767 - DNA, 128 bp, Homo sapiens
gtatgttatccccaacactgttattttcggtttttgtttgttgtttttaataatagccagtatgaagtggtatctcattgtgattttgatgttcatttacaaataattagtggtgtgggcgataacat

SEQ ID NO: 676768 - DNA, 659 bp, Homo sapiens
acacgccacgagcccgcgggatcctcgtgagagtatgtgaacccttcccctccgctctcagccggagtgccagctgctgtccagcctgtgtgcgctggtcttctgaacacctgatttcaaatcatgtgtccccgtgtggcccagctgtcacttagtgtgaatgtggtgtgcatttttgtggttgcttgctaaatcactggagatgcagccttgtgcgctgcctggtcccaacttgatccaatggagccttgagaaggagatgatgattcatgtaccatgtggtgcctggcctgtggctcccatcctccgtgaatctgcaaaatggctacttcttcagaaataatggtggagatgggatggcaatgagtgccatgagatcaatggccctcgagtattaacttgagcatttgggcacaaaatagacactttttggattttcccgtcttattccaacaccaatggatgagattatcaaaatgatgtgttaaattaattttgtaccggccgggctgcggtggcttactgcctgtaaatcccaacactttgggaggcctgaggcggtcgaatcacaaggtcatgagttcgaaaccagcctggccaatatggtgaaacccccgtctctactaaaaatacagaaattagccgggagtggtggccga

SEQ ID NO: 676769 - DNA, 109 bp, Homo sapiens
ccgagctcggcacccaggtgggcgcatgcgtcgactccactgacctggcagtcggtatcgagcgggtacgtgacgccaactaagccaccatgaagcgctggcacgagcg

SEQ ID NO: 676770 - DNA, 283 bp, Homo sapiens
gtagccctcttactggccaacatcaacacccagctgtcgggcatagccaatgctttccggacagtgcgccagctcaacgacctagccagctactttaaaggcatccaggcgcatgtcatctaccagatgccctccaccgccatttcttggtctacttatgagcttttcaagcactttctcacccggccccagctggaaaattaggctccatactaaaggaagggatcataaaattttttctaaaagtcattctttgactgtgtccagccccttggtctctctc

SEQ ID NO: 676771 - DNA, 669 bp, Homo sapiens
  misc_feature (351)..(351): n is a, c, g, or t
gggccatgtccgctgccggaacgagcatatctcactggtcccagtgaggagttgaagctgtactgttatcgatgagatatatctgcatgggaatccaccacatgtactgcgtgccgagagctcgcttgactcgggaactcacaaatcctgtaaacatctgccatgtgacgtagctctacatactgatataagtgcaaacatacagacagacgtttcactgtgtacattgatcgacctacgtatcgcttaggtaatctatggttcacgtgctctattcagactaggttcagcagatggccaccggtctgatgtactggacctagatcagcttctaccatcttgctcgactgntgctcgatgaacagaatcatgaaaggtatatgagtgagtacactgagggtgagttcgactctgaggaattcaggtttaccgtacgctggatatactctcagtatactcgctcactgatactgattgattgcctgcgtcatgtaggaactgagatggttcgctagcgtgtagtgagacacgtttcatgacttcatgaatctggagactgatgtgcgcgatgtactgagcctctaccgtgttctagactcaataggccttgaccgcagtttggatcctcactttcgagaggacccgggtccatggcttttcccgctttgt

SEQ ID NO: 676772 - DNA, 292 bp, Homo sapiens
  misc_feature (44)..(44): n is a, c, g, or t
tgggaaagcacacccttcctttattctcttaggatcctatgcanttccttcatagtcattatttgtataaatttgttttcctgttcctttgtcccaccccatctctgacccaatttaagccctagttgggaggagattatgacttgttttataaatctgtgtgtggaaatacctaccgcatttctgcttatataataatttataatagattaatatatgggaaatgaattttatgtgggaaatgaattttttttaatcttcaagcattgccttaaattcatggtgactttcc

SEQ ID NO: 676773 - DNA, 478 bp, Homo sapiens
aaattcactcatactacaagttcagatacgcagagaaaatacaaattctttattgtctatagctgattgcttcctgccaggtctctagtcattggttaacagaaataaacaagtgtattacatagtttagtcttagtcctatgcagtaatttctacagttcatttagacagtagcctctcatttggagaaaaacacagtctctcaggtaccctttagtcacttgctttttgttgattgtttttaacccatgtagctgaaagccacactgctaaacactataacttaaccttcatgagctcctttagagataatgcttctgatgtatatgtcaccatggtaacaattgcttaagttgttttcaggaacttgggggtcagcttttgtccaacttaaaccagttaagacacgtcgagaaagcagacacatgcgacgcagcgtagccccccccccccccccccgtcaccgcaccccctcccg

SEQ ID NO: 676774 - DNA, 168 bp, Homo sapiens
tgctgtccaggggcacagagggtacccagatcaccacgactataagcatatacgtgaacgagttgacaagcctttctcaagtagaggtcattcttcagcatagtgcttgctgacattgccagagctgagatgttgttagaagaagctaaaagagcaagcaaaagtgca

SEQ ID NO: 676775 - DNA, 553 bp, Homo sapiens
cagacttgttctgccaaacagcttatttgtagtcagtgcagacaaatcatgcttcatacgcattgttatataaggggaagggggaaggtttatgacaggatttcagagaccagagataattaataattaatgtacagtacactaaaaaaaaccatctgtaccccactattaataagtacaaaaaaccctaaggcttaacgtcatagtactggttattcataggataattatacgttgtatatatagaaaggaagtgatatgagtgatgaacagttcatttgtgctcatagttaactacgtaaacatgatactgagtccagttaaccaccaggccagtgcctgctttgatatttgtaccagatgtgtttggtggtcagcgtttaccatgatccagaatattctaatttttgaaggtcaaaaactttgagtgtttttataaaataacaaaaaactgaaaaatgcagaaaagtataaagatggtaatctctgtaggaaattagtccccattatttagctgtaaaattataattaaaaaaaaaaatctttgtttcta

SEQ ID NO: 676776 - DNA, 1481 bp, Homo sapiens
  misc_feature (544)..(544): n is a, c, g, or t
  misc_feature (684)..(684): n is a, c, g, or t
  misc_feature (842)..(842): n is a, c, g, or t
  misc_feature (1076)..(1076): n is a, c, g, or t
ctggaggacacacacgggagagaagccttacacgtgctttgagtgtgggcgaaactttagcctcaagtccgctcttagctgtacatcagaggatacactctggggagaagccttatgcatgcacggaggtgtggcggcaaggcttttatcgacagataatcacgagtctcattcagacaacctagaggactacatcacaagtgatggaaaagccctatatcgtctgctgcgagacgatgtgggcgaggctttatagctcatgtcaaccgctccagctaccaccgtgaggatagcagcaactacccacacgtgaaataaagatcctataagtgatgctgtccagatcaagatgctggggacgtagagcctttttgttgtggattgaacactccaaaactccttcaactcagcaaccaattgcaggacaagaaccaccagttactagcggtgaagaaatgctcattaatgattgtagatggggagcgagcatgttcgggcccgggcggacatatacgcgcctcggcggataacgaatagctctccnttccaacaacgatggaacgcacttggagattggagacctatccaatctaacaaaagggacaggaagaaaaacccctttaccagccaattgccaagtttccgaacggtggtagggagcacgaaaaagcatttttaacggcnccaaaccaaaggggtcccgaactttccatccaaagaccttttagcgagatacaagagagggatataccagccctccgcgggggcggaagcacaaagggcccagttatagttgtcacattgccgtgtggagcacagtatcgattaggggacaacaaganaggccatattatacagaagcacagaaaaaaaggttccaccgagtggccggttcaagtctaatgttaacaacacaaggaagaaggattaaccacacattcggcgggggcaaacacgagcgccgttttcatacgagcacgggggggccaaacggggcacgttggaacgagcactgggtggaattatttagaagggcagaagacagaaagtggttacgacgtcccatcgtcgaaggngcgcaagcaacacaaagccggggaaaaaaaattgggctttaagaggggaacgaaaacggccccgtttgcgtgtgatagttaaaaaacgggttacaattggtgggagacaccatggaagcactctggttaacactgttgggaacccatttccaagtttcaacccttaggttaccaacaggttgggttccaagggaaggggacccaaccaactttcagggggaaagagaaaagcccctttccaattaggggaccggtgggacagcaagtgtacaccgcgtcgatcagaggccttggggcaacggttggggcgcaccccgtttacacaggacagacagtaaccttctggggagaggttccacaaaatcctacatccccacgttgtggtaacagggcccccaacaccac

SEQ ID NO: 676777 - DNA, 192 bp, Homo sapiens
  misc_feature (187)..(187): n is a, c, g, or t
acagaggttccaagcttacgaggcattgcaatacatcctccatcacagactgtttctgatgcagagaaacttctcatgccagactcatgacttctggaaggggttgacctctttgtctcacagtgaaggagaccatatcaagatgaagtactcgttctctggctgaccactagccatatttactacnatcac

SEQ ID NO: 676778 - DNA, 324 bp, Homo sapiens
tactggggatcatgtttacttactcatttatcaaatattgaatttgtcaggagcctactgtgtgtcccaggatgtattccagacaatttaatctgagttctttcaccttttcttatttgggggaaattactggtcattttttcaaatattttgttttctccattttcttctctttatggacaaattattggtcatttttttcaagtactttgttttcttcattttcttttctttacaggaattctgttgtatggattttgtcacttctagtttccgtatgtctcttaacttttaatattttgtttttttccaatccccggtcga

SEQ ID NO: 676779 - DNA, 228 bp, Homo sapiens
gtctatgtgtgaagttggaggaaagctgccatactgtcttctgcaggtggtcgacaccactattacagtcgcccccagcccccaggagagaacttcctttgtcctggatgtaatggggtacgtatcctcattctaagtgctgggcctcggtgagccgtccctgtgcctgtagggtttgtaccatgggacagtctccacaatttccacaggggggcccgggtaccgatg

SEQ ID NO: 676780 - DNA, 961 bp, Homo sapiens
gtttgcttgattcctctcaagcttggagttctgtatggtgtggttactggcgggttcaccgatgcgtatcgataagtgttataatgttcgggacaatatatccgtggcacacaggcaatgatggtacagtgccgctatcagaatgcataggctgttcacgagttttgccaggtctaaagtgtcatagatatattcttaaataacgaaatgcgccgtcctcgcaacatgcttacgtattgagatcaacacgcagttcccggacagagctgctgtggtacaagaggctggacggtcggataaattcagtcctgaagtttagagaaaacgtaggaagttgaaccatagtcataaataccagcgcacaagcttatggaaaattgaacatatttgatgtgatgatggagagtagataggaattttattacagaagcgacaaggaaaagttgagtatatgaaatagtctggatcacaaagataaagaggtaccgtaaagtgtcgagtgatattaacggaagtatgagtcaagaacaatacagtcttatccgaggacccttcattgatatggtgatgggtatacaggtcggaggagaacacaggttgcagtttgttatgagagtgatgtgtgcccttggaatgcatgctccgataaagactcgtctgtaacgctctgttcgtttcactgtaccatttgaaatgccccttggatacgtgatatgtgcgtcaattatggtattttcacatgaaggtcacttaatttgaagccgcgatacaaagaacatgttgttggtagggcgtttacctaatatgtggtatacgggggtaaaatgcttttcgcggaaattttgcttaggaatagggacaaggagatccagtgatgatacaacgattggagcacagcggtggcttgaaaggccgggcagatgttataagggaaacagccgggtaaaaaaatggacaatcg

SEQ ID NO: 676781 - DNA, 412 bp, Homo sapiens
  misc_feature (326)..(326): n is a, c, g, or t
  misc_feature (342)..(342): n is a, c, g, or t
  misc_feature (370)..(370): n is a, c, g, or t
  misc_feature (397)..(397): n is a, c, g, or t
atctgggaccatctcatcctggatttcattttccatgtccttatcagcattttggtcaaagccattcaagtctctaggaagttccaaactttcccacattttcgtgtcttcttctgagccctccaaactgttccaacatctgcctgttacccagttccgaagtcacttccacatttttaggtatcttttccacagcaccccactcctggttccaatttactgtagtagtccattttcacactgctgataaaggcatacccaagactggggcaatttacaaaataaaggaaggattagtgggacttacagttccacatgggctgggngagggccttcacaatnttgggagggaaggttgaaagggcacatncacaaatgggttggtaggacacaaggnaggagaggtttttgc

SEQ ID NO: 676782 - DNA, 306 bp, Homo sapiens
tggactccgactaacatatgaattctagacaatagacatcactcatcatagttagtgcaatcaggatactgccattgctgtccccagtcatttgattccgctgggctttctcttgcagctgtcagtctctttaaatcctttctaactgtcacccaatgtccttactttcctcttgaaacttcgcacgttgcctatgcgtcggtggtcacgggaccttaatcggtaacggaggcccttctcgaacttagtcccgatctcgctttcacgctctgatcgagtccgctcccggatccagttccacttagt

SEQ ID NO: 676783 - DNA, 350 bp, Homo sapiens
tccgcctttgcatagatacagtcatctggccagcccccgcccctcctcccggcgtcagcccgccagagaccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggatccgcccagctccaccgcacaacaagcgtgcgcgcgccgggcgacgccgctcccagcgtcacgtgcgcagcaccagacgcagtgtgcgggtgtggggggcgcgccggcgcccgccggactcgccaggggcggccgc

SEQ ID NO: 676784 - DNA, 259 bp, Homo sapiens
tggacaatggtagtcctgttctttatgggatgaaaacagtccctttacaataagttccctgaaagggaaaacaaattagattaatataactctctttcgtggttaacattatttagtggtacactgtggccaggtggtgtttttgggcgatttaacacattaatctcctgtggtgaatctcagatttaatttcacttgggcgtgaggtgttccatttgtgcgggcaattccctctctgtgtgtggaggtctctgtgtgg

SEQ ID NO: 676785 - DNA, 194 bp, Homo sapiens
attcgcggccgcgtcgactttttttttttgatagagagtctcactcttgcccaggctggaatgcagaggtgcaatcaaagcccactgcagcctacaccccctgggctcatgcactcatgctacttcagagtgcactaatggctgggactacaggtgcaggtcatcaatatttgtatttttggattccgtattat

SEQ ID NO: 676786 - DNA, 886 bp, Homo sapiens
caactcccccgtggttttcgccccctttctttcctccggtggctctctctattttttactctgagttgccccgccggtgttgtttcgccgctagtgtgctatcgtacgctcgcttttcggggggacccttttccctcaggaggccgctttcgagtggtctgttccccgtggttctatctcccctcccctccagtggtgtcgaccgagcgaaatcgctcgcatattcttctccggcgcgagcgaagctgatgggtgctccgctactcattccgtccttccttcttcaccacacgagtggtgtgttctcttagccgccgtgtcgctgccctttatgctctcgccgggatgggctgctctcattccacaccctggagattttaggcccacagaactcctcgctctgctgtccctgttcagggcaacacgggcgccccgccccgcgctccatctctctgtcagtcagtggtcactacgcgcactcgcactccagctgggtttggcaccgccctcttgttcatgcggcgcacacgaaactggtcggctcgggccacctctctttggatgttatacaccccccacattcacacgcctcaatttaacaaggtggggtagcgccccccactcgtgaatgagcgagacagtggggcgagcccacctctcttaatatacagcccaccaagagaggagggtgcactccacactcatcacgagcgagtcggatgcacaatgctggttcgttccattgcacgcgagggttttctccccaggatgttttctcactccctccaaacgacgactctcgtagcagagtgacggtcatttttttcggcgtccaccacgaacagagcagaacaaaaaaaagtagtagccccgccccacatgacaa

SEQ ID NO: 676787 - DNA, 139 bp, Homo sapiens
tcttaaaatcagtaacaaatgtcaacccaacgaaaatgggcaaaagacttaaaaagatgtttctctaaagaagatatacaaatgaccaataagcacatgaaaagattctcaacacatttctaatttttagggaaatgca

SEQ ID NO: 676788 - DNA, 463 bp, Homo sapiens
gatccctacgtctatcatagactgtttccaggtgctataagatgccagctgaagaaacgagtctcttccttcgagtaatctagggttgacctgcaggaccgtgattactctacggagacatgtgaaaataaaagtatagctaaaatccgtaagaggaaggtgacacagaaaatcaaccatcatgacaaaatcaatggaaagaggaagaccgccagaaaacagtaagatgtgccttgtatacaaaatactgttgtatgaaccatgtgccaatcaaagtagacaactgtaaagtccttgagaatattttctacaatatttgtggcaaattcagtgggttcaaaattgagtatgtccttactgctccattagtttaagctgtataattcctttcccttcctacattcttgtaacattatatcggaggaagaggagtcgctagtactggcataggttttcctttctc

SEQ ID NO: 676789 - DNA, 199 bp, Homo sapiens
tgaatcgttgaacgaaacagaacgcttataatagcggctgcaccatcgggatgtcctgatccaacatcgaggtcgtaaaccctgattgttgatatgcgactctagaataggattgcgctgttgatccctagtgtgaacttgttcctgccgaaaaagttattggatcaattgagtatagtagttcgctttgactggtgaa

SEQ ID NO: 676790 - DNA, 867 bp, Homo sapiens
  misc_feature (18)..(18): n is a, c, g, or t
  misc_feature (109)..(109): n is a, c, g, or t
  misc_feature (111)..(111): n is a, c, g, or t
  misc_feature (117)..(117): n is a, c, g, or t
  misc_feature (120)..(120): n is a, c, g, or t
  misc_feature (123)..(123): n is a, c, g, or t
  misc_feature (126)..(126): n is a, c, g, or t
  misc_feature (147)..(147): n is a, c, g, or t
  misc_feature (152)..(152): n is a, c, g, or t
  misc_feature (154)..(154): n is a, c, g, or t
  misc_feature (158)..(158): n is a, c, g, or t
  misc_feature (160)..(160): n is a, c, g, or t
  misc_feature (164)..(164): n is a, c, g, or t
  misc_feature (169)..(169): n is a, c, g, or t
  misc_feature (261)..(261): n is a, c, g, or t
  misc_feature (265)..(265): n is a, c, g, or t
  misc_feature (271)..(271): n is a, c, g, or t
  misc_feature (275)..(275): n is a, c, g, or t
  misc_feature (279)..(279): n is a, c, g, or t
  misc_feature (281)..(281): n is a, c, g, or t
  misc_feature (283)..(283): n is a, c, g, or t
  misc_feature (292)..(292): n is a, c, g, or t
  misc_feature (314)..(314): n is a, c, g, or t
  misc_feature (340)..(340): n is a, c, g, or t
  misc_feature (342)..(342): n is a, c, g, or t
  misc_feature (593)..(593): n is a, c, g, or t
  misc_feature (596)..(596): n is a, c, g, or t
  misc_feature (601)..(601): n is a, c, g, or t
  misc_feature (703)..(703): n is a, c, g, or t
aggtgttcattgctgctnggtggcgggggtcggggtcttctgttcactaacaggaacaaagacagaaaccatgacagggctgcccccgccaggccccggtgggtttttntncacttngcnctnctncccacaccagccacttttgtnacaantncccntncaanaattntttggttaaggagcaaccagttccctcttattcttgagcagggagaaattgaccttgccttgtcgcccaggaagtggggctcggcacccatnactnacaccncccncccntngnaaccatgtnttctgggggtgagtgaccattntgggtctaagactgtttcaaagaagngntcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattntgnaactntttatatttttttatgcaaaagcagcttcttaacagatggcattttctgtgactctaggcctcacaaaagagccagagttctggacccatgtttggagcatntgtagccttattctcatctgagtgtgaatctcatgatccatgataaaagagccataatgatattaagccagactgaccacttgcttggacgtgtgtgcgttgacaaaactcagagcaatactgttgggtattgtatcaggcatacctacaaggtggtaacacca

SEQ ID NO: 676791 - DNA, 304 bp, Homo sapiens
atccaagcagtcgcgtaactagttagcatgccgtggctcgttcgttatcggaattaccagcggatctgtttcaccaactaagaacggccctgcaccaccacccacggaatcgagaaagagctatcaatctgtcaatcctgtccgtgtccgggccgggtgaggtttcccgtgttgagtcaaattaagccgcaggctccactcctggtggtgcccttccgtcaattcctttaagtttcagctttgcaaccatactccccccggaacccaaagactttggtttccccgactgcttggattacaagga

SEQ ID NO: 676792 - DNA, 561 bp, Homo sapiens
aagcagttaatacagaccattctccatccagttttgtttccttggtggtgaggagttgtgatccttcagagaagaggcgttctggtttttgggaattttcaacctttttgtgctggtttctccccatcttcgtagatttatctaccttttgtctctgatattgatgaccttatgatggggtctctgagtggacatcctttttgctgatgttgatgctactcctttctgtttgttagttttccttctaacagtcaggcccctctgctgcaggtctgctggagtttgctggaggcccactccagaccccgtttgcctgggtatcaccagcagaggttgcagaacagcaaagattgctgtctgttccttcctctggaagattcatcccagaggagcacctgccagatgccagctggagctctcctgtatgaggtgtctgttggctcctactgggaggtgtctcccaatcaggagacacggagttcagtgatccacttgaggagttagtttgacctttagcagagctcgaacgctctgagatctgctgctcgaacgtgctaggag

SEQ ID NO: 676793 - DNA, 271 bp, Homo sapiens
tatgctgtagacaaacgaaaatggccctgctacctgacaagcttccgcttcgatatagccctaacgttatcctgtacctgcatcaaattcccattctacccgacaatctcgccttcggtaattcattctctttcaagatccctatctgcaaaacacccaagtttcacacctaactcacccaatggccttagttctccatctctgatggtatattcgtgagttgtgccatccgtcatatccatcccagaataaaggcgtcaaccaaacagtt

SEQ ID NO: 676794 - DNA, 137 bp, Homo sapiens
tccacgctgcgaatatttcagagtgaaaaaatgaagtaaacaactgaaacataactttcaattgactactgtaacattaattaaataaagactagtatcatatctaaaaaattaagttggtcggtgcttgccaacag

SEQ ID NO: 676795 - DNA, 699 bp, Homo sapiens
cactcgcgggcgctgcccggttatggcctgtgtgggatgtccgagttcgacgcgccgctgtgcctcagcctggacgcggtacccctccgttgagcgctgtctgtgacccacggaacctgtgcaggccgctctctgcttgtggcgcccagagtgtgcggctgctgtacatcggtgcgcgatcctgggaggcgatggcatgtggctagggcactttctgtccctggggctgatcccagagagacgcctggctctgggaccctcgcctgggtcctctgtcccgcagcctcttctctggcctccctgcgatcctgccttgcgccctctgcccatggactcgtctctcacggtcaggctccgccgccaggtctcgggatgcctccgcttccctcggcgtcccgcatagacaactcctggggaaacatcggtaacaaagtaacaaaagaagaatacaacaccagaaaaaacaccaaacgaaagacagacaaccggaagagaacgatcgaacgtagaccgcaaaattgcacaatcgaacatcaatacacagaagaaaagacagacggagagcatcgcgaccacacccaatagacatagccacacgaatgaccacaaagcagagaaccacacaaaaagaaacaaacgaatagcacttcataccgaaagcagagccaacacccacgaaaaaacaaacaaaccacccag

SEQ ID NO: 676796 - DNA, 102 bp, Homo sapiens
tagcggaccgtctgcttctgcgtaaacataggatagcatctggaaattatcatttagtggcaggtggttttttaattttcttctgtttctgattttgttgtt

SEQ ID NO: 676797 - DNA, 1377 bp, Homo sapiens
  misc_feature (235)..(235): n is a, c, g, or t
  misc_feature (1121)..(1121): n is a, c, g, or t
caggccgccctttttcccggaatagggccggcgcgccacaaaataagggagggacgaccccacaggaagagagaaaaaagagtaggggtgtgtagaacaacaaccacaaggtgtgtgtcgttacaagagaaaaaaggatttttgaggtataatatagaaaatgtgggaaagaacgcaaccacccctggccataataatgattcccgcaacaataatttataacgagaaataatantgtggagggaaaggaaccgcgctttctggtgcaacgcccacgggagaccccccacaagggggcaccccgccaaaaagtggtggcgactatattcggaaatgagggtttctctctcaaaagaagggttttcctctggtttgtttttttggaaaagatggagaagatttctcttgcgctggaaatatttgcgcccagagaaatagggataggaaaagatgtgcgcactgtgttagagagaaaattttcgcaaaagctcggatattacctcgtgaaagaaatagatgtcccacgagggtgtaaaaaaactcggccccgtgacattaacatgtgcacactcggcgccaatagggatatctgttacacccccggggcacacacaaaaatagatgggtgtgccaacagagggggccccacaaaaaattagggcccagcacccacataggatatgggaagactctccacccgttagaaaggttcccaaaaagacattaccccgagtaggggtgtacaactttgcgtgtctcgtctctggtttctctagtggtttggggttttttacatgtataataaacccgcccacccaattctcagatattccgggagaagaactctctttaatggccttcacgcaccccaacacacggtggtctcgccccaaaatctcccgcgagaagagaagatatgagttgtgaaaaattcacttgatgcccgcagcagagaggtggcacagacaacaaatggagactctgagaaaagagaatgggggccacaataaaaaattgagattccacagagcccgcacattgggaaaagagacacatatagagaaaaggcgcttcgccacaaatcttatatgttaatccctctctccacatgagaagtcttntctcggttatagagaaaagtataaaaaatgcctgagaagaagcccacaagtttgagaattgggaaaagctcactggaggcttcacatggtggaaaggcacgtaagtttctgggaaaaggccacactcggggaacgaagacacacaggtggcctaaaagttggaacgaggctgagatggatatgaaccccccgtcccagaaatctgtttaaagattccagacttccaattagtggccaaattaaaagtgctatttgt

SEQ ID NO: 676798 - DNA, 155 bp, Homo sapiens
ttccgaagcttccacatgtggtgcctccccctctcttcactgcagacacctgcacaggctgagctagcctgtgccacacacttaactcacgccaggggctgtgggggccctatccccccattcaacacctccaattcccagacttccagcaaagc

SEQ ID NO: 676799 - DNA, 107 bp, Homo sapiens
tgatcgagctcggtacctcaatattacatgaaatcaatcaaagggaaacttgaagacagagaccagaaatgagtaaaccttttatgacagtgggcaagcggccgcaa

SEQ ID NO: 676800 - DNA, 751 bp, Homo sapiens
  misc_feature (44)..(44): n is a, c, g, or t
tatggcgggggcattcctttgctggagattaagcccgagagctngctccggccttagctggctcgcgctctctctcttttgcctggaggctatccagcgtctccaaagattcaggtttactcacgtcatccagcagagaatggaaagcaaatttcctgaattgctatgtttctgggtttcatccatccgacattgaagttgacttactgaagaatggagagagaattgaaaaagtgcagcattcagacttgtctttcagcaaggactggtctttctatctcttgtactacactgagttcacccccactgaaaaagatgagtatgcctgccgtgtgaaccatgtgactttgtcacagcccaagatagttaagtgggatcgagacatgtaagcagcatcatggaggtttgaagatgccgcatttggattggatgaaccccaaatcctgcttgcttgctttttaatattgatatgcttatacacttacactttatgcacaaattgtagggctataataactgttaacatggacatgatcttctttataattctaccttgggggctgtctccatgtttgatgtatccgagcagggtgctccacaggtagctctagcagggctggccaccttagaggtgggggggccgggaattctcttatttcaccacaaccttcttggccccgttttggacctctttaccctctggccctcacaagctggtaagattgttaggcggaaataaataaataaaaat

SEQ ID NO: 676801 - DNA, 453 bp, Homo sapiens
tgccgggacttgtatcctgcacttcatttactccctctattctccatcatttctttcaaaagtggggcaatttcattaaacctttttaaaggtacagtctttgtctcttgcactagcaggaacacatttgttcattgtggtatccccagcacctagaatcacgcttggcatgttgtagatactcaatacgtgctttttggacttaaaaggcaggggagatggcgaggtctttagccacataagaaagaagtagctaaagaccaagcagtaactaatgtccacagcaaaaatatatatgtctactaaatgcatggctctttcaagaaggaaaagtaaataatagcctaagatagtatatcctttgtttatatcaatattcgatatttgcctaattctgattccctagaaggaaatacagatcttgaaagatttcacacataataatttccttac

SEQ ID NO: 676802 - DNA, 1231 bp, Homo sapiens
  misc_feature (1094)..(1094): n is a, c, g, or t
tttcacatggaaaattattacttatatttaacattggggtctaatatttttttctggacaatgttatcaatggaaaggcaagaaagaaaatccatctcccaatatcttatgtttccaagagacacaatcctaaaattattaaaacccctggtagctgggcctataattatattatattataaagatggtttatataaccaggaaagatctataacccaagtgtcacaataatgtttaaaggacaatcacaaggccatcttcacatgtgtgtgcacatgtttctcttaaaactatcctatgagaaatgagatatcatctggcgtgttatataaacctctctctcacatatattatacagagacacaagtagtggctcgagaactttaacacttacacagagagtagtgtgttatctactccatactgtagagacatattcataacacggtgcgtcccaacaaaaactatacacgtatttgagaggaaaatactctcttatatcatatagaagggtgggtatctcctctcttatatatatcacacacacggtgggggacaaaacaaacacacagagagaaatatatagagatgctccttatatgtggggtgcgcatatatatacacgcagaagaggccggagatgtgtgtctagaggtctacatatgtggggcgcgcggggtgtcatatatattatatatatatatctcacgacgagatggtttatatatatcaacaggtggtagaagaaacttatacccgagagttctccaaaaattagtttttatagagccaaaatactcaagacggcgcaaagcttctcaagcgtgctgtctcgagtattctctatttataacatctccaagtgagacagcgctggacatcatacgcgtggggataattatacaccctttcccgcaaaaaattttcttcacaagaaacacagcagggcttgcaccacacatcacccctactaccgagaaagtggtcttactcatattcaaccctatgtcacgcccttcttttcataaacgcgtggtgtcaccacacaaaaaacttacccttgttcgggggagaacaaactctcgccatatatncccacatatagggacaccgaggcgggtgggtttatctcccccctcctgtatatattcttcacacacaccgtgctgggggcgaaccacaaaacacacacgcaagagaaacaggatcaaaggtgtcccctcttggtggg

SEQ ID NO: 676803 - DNA, 137 bp, Homo sapiens
  misc_feature (18)..(18): n is a, c, g, or t
  misc_feature (38)..(38): n is a, c, g, or t
  misc_feature (97)..(97): n is a, c, g, or t
gtgacactgcttaggtanggagcgcggagtcggagcgnggacgcgccgggctgcagctctgggatgcaatccgactgcctcgcaagctgctcgccgntgcgctggcaggctgtacgctgagctcggaggatcccatt

SEQ ID NO: 676804 - DNA, 956 bp, Homo sapiens
tggattactaattcgtgttttgaaagcagtaagaggttccacgaccccaaatagcaccagttctgaggttcccccaaaataaatttaacagcctccagctctcagtgttatactcaaaattacaaaaagaaaaaagtagaggttgcttttttccgatggcaaattcggacccttgcaggctgagggagagaaagctacttcacacacagaggtggggtgcccccgaggggctgtgggctctaggtggcccgcctgcccggtttgcacgcgctcctgctggtgaggccccagatcttcctgccaaatgtgttctagagcgagcacgatgtgttggggcgacgacggacccatttctggccacacggcgaccgagggacagtatgggcgccctgggtcccataggctcgcctgaacggtgcggtagggcgcgcctgcggcatagcgggggtgcgctgtgggcctcccagctttggccccgtgggacccgtgggacgcacagggacaacgcccatggctatggaatgcagggttgacccaagggacaacgcagatgttgcggggaatctctactgtgaccaatgcaacaatggatcgacagtctgttgcgccacacaccacctacatgtccccgaggggacacagttggtcctggcgactggcatccagcgccgtaactctgccaaatctaacagccaaggcggagatccccccttcgtgtgttgtaccaagtgtcctacgatctgaaattctcaacatactttgaagaacatgcacaagaaattgggggtacaaaaaccagagtcccaaatatgggatttcaccaccagatctctaaagccacaggagtttggaccgtctctcccaaagaagggaactcctgggaggcacgtgcccttgggctctaaatcccctcctcacagcttgaacccgacattaattactttgtacagtacaca

SEQ ID NO: 676805 - DNA, 714 bp, Homo sapiens
  misc_feature (189)..(189): n is a, c, g, or t
  misc_feature (320)..(320): n is a, c, g, or t
  misc_feature (663)..(663): n is a, c, g, or t
  misc_feature (670)..(670): n is a, c, g, or t
agcgggcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgatnctcctccacccaggagctccccatggcaatcgcagctttcccccccaggtgggaccccctcatcctgtgaccaacagccagggtatccaggatgccaaaccgttgggtccctaccgctcctccatacccancgactgcccctggaatccctcctgtgaatcccttggctcctggcatggctatggaccagcagtgatagtagacaagaagatgcagaagaaaatgaagaaagctcataaaaagatgcacaagcaccaaaagcaccacaagtaccacaagcatggcaagcattcctccatcttcctcctcctcttccagcagtgattctgactgaatacaggccctggacccttccctcaagtctcaccagttctgctctcccatcaagcttcagatgccatgtgtactgggggaatgtagcccttgtgctccccaccccactacctccacctgagcctcaccctgctgttgagnccctgangtggctaggggaatgggaagaggattgccatggcctggccatct

SEQ ID NO: 676806 - DNA, 187 bp, Homo sapiens
tgagcggcggatcacaaggtcaggagttcaagacaacgcctggccaacatggtgaaaccccgtctctactaaagatacaaaaattagccgggcatggtggtgctagcctatagtcccagctacttgggaggctgaggggctgagcgaaactccgtctcagaatgacttatacagagaggggcgagcg

SEQ ID NO: 676807 - DNA, 366 bp, Homo sapiens
tcatcgtgttaacatgttgccgttctgactggacactgggtctcatggatacttatgttagggatggagataatggcatgcggtctattgtgagtgtatccatcactgcacactatctcctgtaacaaatagagcccagaatgcagaatgattacaacaccatggagatgtgttgctcacataacaagccagagtgagagctcattagtggcacgtggcttttctcctgaaaagctgaatgcagtgattcggaaacccgtgttctttacagttagtagattcacccttcccaaggcctagtaaccaatggtattcagcggtggaacgggaaagagagagcctggagagagcccatatccatactcc

SEQ ID NO: 676808 - DNA, 656 bp, Homo sapiens
  misc_feature (605)..(605): n is a, c, g, or t
  misc_feature (612)..(612): n is a, c, g, or t
agcgggcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcctgtctcctccccaggagtcccatggatccagttcccaggtggccctcatctgtgcaagcaggtatcaggatgcaacgtggtcctacctctgatacacgtgcctgaatcctctgtgatcctggtcggcatggtggaccagcagtgatagtagacaagaagatgcagaagaaaatgaagaaagctcataaaaagatgcacaagcaccaaaagcaccacaagtaccacaagcatggcaagcattcctccatcttcctcctcctcttccagcagtgattctgactgaatacaggccctggacccttccctcaagtctcaccagttctgctctcccatcaagcttcagatgccatgtgtactgggggaatgtagcccttgtgctccccaccccactacctccacctgagcctcaccctgctgttgagnccctgangtggctaggggaatgggaagaggattgccatggcctggccatct

SEQ ID NO: 676809 - DNA, 1226 bp, Homo sapiens
agcggggggtcggccgagggcgcggggccccggggctccgtggctcacccccgcgactcggggcaagcgcgccgatggcgtttctgacggtgacgccgcccacatcgtggcttctccgcggggcgtgaggtaaactagcctatgaactcgcatccggcatgccttccttgccgggcgtccagtaactactcgggatcagtagagtttgagatatatccaactatctgagtaatagctaagcagtgaagtgacgctgacacgtttgctcacttagcgacgaatttaacaacgatcttgatactaagagggatgctcaaatgagcctcgcgttagcaggtggcatccatgcaaacatgctatcttctcactggtgacacgacggactcgggcaccgacaaggttggtttgaccactaggaaggaaccgtctgcaggagagaacttacagatatgagttgaatcttacagtatacaaagatagctgacctagtacaatcaggggttcatctacaactggaacgaaaagggtaaaaaatgctaccttgaaagtccacatttcaaaacgtaggacagttgctccaaagcaaggctcgtaccaacgaagagcgatgcgcatacctaacacagcactatccgtgggcaaacaggtgtggcattccacgcacctggggcacaccggccagtttgccttgtccctccttttcatacgtcttgtcaaggaaccgccatgtggtacgctcgctaatgacacaccgggatagcgaccttccatcgaaggactatacggaccaggtattcaccgcgctggagggcacaagccagttaatttacctatgactcccgccaagggggaataagggagcaaaccacagctctgttaatgcacaaacgtgaccctttcgcgtcaagtgcagctaaccctaatatcgaccgtttccttcttaggcctgggacaaaccacaacagttggcaacatttttacaacaagggccgcttacacgacaagcgggaccacgcagaccaacgcaaacttaacattctgtcagcatcatcaggcaccagagggtcagcacaaggataacacaacaaacttccccaacacagcttatttacggtcaccagggaagattagtgatcattacccgcgggaggatataaacaacgatattttcaccaacaaaagagttttggccctcaaacggacaaagcaccccaattcggacccca

SEQ ID NO: 676810 - DNA, 642 bp, Homo sapiens
agcgggcggtcgttgtgggactccagctcccagcaggcaccgcttctgcggccagactgcgctgtggcgtgctgtgtgcctggcatgtggactcgtaagtgcggtcctgggtaggagacgatgcatgggtggccacgctggctccatctacgcacgtttcggaaaccgtggccccgggatgtgtgaccattggcccgctcaccctgtgtccctggtgctgtcccccggaacgctgtggtgctacgatgtgagcctggggccgggccgcaagcgggaaagatgtgccacatggcggggcctgcgcacgtaggcggcgggtaggttacgctgcgtgaggacacccgggaacgcccttttgccaccgtgccaccgcccgtcggtgacctcgcgttaacgcgtcctaccatgggttgccgaaagggtcatgtggtgcctgttagtagtggaggtcctggtaaactcggccggtggtaacaggccctttcagttccaaaattaacctctgctgaaggtacccctgttcctgccgtaaggcacagtatctttccgctaaagcacacataggggaacgctagacacacatgccggtctgtgaggcaatgcgtgattttcccctgtgttgctgttggtgttcactatgtc

SEQ ID NO: 676811 - DNA, 1374 bp, Homo sapiens
  misc_feature (874)..(874): n is a, c, g, or t
tcatgagtcttgggattgtgttatgttggctgagatgcgtgtatcattcgtagttgtgtgtcgtgatctctcctgctgtctgctcgctcctttgtcgacgccgcggttcgcatgctcggcgaccattccatgcgcagtcgtcttcgcttgtttcggtgagtggctggtcttggtcgatgtcgtgttttttctcttcgtagccgggctttttctcgtcccgattcagtactgtgcctcgccgttatcttgttggagtgtgcgtttggcgctgcttctcgcgtgttcgtgagtggtagtgttgttgatgtgggtaggtgttgtgttgtccttctcctccgctgctgcggtgtgtgcgtgtaatataaccagagagccttcctgttttaggggaaaccccgttccaggattccgccctgggggatgaacccctcaattcacaaccgccgtgtgttttgagaccctccccattaggtaaaggagccacgcccggggggacgcggagtgcccagggccctcccggggacctttcttaggcccttatggccccctcgggggaccccggaattataacccaggtgtgtccacacaaccacggggggaacacacgcttatgtgaacgccacctttaggggcccctatatttaaaggtggtacacacctatataggagacgacacaggttttggtgacgcacaaataatgcacacaggctggggtatacccgcgttccgcggaaattctccccgcgggatatatattgtgtctgagacgcacacacggcgttcgcgggaaccccgggtcttgtcgcgttgtgctctgtccgcggagctcttgatctcgagtgaatactcttattctataaaaggtttcctcgngggaaagccacacaagttatgaaatgtttacaatatagagaccacacaatgtggatatgtgagagagaggagagaaaacaccctatatgggtggcgctgttgaaaaggagcccctcgaatgcccacatgataatgtgtcacaaattgaataatacaattctgagatggcccactgagaattttatattgtataaaaagaggagaacacatgcacttaaacactcacggcaccgagataaaaagccacatgttgaggtggcccacggtcacgttgtgctgaggaaccgaaaaccacacatgagggtcaattttagagagaataccttcaacaatgggctatcgaaagtaatgcaatgtattttacgtaccaaaggttcgctacacctaacagctccacccgagagagattcctgaaattcccacattgcacacctgaaattgcactgggactgctgatggctgcgaactttttagattgttaaataaaataaattataata

SEQ ID NO: 676812 - DNA, 1227 bp, Homo sapiens
gcagcctggacgccgagatagacttgctgagcagcacagactggaccgagctgaatgggtggtcgtgggtcatgcgtcacgtgcgaccagacctgacaggcatatgagccccctgccaccatccatgcctacctgcactgggctccctagaatgccaaatccaagcctcgccgctcccatgctgtctcccatatgggggccccactccatgcctcttacactaccgccatgcaccccggctggcccagccttccccgtagcaatgtagaaggtggcacagccagtgagtgggctagcggccacccatgtgctgtgtgggagcctctcagtgcctctggtgcccctcccgggcccccactttcctctcccaggccgaggtgaatgtctagggggccttggctactagagaggccaagagagagccagtggccactggccacacgagtgaagcttgcatggtggtctctggccctgcaggcacgaggaatgagtgagtctgatgcacggagccccaggtgcccctgacgccagcctccagcggatgagcttggctaggctgacgacgcacgctggtacacgacatgaaccacctgcccacacgagtagacgtaccttggagccatgttgtagcgaggtttgccgcgacacacatgtgacagcggagtgcgcgctggagtttgatgccccctagaaacgcggtctattccactgttggccacgccttgaatagacataccttgcggggcccaagaatctcgcgggccatgctgtctctgcgccgtcggcaacacgcgggcacaacttggcaaaggtagctgcacacggtagcccacccttgagcacactggttgcgcctcgactcccccactccccccagagacgtgcaccctcggcggtcaccatcgcaacagccatcacatccttgtcatctccctgtgtgcggctgcacgccctgccccgccgtgggctccctgttcgcgcagcttacgcgtcgaccccccccctacaaacactaccaccgcagtgctacacatacctcctagccgcccacaactcctcccgcctaccctacgcacaacattcactccatatcatgatcctacatcgcacacctgccccctacgagaagaatctcaaacaaaacacccacaaccacccaccctccaaaccaccaacctctcctgactagactgctcctcccccttcatctaccctcacactctaagc

SEQ ID NO: 676813 - DNA, 1368 bp, Homo sapiens
  misc_feature (805)..(805): n is a, c, g, or t
  misc_feature (1368)..(1368): n is a, c, g, or t
ggaaggagcacgcctgtgctagtcctcctgtctctcgctagcacttctctgatctcgcacacgttcccgactgaggaaactgctgaggatgctctgatgcgtctggtggctgcgtacgtttgggcgcagagaagagcggggcgttgctttggccgtcccgcccctagctcttggtagttgtcagtagatgaaccacgtagttctgcgaggcgcattgcgaccacctagtcatagcggcttgcacaacaagaatgctctagtactaactctttcaaggggacagttcaggattcgtaataggtcccgatcatgatttctctgggggcgcccaggacgttacaaaatcacgagtcagaatgttctcttctacaagcgcatatcttctgtgaaagcaaaggcccatgtatgtgctcccagaggttcttgcagcaacaattgtggtggcgggtaaaggaaagacatcgagccattcggacttaacgcggaatgcgttaacttaattatagtgttgtacattcgatagcaaggataggatttggaatctatatggagctagatgtaccgagcatttgaaccttattccgccgctttcatgccacgtatttcccgacggtctcgattgctaattgtcctgcggacttttcctcgctctagtcccatagcgggttagctcaactcctcgcacatgtgagcaaaaatggcgtggtcctgctgtggatgtggaaatattcgctggacagattgtttctgatgcgggttcgaattcatagtacgcttcccaagggtcgtgggtatcagtgcattngaggaacaccaagcggttagtaaaggcgtgttgctaaccaaacgattatttcctacaacattgtcggcctaagtacccttccattagcacatttgaagcttccgtatagaaattcgaaaagactggaacatttttgaatcatttcgttatctcaacgttttctccacgcggggactttttgaatttcgccccaaggggctctcgacagaccattgctctaaaattttccgaaatcgggagttaatccaccgttggacaacaatttttttgtggggcacattgggcatgattccctaaagtttcttctttcgtttgaaatacggagcggggaagaccttggttcttccgcggcccaagggggttggaaatttggagcgtataggcgcatttacgttaacaggaacggtttctatcccgttgcggtcctccttagagacccacaggcacattaatttgcgcgcgacgccacatgggagcgacggtctaatatcaatcccttgacctttggttggtattgagaccaggaggtgtaaattgcgcaggcataaaagcatgagcccatn

SEQ ID NO: 676814 - DNA, 137 bp, Homo sapiens
  misc_feature (2)..(2): n is a, c, g, or t
  misc_feature (5)..(5): n is a, c, g, or t
gnggnacccacccgtatgtgcgatgctggggctccggggcgaggagccacccaaacgggaggcggtttccgaccctgagtacgtgttcttgctgcgccggaacgaccagccacgcgcaatcgcggccatgatcatcg

SEQ ID NO: 676815 - DNA, 165 bp, Homo sapiens
aaagggagggccccccctttgccccctgctttttcccttccttttgggggctctacccctcaggtttcccggccttaggcatttcaacccagcttgtttcctgcttttaggcttgtggggtgggagcccaaatggaggtcggtgaaataaagtgatgccatttga

SEQ ID NO: 676816 - DNA, 197 bp, Homo sapiens
  misc_feature (15)..(15): n is a, c, g, or t
ggtctgtcaccagtntggagtgcagtggcacaatcacagctcactgtagcctcaacctgccaggctcaagcaatcctcccaacttagcctccccagtagctgcgactacatggtgtgtaccaccacgcctggctttttttttttaaggtagacggagggtcttactatttgcctggcaggtctcaacctcagaaaaa

SEQ ID NO: 676817 - DNA, 350 bp, Homo sapiens
ccgaggcaaaggggtgcacagctgagcagagcagtgaaggggaagggccagacgaggtcagtactgagaacgccgaaggtaggaggccatttcataacatcacttgtagatcaaaccaccgtgaaccaacttcttatgcccatcagcaggactagcgtcttgtcagatcttggatagacaagtgacattgaaggtgggggccccaccgatgctcttgagataccgaagatccatgctaaattccccatcctgcagaagtgaatcccggatcaacgaacatttctggcccccaagtgtcagcccattcacgtaaaaacttgaccggtctttgacaaacaggacaaccacct

SEQ ID NO: 676818 - DNA, 1254 bp, Homo sapiens
tctggtaactttttttttaattttttccaatttttcctatcttttttttgggccatttggtaactcgtataaaaattagttagacaacgtgctcaagtggtggcgggttttttctcacaatttttcaacatttagtgattttttttccgtgttgtgcaagttaacgagggtttgctcatgtgttctctttaaaaaaaaacttacaattaatgtgccccatattccctagttgcttaagggtgctctcttctatttataataggggtctgaaaatttcgtgaattaaccctttttagccttgtgacaaaaaacacaccaaaaaccaacaaagcgtggacaacaaaaaaccccgtggcttatttgtgggtacacaataatttttcttttttcccgtggcttgtggggaaacccgtgttgtctacagtgggcgagcgaaaaacgtgtgtatagccgtgttcattgggggtccttatttagaacaacgtgccttttcacctctccagaagaaaagctgtgaacaccatgtgtggtcaaacagtgtcttctggggaaactccttgttgtgtgtccgcaagaggagcccacagagacactttgagtgttgcttttttaaaaaaacacaaaatacacacggagggggcacacacacctgtgtgccgcacaccaaatattttaaagacaccacaaacaggtggttttctcggcgcgcaacctacaacaacctacatatatactatataaacaaagcacacacctccacactacacgacagagaagaagaacaacaaacgaacacataatcagaacgatacggcagggcacaagaggagaaagtgataaagcgagacagcactggatgatcacggaatcgaactagatttagtaacgacgactcaacataaaaatacatacgagcaaaatcacaaatagtactcaactagaaacaacaacaaaataacatgcgatatccacgccaaactagaaaggtagcagtagtggtgggaggcgacaaacaccatttataaacaattcattatactaaacaagagtcgtctttccatcacgcctccaaaatctacacaaaaaacactcaaccacaatcctacataatacatattcataatatatgtctgctatatttcacctatttaataaatatgatgtccagattctaatacttatacactacatctctctacgctcacatccgtatgatcataatcacaccaaatgcatatcatataccttttagat

SEQ ID NO: 676819 - DNA, 271 bp, Homo sapiens
  misc_feature (96)..(96): n is a, c, g, or t
  misc_feature (136)..(136): n is a, c, g, or t
  misc_feature (191)..(191): n is a, c, g, or t
cgcggcccgagcccaagagagctgtggtctgcagggagaggggctggtggcgaaggttctggaagcggccgggacaggcggcgatgggcactgagncatcggccgcctggtgctccccagtgccttccacacggcnccgcacgggccgagcgcccgggcccggactagcaggtggtggctcacgatgcggngcacacttccacgctatttaattgcagtgtacagagtcgtgtttgtatatagaataaactgtcgtggacagtgtgaaaaa

SEQ ID NO: 676820 - DNA, 360 bp, Homo sapiens
gtctatcatatagttgaacccagaccatgacccctaacaggggccctctcaggcctactaatgacctacggcctagccatgtgattgcacttccactgcataacgctactgatactacgcctactaaccaacacactatccatataccagtgatggcgcgatgtcacacgtgaaagcacataccgaggccactacacaccacctgtccacgcaagatatttctgagccttttaccactccaggctagcccctaacccgcaactagggggacactggcccccaacaggcatcacccagcttccactagaagtcccactactagacacattcgtattactcgcgtcaggagtatctcacctg

SEQ ID NO: 676821 - DNA, 327 bp, Homo sapiens
ggtctcaagcaatcttccctcctcagtcttaccagtagctgggactaccagtgagtgccaccacacccagctactgttttaagtttttgtagagatggggtttcaccacattgcccaggctggtctcgaactcctgggctcaagtgatcctcctatttcagcctcccagagtgctggaattacaggtgtgagccactgtgcctggctgccctcatttctttgccccaccacaatggcatcttttctttttttattatttttttttatttttgaggcagaatctcactctgtcgcccaggctggagtgcagagcgagactccatctca

SEQ ID NO: 676822 - DNA, 116 bp, Homo sapiens
aatcagctcggtacctaacagaatggtatattcctctggaaaaagactaacgtcaccaatggattgtgctgctctcgtttcatgctttgattttttttgtctttgagccgaaccct

SEQ ID NO: 676823 - DNA, 975 bp, Homo sapiens
cttggttataaatttaggtatgtgtttcatacctagggtataaattagtgtccgtgtatcatacctatgattctatattccttcgtctacttttctatccttgagcggcagtaccatcactctctgaattattatagcatttgttgttgtcgagaacagggtcttgctctgttgcccaggctggaatgcagtggcaggaggatggctcattgtagcctcaacctcctgggctcaagcaatcttcccacctcagacctcctgagtggctgggagactacacgagtgcatgccactatgcctggcttatttcttacatattattgtagagacaggggatctccctctgttgctcaggcggtcttgaactcctgggctcaagcaacctttcacccaagcctcccaaagatgcatgggattaccggagctcagcctgccatgctcagcctagtatagctatcttaataagcacttaataggagttctgtattagtatccttccctgcactgtaaggcatatacctggcccacataattaattctatgctgctttctgtttaaaactccacactcactgtatctttagtcagtttgtgttgccatacaggactactcgcgagtaggccaacaatattggcccctgccattcttcccccctgagtacgaaagcatagagtacacatcttaggcaataagcgcactgccaacagatttgaacgtaccggaaccgggcacaagcacacggagtaagacgtcgggataagagacaattcagaacgtgacccacagtaccgctgcctgcagcccgcccacgcagcatgaaacacgagggcatccatttcacgccgaggtcatcgtggatgaaaccatgacaaacaacgcgagcagcatagacaccacgactgctccacttcccgtcaccccgacgtgggcgaactgcgataagacgacagactcgctcatgaccggaaaggtgca

SEQ ID NO: 676824 - DNA, 420 bp, Homo sapiens
tgtatatatcagctaggtctggtggtgtgtgtctagcagtcctagccattgggactgaggcagaaggatagattgagtccaggagtccaggagttagagcccagcttgggcaacacagcaagtcctcgtatcttggaaaaaaaaaaaaaaagggaattgattaaaaggatatcccaggctttttctattcaaaacaaagcgggattattatttttattttcgggcagagcagattttcactgtatgaagatttttcagagagtaagaagagctttacataattgaaaagatggtaacaactcatcattgttgtggccctaacaacagagcatcaaactgtgtgaggcaaaaactgatcgaatctgccaaaggtaatagataagtcagtaattatagttggagactataaccccctctatc

SEQ ID NO: 676825 - DNA, 242 bp, Homo sapiens
tttagccctaccggattttttatttggggtcttttttattgctggattggtctttttttcatttttctttttcaaaaattttgcatctggcttgggtgcctccagggatgtggaacccttgggtctggagggacacctggtctctccattggggaaaaaattcccttaacctggagaatacttttgccccttttgctcaatctgctcctggatcccggctgtgtcattttgccccgatcctt

SEQ ID NO: 676826 - DNA, 109 bp, Homo sapiens
cacgagggttacttcgcctctgtccgaacaattgtgcttcttcctgtccacgtgagctgcgagtttgtgtatcactctaaggactgttgacaatgtctgcattgtttca

SEQ ID NO: 676827 - DNA, 339 bp, Homo sapiens
ttttttcccccccgggccccccccccaaaaggggttttttttggggggggggtttttttcccccccggggccgggttgggggggacccccccccccccctcaaggggggttggggggggtcgccccttcccccgggggaatttagggttttttcaaaaaggcccccttttttttacccgggggaaattgggttttggcgctttgttaaaaaaaaaaaaaaggggggatcgggggccccccccccccggggggggtttttcccccccccctttttttgggttaaaccccattttccggttttgggtttggccccccataaaaaaaatttttgccccccca

SEQ ID NO: 676828 - DNA, 203 bp, Homo sapiens
ttgggccagtccgtaccatcgcggctccacacgagaccggacacgacagacccttatgcgcgcgatgccgacggcacgccggcaaggaacgcatcgtaggccgcaatgaactcggcctcggcttcgaagtgcggcatcgcaccggtcggaaaaacctggatagtccagttcggacgaccttcgacctgcgtcttgttggcgtg

SEQ ID NO: 676829 - DNA, 633 bp, Homo sapiens
  misc_feature (228)..(228): n is a, c, g, or t
agacatacctgatgtaggtgaccggttgatgggtgcagcaaaccaccatggcacatgtatacctatgtaacaaaactgcacgttctgcatatgtatcccagaacttaaagtataaaaaaaaaaattcttttagaaaagtattttttatttttatagagttagggagtacagttgcagtttttgtttgtttgtttgttttttcttgaggagtctcactctgcaccccangctggagtgcagtcgtgtgatctcggttcactgcaacctccgcctcctgggttcaagtgattctcttgcctcagcctcccgagtagctgggattacaggtgcttgccaccatggctggctaatttttgtatttttagtagagacggggttttgccatgttggccaggctggtctcgaactcctgacctcaggtgatctgcccaccttggcgctggggttgcaggtgtgagccaccacacctggtcacaggtgcagttttgttacatggatatattgtgtagtggggaaatctgggcttttagtgtaaccatcaccaaaatactgtacattgtacccaaaaggtaattgctcatccctcaccccctcccacctttccaagcctccagtgtctattattccacactc

SEQ ID NO: 676830 - DNA, 389 bp, Homo sapiens
ggggagggccctgttcacctgccccctgcctagctcaatggcgggccaggatcatggactgagggggccaagaaggatcgtatgttgccaaaggagggagctgaggaactgctagagggcatctccgagggcataggcaggactagagggctttgggcaggagctccgtcagctaggagtggcattgagcaatgggggaactggctcagagtcccccttagaacctccactgccccttgaggaggaggaggcctacgagagcttcacctgtccccctgagccccctggccccttcctgagcagccctttgcggtctctcaaccagctgccaagccagcccttcactggccccttcatggctgtgctctttgccaaactcgagaacatgc

SEQ ID NO: 676831 - DNA, 939 bp, Homo sapiens
gtagacagctaaaagtttggtgttagcgtggttctcgcatgttaatctttgtttggtggtagttggcggcgggttccgtggacggcccagcgtgtgaccgccgtgttttagcctatatggggttccccctcgagccggccagtcctgtgcagatccgcccatgttcgtgcacaacatgatttccttgcggggccgcacatgccccggttttcgcccttcgccgcgtttaaagaaactttgttgccggccccgccttgcaccccgtctggtgttgatccaacacttcgcttccttcaaggggaacaaccttgggcgcccagccgagcattggtcttcccggcttctcgcccccgccggagtgtttggtggtcaaggcccccgcatccgagggggggattctgccgggggcacaaaaacgggggtgccgccctgtgtatgcgcctatgtgccgcttgtcctggctcttatggtccccctgctccctggtgttggatggcataagattttcgcttgtatatccgtctgttgggtgaagcgccataggctctttggagttttccaaatcgactcgtcttgtcttccccctagggttgatctcgcggactttgcgtccgtccttctttccgggaccgtggtgttatgataagacgcctgtgttctcggtttactgtcgccaccatgcatggttcaacgttacccttttgtgttcccccgcacgggtagtgcccccgcctcgcctgttcagaggtgtcctctcttgccaccaccacttcgtcggcttggatgactcaatttgtcctccgacacagatgggttggcatttccttattctcgcggggcgccactaaaaccttcgggggatatgtattaatagttaggttccaaaaatggggttcatttaaggcccaacaccctatatgacccccaaaaaccaaaaca

SEQ ID NO: 676832 - DNA, 109 bp, Homo sapiens
tcaagcttctaacgatgtacggggacatgacttattatgcataaagccaaatttccagtttaagtaattgcctacaataaaaagaaattttgcctgccataaaaaaaaa

SEQ ID NO: 676833 - DNA, 340 bp, Homo sapiens
caacctcataaggtatataacgaagaagtctggtactagctagcagggagattgactgactggatgccaaatctaaacatagagaagttatagaaatctatcataggattgtataaggagaccaattttatttagatagggactatttatttttgaactggatctctaagctctgggctgagcccacactgaatcctgggtcttcaaaaagagaattattttaaggttagaccacatgatgcatatacagtgcacttaaaaaacaaagacatttctaagtgcctgaactatactcttccttaaaaaccccagagaagcctcggttgtgtaacgtctaggt

SEQ ID NO: 676834 - DNA, 450 bp, Homo sapiens
  misc_feature (35)..(35): n is a, c, g, or t
ttcggaggattcctcagggcggtcccctatggggntccaaaaggagtgtcagacgtctctgacctttctctgcatgttttccctccagagcctcctatgagctatgagtttgataaggatagccctgaactgtaatgatacataggaactggatgctgggtgggcttttttgtccttagatagttgaataggacaagcaaaaaacttagcataagaaaaggtttaagtcacctgaaacaagtgtgagttaccaccaccaccgtagggatcagggaccacacctggaaaagataaaaaaaaaaaagagtcattcccccttctgggtagggcaattattcccattcactctttgccttcaggcgataccagggagtgaccccagcgaattgccctcaatttccaagaagctactaggaaacagccgctaaaagactgaaaaacaaacaaagg

SEQ ID NO: 676835 - DNA, 102 bp, Homo sapiens
aagaaattgggtattgctatgttgcctgggctggaatgcagtggctattgccagacaccatcatagggcagtgcagccttctggggtcaagtgatccttcct

SEQ ID NO: 676836 - DNA, 605 bp, Homo sapiens
acgattgggtgcgataaatcaactcatgggccttaacttgatctctctggatctctctccaacatcggacaacagtttattattccatcctcttgaaacactttcttcaccgggcttcagcatgcactctcaactctccttctatctaccgggcctctctttttcagtctccagtgctggctcctcttcacctcccggacatccgaacattagaatgccccaatgctcagttctgagattctttttttttttttcaacaccaattctcaaggtcatttaatccagttccacggtttaaaaaaaccatggatatggcggtgatcccaaaattaatatctcaagccttaagagtggtatatccaattcttcacaagtgggtatctcaactttagggggtccaaaatggaggtccggatatctccaagatcggttcttcgggcattctctccaatctaatttaccagcactttaagccttcaagtggtcagaccaaaattctaggtatcatagtggattctttaatactctacatttaaccaaaaaggaaatcgggtcaggtcagacaggtcagattatataacaaggagctggtttctcttcacctc

SEQ ID NO: 676837 - DNA, 618 bp, Homo sapiens
caaattttcctttaataaaattgctgttttaaaaaaaaaaaaaaaaaaaaaaaaaaaaaaaaaaaaaaaagaaaaaaaaaaaaaaaaaaaacaaaaaagggggcaaaagtaaagaggaaccaaattttatgagaaaaaaagaggagaccacacaaaaagggaaaaaaaaaaacggccaagcaacacagggcgcagcacggacataaaaacaggaaacagaacctgcggacagcacacggcactacctgcggccaccgtccctggtgaacaccgcaggacccctattaccctcctgcccgcgacgcgtgccacatagcggcgcgcgcaccaaaccgcctccgcgctcgccccgtaacaccacctaccatccgccctccaaaccagggctaaccacactctcacacctctccacaccgcccgcctatcaccgcgtgccacaacacccaacctcggcccactgtcctcgacgccgcccatcagacgacacctcatgccccgcactgtgactctattgcctcttgcagccaatcttctcttcctcaccccgcgacaccccatccccaataaccctcccccctaccgccccccacccccccccccacccaccaccgacccgac

SEQ ID NO: 676838 - DNA, 113 bp, Homo sapiens
atttgtgtatgttaatcttgttccagaaactttgtgaattcttttatcagttctaggagctttctggaggagtccttagggttttcaaggtaaacgatcacatcattagcaaa

SEQ ID NO: 676839 - DNA, 164 bp, Homo sapiens
gctggatgtatggtttgtaaatatatactcccagtctgtagtatagcttgtatctccccttaacagtgtcttctgcagagcaaaagttaaaagttttgtaaagcccaatttagcaatttttctttttctttctttctttttcttttcttttttttttttcccag

SEQ ID NO: 676840 - DNA, 260 bp, Homo sapiens
  misc_feature (224)..(224): n is a, c, g, or t
aaggacgaggacatctaccggagccggctcccccactacttccccgtgggtacgtgccccgcgccgccccacggcccgcccctgccccggtccaccctgaggtcctcactctcactgttctctgccttccagcctgaggctcccgttttcttttctgaccgggactggtaagcagggcctcgccccgtgcggcggccccggccctagactaacccgccccctancccccgctcacccccaagcagggcgggaatccacgg

SEQ ID NO: 676841 - DNA, 424 bp, Homo sapiens
gacagcctgagtactatagacaggtcagcaaagtgactgccccgttgccgtggcctaccacactgtgaccaacctatgctggagatgtgaattactgaccccaccacacaccggaccaccaagagagccagtgctgctgtaacgcgactcaccagcacagatttgctcagaaactctgcccaagattgtgcagaagttactttaaaaagacttggatcaggctggtcacggtggctcacgcctgtaatcccagcactttggaaggccaagccaagaatggatcatgccgccaggagttcgagaccagcctgaccaatatgttggaaaccccatctctactaaaaatacaaaaattaacagcagagcgaggactctgtctcgaaaaaaaaaaacacacagcgtgggtcccttggtttattcaaaa

SEQ ID NO: 676842 - DNA, 894 bp, Homo sapiens
  misc_feature (88)..(88): n is a, c, g, or t
tgaggcaggagaatcacttgaaccgaggaggtggaggttgcggtgaggtgacatcgtgccattgcactccagactgggccacaggagntgaaacaccgtctcaaaaaaaaaaaaaagaactttgccaacttctagttcttgggcctcaaaacaccccatctaggcatgtccctattattccttttttcagaggcactggtgccagcctaggtgaatgaaaagttacgacgctatagaagcattagaaagcattcgaagttgtgaactctcaggctcaagccatttatactagagccgtggtgaaatctatagcggcagactgtggtgtttatataagaacccacgtgaaattcttgtggcctcgtgatgtgccccatgagcagtggaagctgcacggtgaagttggccatgtgacctcaatagcctctactgtgcgagacctatcaaattctcatgtgtggcttcaaagttgtttcctatccacaaccaatcaagacacttcacgtgaacatttagccagtggagaacgtatcacaggaccattaagaccgacccaacatcgagtcgaggacttaaaatattatataaagatgttgtagattgatataatttagcacgacccgaagggactcctccaacttccaccgtgtgtgttgaggcccacaaaagcctttgggatcattccagaaaagctcttccctgtgggctccctcccgagagacaaaatcccagttccccaacaccttttggtggcgctatacacaaaaggaggatacttgtggagcagaattagcacccatgcaatattgaagcacaaactgtgcattcccaacaagaccattgagacgaaatagatacaataataggcattaatatataataagacacgaataa

SEQ ID NO: 676843 - DNA, 471 bp, Homo sapiens
  misc_feature (83)..(83): n is a, c, g, or t
  misc_feature (149)..(149): n is a, c, g, or t
  misc_feature (152)..(152): n is a, c, g, or t
  misc_feature (157)..(157): n is a, c, g, or t
  misc_feature (166)..(166): n is a, c, g, or t
  misc_feature (175)..(176): n is a, c, g, or t
  misc_feature (184)..(184): n is a, c, g, or t
  misc_feature (192)..(192): n is a, c, g, or t
  misc_feature (202)..(203): n is a, c, g, or t
  misc_feature (226)..(226): n is a, c, g, or t
  misc_feature (230)..(231): n is a, c, g, or t
  misc_feature (234)..(235): n is a, c, g, or t
  misc_feature (246)..(246): n is a, c, g, or t
  misc_feature (249)..(249): n is a, c, g, or t
  misc_feature (256)..(258): n is a, c, g, or t
  misc_feature (265)..(265): n is a, c, g, or t
  misc_feature (277)..(277): n is a, c, g, or t
  misc_feature (285)..(285): n is a, c, g, or t
  misc_feature (299)..(299): n is a, c, g, or t
  misc_feature (305)..(306): n is a, c, g, or t
  misc_feature (315)..(315): n is a, c, g, or t
  misc_feature (319)..(319): n is a, c, g, or t
  misc_feature (321)..(321): n is a, c, g, or t
  misc_feature (338)..(338): n is a, c, g, or t
  misc_feature (421)..(421): n is a, c, g, or t
  misc_feature (423)..(423): n is a, c, g, or t
  misc_feature (426)..(426): n is a, c, g, or t
  misc_feature (428)..(428): n is a, c, g, or t
  misc_feature (451)..(451): n is a, c, g, or t
  misc_feature (459)..(459): n is a, c, g, or t
  misc_feature (462)..(462): n is a, c, g, or t
aagctttcagtattagtgatgtcatctgtccctataggtcaaccaatccattcttaaaggacttgttatttgtttttattaanacgggttgtcttctccccaggggtcagtcctcaaggggccatcctgtccccccatgcagtgccccnagnttaangcctccctnaattccccnnggcccccncccccccntttgggcctnnccttaggagttttgtgggcattnctgnnaannagccccctggnganatgtccnnnattgggnaaattgaaaccnggaattgnggggccatttattnaaagcnnccttaaagncagnancttccccttaggggggntgggggaaaaggttaaattttgtattcaggggttttttggggcccttttgggttttttaaaaattgtttttggggggggttangnccnanccctgttttttttcagggcccanaaaatttnggnaggcttcca

SEQ ID NO: 676844 - DNA, 953 bp, Homo sapiens
  misc_feature (759)..(759): n is a, c, g, or t
agcgggaggattccttgagcccggggggttgaggctgcagtgagccatgattgtgccattgcactccagcttgggtgtcagagtgagagcctgtctcttaaaaaaaaaaaaaaaaaaaaaaaaggaaaataacggggttgtagatagtaaggtagggaaaactggttaagtacaccgagttttttaacaaaattaacaggcttttatttggagactttaatttcagtattgccattacgaggttatagtaccggttaagcgtttaacgaatccaagggtggtatcttaagagataatattctcgacaggtatatttgcaccgccaaatcgacgcatgtatatctcgagggttttatacgtacaatatttgtcacagattctattattgtcccatttgtttccctcccccattttgtggacgacaggctaacgactttcacactattcattttgggggtcaattcgccccaaggaaaacgaaaatctccatgtgtgtatctccccatttatagccagagttcgagccgtgcgctatataatatatttctgtgggcacaaactttttgccgccaagggcaccattaaggtgcagagcaagacgcccagcgaagtatgtgtgtatgttgccctagggctctgtgcgtcccaaaccatgtgtgggcaaacactctctaatgagagcttcacatcgtagatctgttctattagcgagaaaagctttgtggtcatatcatacattctgccggtggggagaagcanacgctcttgatcggatcatactataccgcggggcgcgcgaaatactccgactattacccgatttctactgtgacaacagtggggcgagatttctacacctatttagcggcagtatataaaccaacagataagacgctgggttacttagcccaggggggggttatccccttccccaagtgtgttgtgtgtgaggc

SEQ ID NO: 676845 - DNA, 291 bp, Homo sapiens
gtttttccctttttttggggggggcccggggatttaaaaactgtaaaaagcttgggccccaccccctttggggggggggggggggggggggggggagccccccccccccaagcccccgggggggtttttcctttttttttttttcgggaattggggggggtccccggtttggggggggggggccccttgggcccccggatttgggtttttttgggggggcccccccccccccccccccccggggatcgggggtttgggttttttttttttgtttcccgaaataaagaatta

SEQ ID NO: 676846 - DNA, 605 bp, Homo sapiens
  misc_feature (600)..(600): n is a, c, g, or t
ggtatatgggatctcaaaagcacagagctcaaaggagacccctgtatgcaccagagcttaggatgtgctttagaaggcattaccaaaccacgggcaaagttactttagtgtcttagtcttactaggtttgaaaagccagagaaaagactcaaggccaccatataagagcaaaacaaaaggacagggagagaatgtgaagatactgaaacattttacataaagttgtataaaacatcctttaaagaaaatgtaaagtttaggatatacatcaaaatcagcagagccactaaataaataaataggcattgtaaaatagcaagagaaaatttaaatggatttctaaaaaatattgacacctatgatttttaaaatatgtttaagaaatcccgtatttcacagggcagcctttcacaacacagatatgttaggacataaaggtccttctgtttttaatttactagtgtttatagggttacaaatgtcttctacccttgtcttttgtctgatggtgcaaaaaattttcataagcatgtatttctgaatgcctgatggattgacatatataatatgctgctagtattaaaatatgtgacggaaaangcaaa

SEQ ID NO: 676847 - DNA, 206 bp, Homo sapiens
  misc_feature (3)..(3): n is a, c, g, or t
tangaacaagtgtcagaattaaaacttcaccaggcttgttttaattagtttctagaacttaaggttttcatttgcttcagaatatgtacaaaatatcacagctacttgaatgatccttttaggatagttctggatccaccttttaggatggtgtggataaataggtgtggcctggtagatttctgtttcctaatactgatggggag

SEQ ID NO: 676848 - DNA, 155 bp, Homo sapiens
  misc_feature (103)..(104): n is a, c, g, or t
  misc_feature (108)..(109): n is a, c, g, or t
aaaaaattgtatgtcgattgaattgtactggatacattttccatttttctaaagagaagtttgatatgagcagttagaagttggaataagcaatttctactanntatnncatatctcctatgtttcacagtttccccattttaaagagaaaagca

SEQ ID NO: 676849 - DNA, 312 bp, Homo sapiens
agctcggatccgagatttctccttacaataaatcttgctgctgctcaaaaaaaaaaaataaattaaaaaaaaaaaggggggccccccatttagggccttttcccccggggaaaagtttgtccttttcctttttaaaaaaaaattgggggggtctaaaaaaaaaaaaaaaccccccctttttaaagaatttcttcgtggggaaaaaaacctttttggtggggtccctctggaaaaaaaaaggggccttttggggaaaaaaggcttattttaaaatgggccccccccctttttttttttttggaaaagaactaa

SEQ ID NO: 676850 - DNA, 1031 bp, Homo sapiens
  misc_feature (1029)..(1029): n is a, c, g, or t
ccaagctgtacctttgagggagaaaacactgtcatgagtgctccagagggctaccgttcctgatgaataagttatgatcaggtgcactcaggaagagtaggtgtgtggcagtggtgtcctatttgaactgacgctgcccagtcagcgcatccagccgacagcaggtagcagtctggcgcagactcatggtggatatcaagagcgcgccgcaaagcctaacctgatagcatatagaaactcccgggtgacagcgcagattagtaggaagattgtctgtcgagaacaagacctgtcaaaagagaagtgattcgctaggaatagaagcatgggaggtagcttggaagcctgaacattcgtgttgagccgtggtggcgagcaaggtgaggcacattgccactatgatggctaggttaggctcttttcagaaaaactcctcagaatgcaagatagaagccattcggagctggtgcttgaaggagatttatgtttgcgtgtattgctcgtggtaatggaatcaggtcagaaacgcgggggattgtccttcaggggagcatcatgaacagagcctgagattacacaagctaaagcagcgtgtagaggagttactcactcgtgattcgctcagatgctggggcttggcatgatggatttgatttgcaggatgtgacacttgggtctgtggtggcgtatgatgggaagtgtatgaaactttgtggagtgggtaaggatgcccatgacaaggagaggtcaggaatgttacagcacctgaagtagtggcgtccaagctatgagtgtccaggacaggttgagctggttagaaagggcgggtgaatgaaatgtggagctgtcgaatcaatagtttaggaagatagtggccgtttattggggggaataggataaataatgaaagaagattagtggtaagagaacaggcacgaaaagaagagaactgaggtgcggaaatagaaaacacgaagttaaagaggaaaaaaagagtacgatcgcttagattacgtctatgtgtgttanac

SEQ ID NO: 676851 - DNA, 441 bp, Homo sapiens
tattccacaggggatgaagagctatatggctagagctgtggtatgtgcactaattgagctatataacattatcgctgttgtcatccccacagcttctctgagtgatcaagtacttgttcctcattttggaatgttttgcagaatattgaatctcatagaggtgaggtaattgatccaaggtcgcatagcccagaagcaacggctataggacttaagtcttggactgtttgagcagtgtatcatactgccagtgattgccagtcatgtgccatgtatctttgtcaaataagatccttattcgtcgagtctggattggagctactgaaaggagttgtcagggtgagtggtttgcttcccctcttctcatatgttgcagagcgttgagggaatgagtattcactctcctgcttcttgtccctctggctacttcagttcaccaca

SEQ ID NO: 676852 - DNA, 562 bp, Homo sapiens
  misc_feature (52)..(52): n is a, c, g, or t
  misc_feature (202)..(202): n is a, c, g, or t
  misc_feature (338)..(339): n is a, c, g, or t
aactttttctaagtttaagagtctagagtttattgggccccctccttgggtnaattcttcccttgcccatcaccttggggccccggggtggggggaggtgtccatatcaaattgcccactctgggcaagcataaaaatttttcggaggggtttaaccggtggcgctttcaaaaacaaggcccagcgggtttggacccggctncggtggggggggtttttaacttttccaaccctccccccctgggcttttcaaaggtggagctggcgcaaatgttggtggccgaagtaaacttgtttatcaaaatggagcagcgggtggagcagggccaggccttttnngcctttttgcctgcccaaaaattaagcccggcccccccccgaacccagccctgttgttttttaattttttgcctgggcagggccccccatgcccccctaatttttcccttttggggagcccttacccttgttgtaaaaacttccgtcccccttgggagagttttttttttttatgggtaaaaaactgctgatgttgaaataaattaggtgttttggcccccca

SEQ ID NO: 676853 - DNA, 222 bp, Homo sapiens
  misc_feature (107)..(107): n is a, c, g, or t
  misc_feature (109)..(109): n is a, c, g, or t
  misc_feature (148)..(148): n is a, c, g, or t
  misc_feature (166)..(166): n is a, c, g, or t
ggagtattttgtatgaatagacatgggttagaaagtttttacgtctatcatttttatttttattaattaattaattaattaattattgagactgagtcttggctttntnacccaggctggagggcagtggtgtgatctcagcccactncaacctctgcctcctggncttaagccatcctcccacgtcagcctctcgagtatcgggactacaggcgcacatca

SEQ ID NO: 676854 - DNA, 507 bp, Homo sapiens
agaggatccttggctcaagtgatctccatcaggacgtggatatgtatggaatcaagtatgtcgagataaaaaagaagaagaggaacagaccatttgggttggagttgatgcccttggactgaatatttatgagaaagatgatagtaaccccaaagattggctttcttggagtgaaatcaggaacatctctttcaatgacaaaaagtttgtcattaaagccatcgacaagaagggacctgactttgggttttatgccccaagtctgagaatcaacaagcggatcctgcagctctgtctgggcaaccatgagttgtatatgcgccgcaggaagcctgagaccatcgaggtgcagcagatgaaggcccaggcccgggaggagaagcatcagaagcagctggagcggcaacaggtggaaacagagaagaaagggagagaaaccgtggcgagagagaaagagccgatgatgcgcgagaaggaggagttgatgctgcggctgacgggatatta

SEQ ID NO: 676855 - DNA, 208 bp, Homo sapiens
ctacacggatccccttggctcggcatcatgctttctctcctaatccccagttgtcgtcactgtgtactgagattgtgcatgtggcttatgaagaaccttgccattgaggacccagcttgaagcaatacacttcgtgagccttatcgctgcccctgggctacatctttccactctcagaccagtgttctcaccatcaaggatgatggca

SEQ ID NO: 676856 - DNA, 136 bp, Homo sapiens
ctactccctaggagaggtggatactatgaagagtaggaaagctgaaagtttagtcgcgtccccttgcaatgcacatggtgtggatggctctcaccatatcctaagagatacatagtaaaacgtggcatcgataaca

SEQ ID NO: 676857 - DNA, 758 bp, Homo sapiens
ccagaatggccacttcattccggaggctggctctcctgcttggtagggaagcgagcccgaaatgaagtgggcatatatggaaggctgcggatcccgggatcgtgaacctggagtgcatgtacgagacgcctgagaaagtgtgtgtggtgatggagaagctgcatggggacatgtggagatgatccatgaccagtgagaacggccggtgcctgaccgcctcacaagtcctcatcaccccagatccgtggtggctttgagacaccttcacttcaagaacatcgtccactgtgacttgaaaccccgaaaagtgttgctggcatgagcagagaccatctccctcaggtgacgctgtgtgactcccggctttggatcgccatcatcgcaccgacgaagccgcataccgccgacgtcacagcggctagggaacgcccggaacataaccatggagaccccgacggatgacagcctcaaacccagggcacaccaaaccgcctaacgactggaaccatggtgggtcaagggccgcagctgaacacactgctaccgtacagccatccagagaaacacataacccgtgaacacgacgagctggagcgaccatcacagagacccacaacccgagaaaagccgccccaccaaggtccccgagacaggcaacaggacaacactccacagactgcacgcccatgaaccaccacacacaaccagctgcagctgcaaatgccacaacgccccgggcgacccaaacacagcacacg

SEQ ID NO: 676858 - DNA, 438 bp, Homo sapiens
gagatgttactacaacttggtgtctacctgtggtaaattaaattgattggacatgatttggaaaggcacacacttgtctatataaggtcccatagttgacagtgcatgtcagagcaaaaaccaagcaataaggttgaaggaattgttcgtagagctccaacacaggattgtgtcgaggcacagatctgcggaagggtaccataacatttctgaagcattgaaggttcccaagaacacagtggcctccatcattcttaaatggaagaagtttggaaccaccaagacgcttcctagagctggccaccaggccaaactgagcaatcaaggggagaggagaagggccttggtcagggaggtgaccaagaacccaatggtcactctgacagagtgttcctctgtggagatgggagaaccttccagaaggacaaccgtcgacgc

SEQ ID NO: 676859 - DNA, 118 bp, Homo sapiens
tttttttcgggggggggggggggggggggggagaggaaaacaactttttcttttttaaaaaagtgttttttccccccccccccaaaaaaaaagaaaaaataaatattttaaatataca

SEQ ID NO: 676860 - DNA, 245 bp, Homo sapiens
ttacggatcttggtgtgtcatgcactacggggcattgagtcagctcccccaagatgagctgcagcccgccagagagagctctgcacgtcaccaagtaatcaggcctcagcctccaggcccccaaatccgcccagactctcccgctctggatcctgcactctaacactcgaatctgctgctcatgggaagaccagaattgatcctgattaaacacaccacggggtttcccgagctcgaaattcgta

SEQ ID NO: 676861 - DNA, 805 bp, Homo sapiens
ccaggtctgctcggtctcctggaggagggaggaaggggattaggaatcctgaggcaacatgtgcgtgagaggagcgctgtgtgtcaacttctctactctggggaagtaacctcgatcaacctgccttccttgctgagctgcatcgggtacctttgaggaaggtctagtgaaatgggtctttccagttacatctggatgtactaccagagagtgctgctgctgttgttttttttagctttgtcttactttgagtctttaaaggggcaattgtcgacactctgcaaacataccgatttgtcgtctgcccactttggagtccttcaatctgggcagtaactatttaccctttttcctgctagcctgtgcccctctctggattgaagtcacctgctaagacaatggactaccgaccagactcccggaaatcatgtggtaggatcccagtcttatttcgcctggagggcccaatgggatcattagaagccagtcctttgcgggtttcagcggcctccaggaaaggcgatccaggtgtaactccttcattgaaaaattcctccgctctcaaggaagctcaggcccaaactgagagaaacatgcacagtttaggcacaaaaacaacaatccccccaaaagagcctcagcctaacagggtggaagaagtctacgaggcttgaaaaatggacttgattgaatatctgggaggttcaccagatgaaatcggaagttgacagcccagttaagatatgaaagaactcctcgctgggtgatgtatgccaaaaagtcattaaaccagtggaggtcctcg

SEQ ID NO: 676862 - DNA, 149 bp, Homo sapiens
cgaggaggtggggctggcggggcggaactacactgtgaacacgacttggtgtggaccctgctcacaagcagctaagcctgccatcctgctgcctggcctccctgtgctgtccacctcctctgttctgtcatctcctcgtgtgctttcca

SEQ ID NO: 676863 - DNA, 315 bp, Homo sapiens
  misc_feature (291)..(291): n is a, c, g, or t
ccaattttttcctggaattttggggccaattccggtttccttttttaaaattttaataagggaacccttttccaaaacccggaatccaaatggggtttaggggaatgaaataaaatgtggtttagggtaatggaagcccttttagaacctggggggattaactttggggaaaaaggggaaaaatcccccctggtctgttaggggccccccattttagtatgggttgttggcaaagaggggtcccccgtttcaatgaaccaagtggatgttgtgtttttacgagaactaaanataaaaacaagggtttatcctgga

SEQ ID NO: 676864 - DNA, 369 bp, Homo sapiens
  misc_feature (19)..(19): n is a, c, g, or t
  misc_feature (26)..(26): n is a, c, g, or t
  misc_feature (68)..(68): n is a, c, g, or t
  misc_feature (87)..(87): n is a, c, g, or t
  misc_feature (96)..(96): n is a, c, g, or t
  misc_feature (181)..(181): n is a, c, g, or t
  misc_feature (202)..(202): n is a, c, g, or t
  misc_feature (218)..(218): n is a, c, g, or t
  misc_feature (229)..(229): n is a, c, g, or t
  misc_feature (305)..(305): n is a, c, g, or t
  misc_feature (319)..(319): n is a, c, g, or t
ctacaaatgccttcctaanaaatcantgtaattaaaatgtcttttagaaataaacttatttggaaacnagtagtaattcattagaangttagatgnagaggctgggcgcggtggctcatgcctgtaatcccagcactttggggggctgaggcaggtggatcacgaggtcaggagatcgagnccatcctggctaacacagtgnaaccctatctctgctnaaaaaaatacnaaaaattagctgggcatggtggtgggcgcctgtagtcccagctactcgggaggctgaggcaggagaatggtgtggnacccgggaggcggngcttgcagtgagccgagattgcgccactgcattccagcctgggccacaga

SEQ ID NO: 676865 - DNA, 288 bp, Homo sapiens
gccggaggatcatctaagcccaggagttccagaccagcctgggcaacatacccagctactcaggaggctgaggtgggaggaccgcccaagcccaggatgttgaggctgcagtgagccaagatcatgccatcgtacatgcctaggggacacagtgagaccagtttccaaaaaaaaaaaaaaaggggaacctttttggggaggcccttggaaaactttaaaaaactgggtttgatttggccctttttcgggggggtccccggcttgaaattcaaaataggggcaatggtt

SEQ ID NO: 676866 - DNA, 279 bp, Homo sapiens
ccgtggaccccccagagcccaggcacaagacaaaagcagcagcccagcagcccccacataggaagggaggggggcatgacccgctcccctggtggcccatccttggggcagctctctggaccctggggttccaggctcaggagagcccagagcagagtgctggttgagtctgggggctgcggcctccaccctcctatgctggcggttccttcttcctctctccgaatctccctctcacgctggtgcagctcgcctgcccttcttttttttccttcctcc

SEQ ID NO: 676867 - DNA, 220 bp, Homo sapiens
  misc_feature (123)..(123): n is a, c, g, or t
  misc_feature (167)..(167): n is a, c, g, or t
  misc_feature (174)..(174): n is a, c, g, or t
tttgtatttttaatagagacggggttttgccatgttggccaggctggttttgaactcctgacttcaggtgatctgcctgcctcggtctcccaaagtgctgggattacaggctttagcactgtnactgtctgcctggctggctggctggctggctttctttctttctnttttctntctctctctctctctctcttcctttctttcttccttccttccttcc

SEQ ID NO: 676868 - DNA, 500 bp, Homo sapiens
tctgtctcttctccattctctgtcttctgatctgtctctgtctctctttctccctctctctttcttcctcttccatctctatgtgcttctgtctgcgtctctcctcttcttctctctccatctccttcttcttctcatcttcttcttgtctctgttttggtattttctccattccctttctttcaacctctttccgtttgttgtgctcaccctccatcttctcctccatgtccatttggttctgtgtccatttatatttgtctgtttccatattttctaattctatccgctgttccttgattttcttgaagacttcctccaattcagacgtctttttgtcattgaggagggccgtctccatctccatctctctctccactctatttttcatctcctcttcacttcgtctccaatcattttctctctctctgtctctatcaaatgttctctctggttcagtcgtcgacgcggccgcgaatttagtagtagtaggcggccgc

SEQ ID NO: 676869 - DNA, 774 bp, Homo sapiens
ctcttttgaagaggggaattggtattcaccatggctggtttacttcctatgtttgaaagaaactatagaaattctctgtttctgaaggattgatagaagtgccttgatttgccacggagaccgtttggctatgggaattaacatgaccagtctagaactgtttcatttacaaatgcccgcaaatttgatgggaaggatgtccgatggatttcttctggtgaatacattcacgtatgtcgtggttcgtgctggaaggagagtgaatggatgatagaggaattgtaattcttatggtagatgaatgagatgagcccaacaattggaaatacaatctcacgttatgggctccggtgatcctctatatatgtgctttccatttgatctacaacatggttttgaacttactacgtgtagaagagattaatcctgagttacatgttggaataaatccttctatcagttttcaggattatacgagcaatttccatggagtagttatgagtaaggtaaagaatgtcagatagaacagtataataaattggtaatgcccaatgaagaaggtgtggttatctattatacagattagacgggggagccttgccttaatggggtaaagacctttgatcgaatatattcagtaatctaaaatagtgttacgttttcttagtaacaggtcgtcggtaagggtaaatgattgaggagatgactgtcggctggggagtagtggtgacttctcattgatgcatggtaagctgatctgtgaagtggatcttg

SEQ ID NO: 676870 - DNA, 329 bp, Homo sapiens
  misc_feature (79)..(79): n is a, c, g, or t
  misc_feature (170)..(170): n is a, c, g, or t
  misc_feature (179)..(179): n is a, c, g, or t
  misc_feature (276)..(276): n is a, c, g, or t
  misc_feature (315)..(315): n is a, c, g, or t
cgacacctttgaggccccaggtgaagcggggcctaactccggcctctgccttgggctcgctctgtcctcaggtcctctnagaggcagatacctaggggagctgctgctgcctgctcattctagcttccgattccattcccagcccctgcgttaaggtccctggagaggtngcgtcagtnggggtgaggaagggcatcttcctgactcctctgcccagtgctggaaggagcatgcctggggttagtgggccagggcagggcagatggggggcctttngggaccagaagggggagatgttgcttcccagagcctatnttgctgtaaagacc

SEQ ID NO: 676871 - DNA, 295 bp, Homo sapiens
atctgagaggctccccttggggtctcatattaaggtacaggctctacgacctcctgagccaactttaatgtaactggcttgcctaggctggggcttgaactcaagtaaagcaagccaaggagttcagatctagatagcagagaagtaagtctcataccaaagtattgcaaccattgttagagtccacccctatgaagctgtaacacaggcatggtgtcatctttgcactgaattctaataaagttatatattggtccagcactcaaaacaatatgttggctacagctaggtgggc

SEQ ID NO: 676872 - DNA, 196 bp, Homo sapiens
tgatgtaggtggctgcaggactgagggtggtggccatgctttgggtcagaccgtgcctgagcatataggagacacatgatgaggaggcagcaaaggatagggtggtggccgtggccctgggttgggctgtgcctgaggacattgtgggtggtgctcctgcacttggctccaggttgctgtccatctgacccatctt

SEQ ID NO: 676873 - DNA, 271 bp, Homo sapiens
caagaggtgtccatgccaagtcctcattcccatggtgatgccttatgggctccatcatgttagccagaatataccctgggagattatacctgggagacacgtagctcaacaagtacggaacatgtcttccctgctggtattggggggacaggatgaatatctgtctgataagctcactgagatatgttaggcttgttccctgtgaataatttatattttgagaaacctagtactttcaaattcatacaataatgagctgtgttatattagg

SEQ ID NO: 676874 - DNA, 612 bp, Homo sapiens
  misc_feature (19)..(19): n is a, c, g, or t
  misc_feature (61)..(61): n is a, c, g, or t
  misc_feature (85)..(85): n is a, c, g, or t
  misc_feature (87)..(87): n is a, c, g, or t
  misc_feature (100)..(101): n is a, c, g, or t
  misc_feature (149)..(149): n is a, c, g, or t
  misc_feature (179)..(179): n is a, c, g, or t
  misc_feature (191)..(191): n is a, c, g, or t
  misc_feature (194)..(194): n is a, c, g, or t
  misc_feature (196)..(196): n is a, c, g, or t
  misc_feature (211)..(211): n is a, c, g, or t
  misc_feature (222)..(222): n is a, c, g, or t
  misc_feature (229)..(229): n is a, c, g, or t
  misc_feature (238)..(238): n is a, c, g, or t
  misc_feature (267)..(267): n is a, c, g, or t
  misc_feature (278)..(278): n is a, c, g, or t
  misc_feature (282)..(282): n is a, c, g, or t
  misc_feature (293)..(293): n is a, c, g, or t
  misc_feature (295)..(295): n is a, c, g, or t
  misc_feature (376)..(377): n is a, c, g, or t
  misc_feature (400)..(400): n is a, c, g, or t
  misc_feature (471)..(471): n is a, c, g, or t
  misc_feature (475)..(475): n is a, c, g, or t
  misc_feature (501)..(501): n is a, c, g, or t
  misc_feature (525)..(525): n is a, c, g, or t
  misc_feature (531)..(531): n is a, c, g, or t
  misc_feature (570)..(570): n is a, c, g, or t
tgtgaaaaaaaagagatgnggtttagggggtaaaaaaagggccaacatagccctgaaatgnaacagcctctgagtgacttgggcngnatgtgactggggnnctgttaaaaggggagggtcctccctcctagccctgaagccccaggaanctgccttgaaagaaaagctctctaatactnaaattggggggnctngncctaacatccaaganttggtagcatntcctttntcccaaaanccagctggaactcaacttttcctaaacgnaaactcaaggncagnacaccagatgncncctgttgtttgttagggtttcaaactccagagggaatgcttttgcctgttttggttttcctctcttagggggcctgtttgnncttgggggtgtgattccactggnggctcatggggcctgggcctactctccccctgaattcacacttttttttataaggtatcaggtgggggatnagtncaagaaggtggcagagggtcccgggnaacagaggttgctcattcctgggngggatntcccccaatgccccagaggggtggggggggcgggacagnataaggacagagaaagggcagaggggtgcttggaagtgctca

SEQ ID NO: 676875 - DNA, 169 bp, Homo sapiens
  misc_feature (20)..(20): n is a, c, g, or t
gcctttcaaagacatgtggnatctgccctagtaggaggaaagctctatattgggagctctatctcagtcttagccatatcgggagcgcctgatacctgctagtcttttattatgttaaaattatcttaactttcactagtcaattatgcattattctaatcatttctta

SEQ ID NO: 676876 - DNA, 503 bp, Homo sapiens
gggcgggcgcatcggccatcaccgcgcggcgcgcagcggacaccgtgcgtaccggcctgggcgcccggcacctggggcggaccggcggaacccgaggcatgtcccatgacaagagttttcgggtgtctggggacaactatcctccaccccaacccttggatatccggggggtgccccaagccaactcattgcccacctctatgctcaagtctccctaacccatgtggccccttttaccccaaccagaccaccttgtccaagtcaaccctccacctttaaacatttctcaaaataacaccgccaatacccaaacaaaagcacctacaactactcatcccccaacgaacttcatagtccacacgccaaaatggcacaccattaccacatcaccatagttacactacccaccacatatccccaataccctcccttcaaccaaacttcatatacaacacacatctcacgacaacacaatatacaacttacatcaaacactacaaaca

SEQ ID NO: 676877 - DNA, 137 bp, Homo sapiens
tagagagacgcagaggagacagtccgcgggcagcaccagctccgaaccgggccaggccgcagcccctccccccgccgcgtggcgccaacaaaaggcggccccggaacaaaggcggcgccaccgtccgcccgcggccg

SEQ ID NO: 676878 - DNA, 1105 bp, Homo sapiens
gaataaaaaaaaaaaaaataaaaaaaaaaataaaaaaaaaaaaaaaataataaaaaaataataaaaaataaagaaaaaaaaaaaaaaaaaaaaaatataaaattatataatataggtgggggggggtgattacaagttatttgtatattggatggtggcatatttgagtgatgccgtcgctctttgttgttatattagaggtggtgtgagtgagagagttgtaggaagagagtgtaaagatttttgtccttttgttggttcttctcttgtgaaggtgcgggcgccgtggtgcgtctctgttgcggcggatgctcgctgccctcctcgaggcttctctgctcctcttgtcctcttctccgtcgcctccgcctcgcgcccgccctcccgctgcgctcccccccccccccctctactctttcctctctcttggcctttcggtgcgtcgcgtctctcccttccctcacgcacctcgacgactctctgtggccgcagtgcggtgcccgctccgccccctctcctcttctcttctcggttctcagtcttatctgtcgcgtagtatcaaggagcgcggcgcgccgccccctcgcccctccctctctttatcgtgtacgtatacgcccctccgtctacttcgcgcccgtcgccgccggcccgcctttcgaagcactactcaccctccatccacctggcctccaccactcacaccccagcacactagcaccgcaggcgagaacgccgcaacgaaccactcatacaccccagcactcgactaaccacgcaaagtcgaactatgtcgctctacgcacagcactgcgagagcagggaatcagagactgccacactcactcgtaaacacctgctccgctcgagtccatgaccatcagctccttactcactgcgcgacgctaatactataaactatgatgtgacacattctggagatcgattgcttgtgctgatagtacgagcgaacggagaacatacacgacactacccaatacaaacgcatcacacccccacgaacaccagaagaatgactagacgagcacaagacgcacaacatgcagaagcagtaatgacgaccacgcaacacaatcctagacaa

SEQ ID NO: 676879 - DNA, 415 bp, Homo sapiens
ctgtgctcactcttgatgaaggtctatcatctcccccacccttaagaagtttctttgtaattctcctcacctttgacgatgtactttatgggatccacctcctgcccccaaaacactgctcttaactccaccgcctatccccaaatctataagaaccagtgataatcacaccaccctttgttgactcctttttcggactcagcccgcctgcacccaggtgaaataaacagccatgttgctcacacaaagcatgtttggtggtctcttcacacagacacgtgagacaggagttcgagaccagcctggccaatctggtgaaactctatgtctctactaaaaatacaaaaatcagctgggcatggtggcgggcacctgtaatcccagccactcgggaagccgaggcacagattgcagt

SEQ ID NO: 676880 - DNA, 560 bp, Homo sapiens
  misc_feature (5)..(5): n is a, c, g, or t
  misc_feature (46)..(46): n is a, c, g, or t
  misc_feature (49)..(49): n is a, c, g, or t
  misc_feature (79)..(79): n is a, c, g, or t
  misc_feature (87)..(87): n is a, c, g, or t
  misc_feature (93)..(93): n is a, c, g, or t
  misc_feature (100)..(100): n is a, c, g, or t
  misc_feature (105)..(105): n is a, c, g, or t
  misc_feature (111)..(111): n is a, c, g, or t
  misc_feature (131)..(131): n is a, c, g, or t
  misc_feature (160)..(160): n is a, c, g, or t
  misc_feature (175)..(175): n is a, c, g, or t
  misc_feature (177)..(177): n is a, c, g, or t
  misc_feature (179)..(179): n is a, c, g, or t
  misc_feature (191)..(191): n is a, c, g, or t
  misc_feature (303)..(303): n is a, c, g, or t
  misc_feature (319)..(319): n is a, c, g, or t
  misc_feature (322)..(322): n is a, c, g, or t
  misc_feature (358)..(358): n is a, c, g, or t
  misc_feature (431)..(431): n is a, c, g, or t
  misc_feature (433)..(433): n is a, c, g, or t
  misc_feature (442)..(442): n is a, c, g, or t
  misc_feature (555)..(555): n is a, c, g, or t
ggcgnctgtggtggacaatgtagtgaagctccttggggaccagtantanaaaaatgccatggagcaatgccacaattanaatcctcncctctntgctgancgcanccgccncctgcctttcttggactcanaaaccggagtagcccaaagcaattgttanatctggatggaaaancnanaccggggtccangattggcctccggacaactgtactcctaccctgcccggcgctggcggaaaaaacggcgaacccatccccctgaggatccacgactttccttcccatctattaaaccaaacanaaaccaaaccctgaanaangaggggctgatctctcaggatggcagtagtttaaangctctgttgcgcactgaccccctggaaaaacgaagtgccccggatccccgagttgatgatgacaacctgggcnantttcctgtnaccaaaaatcgaacgccaaagcgatcctaaaaccacatgacttcctggatgacctcgatgatgaaaaatatgaaaaacatactcccaaacgtcggggaaaggggaaatccaanggtaa

SEQ ID NO: 676881 - DNA, 434 bp, Homo sapiens
cccctttgtattaatataaatcttctcccagtctcttgccagttttacaagccatgaatatctttctcaagggccctggagccatatatccctttgacatttaatcaagaaagacagggccctgttgctgtctctgtgggagggtaggagcctaactttgataaacaatgattagcaaatacagatggcccagtcacattcaccaatctccctgctaaagtccttcagtactttctcactcgctccttccagtgtttaaaaattctcctgttctttatgtcaccagagttgggttcaatttctctcctctatggcaatagtcttcacttatattgcaacggtcttaaataaagtcttccttgccatttttaacaagtatccagtgcaatttttctttatagggactggttgtagatcaactgcttggacagctc

SEQ ID NO: 676882 - DNA, 174 bp, Homo sapiens
aggagaatggcatgaacccgggaagcggagctgcagtgagccgagatcgcaccactgcactgcagtctgggggacagagtgagactccgtctcacacaaaaaaaaaatttaaactctccaaaaaattattacaattaagggcaaactataaaagcgagagtgttttaaattata

SEQ ID NO: 676883 - DNA, 186 bp, Homo sapiens
caatggtgtgcgtaccagtgaattaggccttgccgtggcgcatcttcaatcagcggcaccaccggcactgtgttgtcggcgttgagttcgtcgccgggaatggccaggtgctgctccgaatcctcatcggcttcgcggcggcgcttttgctgttcctgctggcgtcgctgttcctcgcgcagcaac

SEQ ID NO: 676884 - DNA, 238 bp, Homo sapiens
cggtgaataacgatggcctgttagggcgagaagaattattcgagcgctataggcgcttgccagggaggtagcgatgagagtaatagatagggctcagggtttgttataattttttatttttatgggctttgccgagggaggtaggtgagagtttgtggctaatatttttagctgtctgatgaggaatagtgtaaggagtatggggcccattatggtgtgccatacgggtgtatttagt

SEQ ID NO: 676885 - DNA, 821 bp, Homo sapiens
  misc_feature (291)..(291): n is a, c, g, or t
aacaaacataggctaggacagctggtggtaatcggcacaggcaggcttcccatgtgccgcgccattgttcccctccgctccgctacttagcctcccgcagcctctcccattggcggccgcggcgccgcggagtagccccgtcctcccttcgctcgctcccagctccgcccggcaggtggcgcgccgggcccagcgccacgtcaccgcccagcagccctcccgatgtgacggcgcggggcggctaataaagggagggcgcaggcggcgccaggatctcttccgccgccattntaaatccagctccatacaaacgctccgccgccgttagtgccgcgacccgggattgcgcgcaagaaccccctatgccgaaagctccgtcactatggaggatatgaacgagtacagcaatatagaggaatcgcagagggatccaagatcagcgcgagcaagaatcagcaggatgacggtacaagtgttatgtgaggctagagctgggatacaagcaaaaaaagatctgacagagtacttggtctcgatgggcggaagtggtagacgtgacaattaacaacagatccagtcagtgggaagatcaagaggatgggcattggggggctttcaaagatgctgcaagctgtagacaagcgttgggcaaacgtgaaaagaacacaagtgtggatgggcaaatttgatagatcccaaaaggggccaaagttttaaaaggcaaagaaacctccaaaaaggtttgggtgggtgaattaggcccggatacttctgaagaacaattaaagatattgggagcttggcaagatgacaatatgacc

SEQ ID NO: 676886 - DNA, 317 bp, Homo sapiens
gggcggcacgcgcggagcgccgggtgcggccatgcggggaccgggcccgaccccgttcccgaccccgagcccaagaaaaagctgggagcccgtgtttgaccccgagcccgagcccgagcgcgacccccggtgcggcgcggttaccccggcggaggccccgggcgcggggcgcgctctgaggcccgggggatgcgccgccgcctcgaccatgggcgccgccgtctccaggaggagggcgctgaggagcgaggccatgtcctcggtggcggccacagtgcgagcagcccgagcgcttggagaggtcccgtcccacaggt

SEQ ID NO: 676887 - DNA, 139 bp, Homo sapiens
cctagaactggagctgaacttctctgtactccctctgctctgcctcatgctctgtgaggttcttctggagagttctgcaaattgactgagcagagctgctctaatgtcccttgggatgtggcagccctgcccggtgtgg

SEQ ID NO: 676888 - DNA, 149 bp, Homo sapiens
gcacattttggttcctatcccagtgggtaagaggcacttatctctcggaaatttagctctctgaggactctcccctcccaggcatttttcatcactgggaaaggctccctattggggttcagaatccagagaaccaaaccctggatcca

SEQ ID NO: 676889 - DNA, 965 bp, Homo sapiens
  misc_feature (139)..(139): n is a, c, g, or t
  misc_feature (230)..(230): n is a, c, g, or t
  misc_feature (236)..(236): n is a, c, g, or t
  misc_feature (279)..(279): n is a, c, g, or t
  misc_feature (300)..(300): n is a, c, g, or t
  misc_feature (313)..(313): n is a, c, g, or t
  misc_feature (318)..(318): n is a, c, g, or t
  misc_feature (394)..(394): n is a, c, g, or t
  misc_feature (431)..(431): n is a, c, g, or t
aacactgtcagctacagccagtccagcttgatccacctggtggggccttcagactgcaccctgcacggctttgtgcacggaggtgtgaccatgaagctcatggatgaggtcgccgggatcgtggctgcacgccactgcnagaccaacatcgtcacagcttccgtggacgccattaattttcatgacaagatcagaaaaggctgcgtcatcaccatctcgggacgcatgancttcangagcaataagtccatggagatcgaggtgttggtggacgccgancctgttgtggacagctctcanaagcgctaccggngccgncagtgccttcttcacctacgtgtcgctgagccaggaaggcaggtcgctgcctgtgccccagctggtgcccgagacngaggacgaaagaagcgctttgaggaaggcaaagggcnggtacctgcagatgtaagggccgaagcagacaggggaccacgcggtagtcctcaaggcctagactccctctctcctgccgatctggtgcctccgaagtagccatggtcgatcgggcccagtgtccagtcacttaaagttcccccccttgggggcaaaaacccaattcacattgagagctggtgtcgtctgaagtttgcgtatcacaggtggtaactgttcttctctcctgaaaactacagaccaaagtttatttatatcattccaggatcaatgctaccagtgttgtcccaacgccggagggtgttggaccgaaaccctcggaaggcttcgagccgcgtaggtattggagaacccgacactatgagctgtggttgcgggcgaacaaagagggggcgcttaaacccggggccatacgtccctttgtaaaggccataggggtttacagacgcgcgaaacgagcgaagttggcgtgcgaccggttggacccacaagacgtaagggtgcggggagaaatattgcgcatagatggtata

SEQ ID NO: 676890 - DNA, 966 bp, Homo sapiens
  misc_feature (139)..(139): n is a, c, g, or t
  misc_feature (230)..(230): n is a, c, g, or t
  misc_feature (236)..(236): n is a, c, g, or t
  misc_feature (279)..(279): n is a, c, g, or t
  misc_feature (300)..(300): n is a, c, g, or t
  misc_feature (313)..(313): n is a, c, g, or t
  misc_feature (318)..(318): n is a, c, g, or t
  misc_feature (394)..(394): n is a, c, g, or t
  misc_feature (431)..(431): n is a, c, g, or t
aacactgtcagctacagccagtccagcttgatccacctggtggggccttcagactgcaccctgcacggctttgtgcacggaggtgtgaccatgaagctcatggatgaggtcgccgggatcgtggctgcacgccactgcnagaccaacatcgtcacagcttccgtggacgccattaattttcatgacaagatcagaaaaggctgcgtcatcaccatctcgggacgcatgancttcangagcaataagtccatggagatcgaggtgttggtggacgccgancctgttgtggacagctctcanaagcgctaccggngccgncagtgccttcttcacctacgtgtcgctgagccaggaaggcaggtcgctgcctgtgccccagctggtgcccgagacngaggacgaaagaagcgctttgaggaaggcaaagggcnggtacctgcagatgacggcgaagcgaggcgagggcgcacgctggagatcgtcatgccgtatgagctcccgtcctctgtgccagtggtgccttcgagtagccatggctaagacggtgcccagtgtcaacatgtcacttacgaagttccccccttgggcataaattcccaattcacacttgaggagcgtggtgttagtctgaagttttcgtatcacagtgttcacgctgtgcttcctcttcctgtgataacctactagcatcgaaagcgtttgtggatatcctttcccaggtattgacttggctaccacagtgtttgtctccgagctgccgaggtagggcgtggggcctgtacctcctcggggaagtgctttccgatgcccccgctgctggggtatcgggccgggccctgctgcatctgctttaaagttgcttgcttggttgggacaacgctgctcctcggcctcgtttcagttcccctgtcacaggcgggggcgcttcctctgcgtccgcgcaagccttcctcttcctgccacttc

SEQ ID NO: 676891 - DNA, 118 bp, Homo sapiens
ctgtgtacacaccacgtcttctcttcctggccataccggaaccacctgacttcaatgctgcctggatacgcaaaccactcacagaacacaccaagaggttgtggctgctgcatgggct

SEQ ID NO: 676892 - DNA, 752 bp, Homo sapiens
  misc_feature (180)..(180): n is a, c, g, or t
  misc_feature (217)..(217): n is a, c, g, or t
acatcaagcacatggctactcgaggcaccagtggcaagacgagggagtctatggctgaggctccgcgtggccctgtcacttcgccgggatctgcaggtaccgacctttgccttcttcacctacgtgtcgctgagccaggaaggcaggtcgctgcctgtgccccagctggtgcccgagacngaggacgaaagaagcgctttgaggaaggcaaagggcnggtacctgcagatgacggcgaagcgaggcgagggcgcacgctggagatcgtcatgccgtatgagctcccgtcctctgtgccagtggtgccttcgagtagccatggctaagacggtgcccagtgtcaacatgtcacttacgaagttccccccttgggcataaattcccaattcacacttgaggagcgtggtgttagtctgaagttttcgtatcacagtgttcacgctgtgcttcctcttcctgtgataacctactagcatcgaaagcgtttgtggatatcctttcccaggtattgacttggctaccacagtgtttgtctccgagctgccgaggtagggcgtggggcctgtacctcctcggggaagtgctttccgatgcccccgctgctggggtatcgggccgggccctgctgcatctgctttaaagttgcttgcttggttgggacaacgctgctcctcggcctcgtttcagttcccctgtcacaggcgggggcgcttcctctgcgtccgcgcaagccttcctcttcctgccacttc

SEQ ID NO: 676893 - DNA, 982 bp, Homo sapiens
cgagaccgttatctactctagcatcttagcagcgccctactccatcgacagcgctgagctcagaaatgattgaacactcgtggagtaggcctaaaatagagctgctagtctttcattccagttctaaccagaaaaataaaccctcgtcccacagaagctgccatcaagtattgcctcacgtcgatagccaagcgcaatccataatccttctaataggctatcctcttcaacaatatactctccggacaatgaaccataaccaatactaccaatcaatacctcatcattaataatcataatggctatagcaataaaactaagaatagccccctttcacattctgagtcccaaaggttacgccaaggcaacccctctgacatccggcctgacttcttctcacatgacgaaaaattatcccccatctcaatcatataccaaatctctccctcactaatacgtaagccttctcctcacgtacctctcaatcttatccatcatagcaggcatcttgaggtggattaaaccaaaaaccagctacgcaaaatcttagcatattcctcaattacccacatacgatgagtaatagcagtctaccgtaacaacctaacataaccattcttaatttaactataaatattatctaaatacaaacaaatctactactcaaattacatcctaacaccaagactagtatatcctgcaccggaacagctacatgattacacccttattccatcggcctcactcctagaaggcgccccggtaacgtattgccactgggcgtatgacaaaccaagagaaagcttgatgccacagaatggtctcgcctctagtgcttacagcctcacaacccgaaacgatccattaaggaaaatgagtaaaacaccttccagaggacgaacacaacgtaatcaaagggatcgacacgcatgtagaaaaaagagatggtcaaaacataatatttcagcatcgcgacaggatc

SEQ ID NO: 676894 - DNA, 616 bp, Homo sapiens
ctcaacgctttatacttcttctggttttacccatcagttaattcatttaactacgggttttacatttctgtctctagccacttttgttgtaacttcccttccttacctttacaaaaccatcattatctattttgacagtgggatatgaaggggggaaaagaatccacacaagttcctccttttcattttgcctcctaaaaacacagggtcttggcattttaagaatttttatgccaatcactacggaaaagtagcaaaattagtacacaaaagacacactctggaatctacaaggcagtattcttaaggatttctgcctctatctacattttcaagccactattccttaacagcaagcatttattttcatatcagagtgttggtttttttgagactgagtctcgctttgtcacccaggccagagtgcagtagccaatctcagctcactgcaccctctgcctcccaggcttcgagcgattctcctgcctcagcttcccgagtagctgggactacaggcacgcaccaccacgcccagctaatttttgtatttttagtagggatggggtttcaccatgttggccaggatggtctcaaacacctgacctcaggtaatcca

SEQ ID NO: 676895 - DNA, 988 bp, Homo sapiens
gcatcacatcggtggtctccatgctgtcctcccgtatcgagatccgagaaatacgcaacggactactgatcttatcagtgacttggagttcacccccgtgtgaacctacacatatttcctcagtacttacacagcttcataactgctagcgtcttccttcaaagaggaatctgccgatccagtagtgacctcataggtcgagtgagactgcgattgtcatccatggaacacacgtaccatgagtggtcacacgattcccaggtacaatgtgcgattccgactgttgaacacagggcttctggtccagtgatgccatttgagtgtgtgacgcgtccccaatagtgctgtgagacgacatgcgtaatgatgtaccatgaatttgcccagatatttgggtcagactttgtgccataatctgagtagatctcgaagtattagcttcgtcgtgaaactagctctggttaagtctagtattgtgttttttgggatttccccatttttggggcttgttgatacgatcgagattgcacacggtgagtaccgttgtggtatgcctgagccaaagactcaactgagggacacccttctcttgtaaggctcgtttgtgtcacaatgattaggtcatgaaccttacggaaatcgcaaaggtgtggtgagccatcggacacccttgtgttactccctgagacgagattggtctttaccgatgcattgtccaggatatatgcgtggtggtgcgacagcgcacctggggagacacggtttaattgatgcgaccacagcgttggtatgacgacaggctcatgagagtgttaagcgtgtaaggctacacataatcggcgttccgaggagaccccgtttttgtcccagccatgttccacttcaccgtcgtgacagggtgctcccaggtggacttaagtatcctgtctagcaagcaggtgggtcgcctaagtggaacaggttctcgcttgagcaaggcaacgggaaa

SEQ ID NO: 676896 - DNA, 125 bp, Homo sapiens
ccaaacaagagtcctgaaaggcggacatggttaacgaccgtgttcacagaccacagcacattagaaccagggagctatcaggagacttgagatggtagtttcaggataaaccagaggcagcgcta

SEQ ID NO: 676897 - DNA, 129 bp, Homo sapiens
gggaaaaggtctgtggtactctttatacctgtttctgtttttggtggtccctttcttttaattttaaagggccttaatggccgggctgggggggtctggtgagaccccggtctccacaggggtaccgga

SEQ ID NO: 676898 - DNA, 290 bp, Homo sapiens
ggagctcggcccttatacccacgatcaccgaaacaaacactgggttttgcaaagttaaatgaaattgacaaacctgtatccagactaagaaaataaaagaagacacaaataaataaaataagagatgaaaaaggagacattacagctgatagcacagaaaagcaaatgatcattagtggctaatatgagtaacaatatgccaataaatttgaaaatctaaaagaaatgaacggattttagacacatacaacctaccaagattgaaccaggaagaaatccaaaacctgaac

SEQ ID NO: 676899 - DNA, 355 bp, Homo sapiens
gtgctgaggtgatctagaggatctcgcccacggtcatattctcctgctcagcctcccaagtagctgggattacaggcgcccactaccacgcccggctaattttttttttttggtatttggcagtagagacggggtttcaccacgtgggccaggcttgtctcctgacctcaggtgatccgccctccttggcctcccatggtgtggggataacaggcgtgagccattgagcccagcctgtcatgttttaaaataaaaaaacctagggtatgttactctaaagtccccagctcccattagtttttcgggatatgagagcatatcatggtctggtcctttgggggaaatctaccggggg

SEQ ID NO: 676900 - DNA, 1018 bp, Homo sapiens
ggtcgcttcgtgtctgttgaacggctgtgggcgtcttgctgccttgggctagggcggcttaaaactcgttcttgagaggaaccgtctctgtccgacagagactacatgacgttctacgctctgacgcaagtgacgcttgtacgctggacacaaacacaagaggaaaaacacacacgacagagaactgctctgcaggaaccagacaacaacgaacacttaacagcatgcttttgacactaccttgactacacgacaaacgactgaacggcaactagacttatcactgcaacttacacacgcgtgcgcaactgcagagccctttggcgcgtcctcgactgtcacacacacacaggctgcatgtacctgaacgacttctctcaaacgcacttactgaccagagacagcacacaggcgaaaactcagcctttgacacgattctctaactgacagttgctgacacgacctggactactcgcgacacacgagatccgccattgaagaacatacttcaacgggcattttacaacctacttctgactgactgcatgattccacggtcaaccactaaggcttgacggacctttcgcgacgtgttcgctagacgaacttggcgtgaaacaccatgagtgatgcaagcaaacttcgaagcctatgactacgaagacattctgacaacgatggtgactggacgaaactaaaccaagacggagttccatttgctagtttatgacctggtgacattctagccgatttacaacggcttaaacactaagaactgttgcagtttaccactctttatatcctacttttgtgcctgggcggccatgttgaaaagacaacccaactttactcccttttatcccttaaaggaacccaacacttatgcttcttatattatccggtctttttagctaacttgttaaccgttcgcttcgatatgaaactgtgtttgtcagatctccaaatcgtcaaagcgtcgggtttgtatatatacccttcattatacagcttctacacc

SEQ ID NO: 676901 - DNA, 495 bp, Homo sapiens
gtgtgcaactcaacaaagaccatccgcatcaagctcagcccacgtgcttccaagaggcaaactttaccttacacttagccaagaattatttcacctgcgttgtatcacttttcgcaataaccccgtgaagacagtaggatgacttcttatgtgtggctacagaatccatgaaggctcagaagactaatgtaatagaagactgcaatgacagggttacctcccattaacaaaagatacttgactttcctgtacctattcataagaagagggcctcaattcaacagtccccaaagtggggaagcaatcaaggctggacttgagttccaccagattggtcagagacctccactatgcagtatactgaaggaaaggctgcctttgattgacaggtagtttccttttccctagaaaatgaagccatctctaggcagcgtcctgggttacgatacactagtccatgcaccttgtacttatgaatatgtgtatgaaggaatg

SEQ ID NO: 676902 - DNA, 529 bp, Homo sapiens
gactttgtgccccatgagcctgtgtacccagtgagcctatgccccctgagtctgtgccctgtgagcctgtgtgctctgtgaatctgtgccccgtgagcctgtgtgccccatgagcctgtgtgctctgtgagtctgtgccctatgagcctgtgtgccctgtgactctgtgccctgtgagcctgtgtgccccatgactctgtgccccgtgagcctgtgtgccctgtgagtctatgccccatgagcctgtgtgccccatgactctgtgccccataagcctgtgtgccccgtgtcctgtgccccgtgagcctgtgtgctctgtgagtctgtgccctgtgagtctctgtgccccgtgagcctgtgtgccctgtgactgtgccccgtaagcctgtgccccatgagcatctgtgatctgtgagtctgtgccccgtgactctgtgccccataagcctgtttgccccgtgtcctgtgccccgtgagcctgtgtgctctgtgagtctgtgccctgtgagtttctgggccccgtgagcct

SEQ ID NO: 676903 - DNA, 574 bp, Homo sapiens
tggcggggggggtaactctttatttcatggtccggaaaaaagatgggagtgggaacagggtggacactgtgcaggcttcagctttccacttccgggcaggattcagggctatcttgggaccgcagggactgccaggtgcacagcccgtggcttcccgaggcaggcaggcaaggttgacgggactggaagcccttttcaagagccttggagagagctgtgtccgctccacaagcaatgtgacgtgtgccacttctgtgcagtttgtgcaggggagtggattaacacggggaaacactgtggtgcatttcctctcaacagccaacagtgtgataggctctggggagaagcccccggggcgtgagctataagcttcagggcgtgttccagggggagagccaccaaaaagcgtgacacggtatagggtgatgtggtgacaaaaggagttccaactccggtgacaaggttttctcccaggcccaatgtgagaaaaaactctccgtcgcgtggcggttgtggtggagacccgtggtgggaagttactccggaagaacacttcttccaagtggcgggggtt

SEQ ID NO: 676904 - DNA, 396 bp, Homo sapiens
tacggagctcagttctttcatgaaggacaggtgcgcagcgttgactcgggaaatcctattgcatgcgtagtcctttgtatgattataggcgtgatcagtagtagttacgggttgaacattgtttgttggtgtatatattgtaattaaaattgctcgggggaataggttatgtgattaggagtagggttaggatgagtgggaagacgaaagagaggaagtcacagtttacattcatgccttatagggttgaggtgatgatggcaggtggagatttggtgctgtgaaattgtataaggtaatagcttatctagtcaggttaggtctaggaggagtcaggtcaggtatatggctcgtaaagaaggcctagattagggggatttgtgcggtaacaagctt

SEQ ID NO: 676905 - DNA, 162 bp, Homo sapiens
gatgatgacacaggtccagctggtgggtctcttctgccccagtgcccttccccttgggctgtgttggagtgagcacctcctctgtaggcacctctcacactgtatgtctgttactgattatatattgataaaacagatcataaacacctggtactttctaat

SEQ ID NO: 676906 - DNA, 498 bp, Homo sapiens
acatttatgtaaacattttaaatattcaaagtatataaatgtgaagtcctatcaagagtaattagacaagagaaagaaataaagggcattcaaatcggaaaggaggacatcaaattgttcctatttgcagatgacatgatgttatatataggaaaacctgaagactaccagaaaacttttagaacaaacgaaattcagtgaagttgcaagacacaaaactaatacacgaagatgggttgcatttatatatatgaacagcaaacttgctgaaagaagaaattaagaaggcaaacccatttacaatagttaccaaaaaaaaaaaaaacccggatcttaatgggttacccaggggggtgacaagtggaagaccttaccaaaacctctattggacaagaatttggaacgaggatacaacacaatgtggaaaggactttccatactccgtgggttccagaattttggactggtgcggtcacacggggacggtcctatctcaaa

SEQ ID NO: 676907 - DNA, 1027 bp, Homo sapiens
ggctgcacgggcttcgcgggcgccacgtgtgaggccgtgctttgtgctgtgtcattgcgccgtgccctgggtgggtgtgttggcatgtggctgggacttggtgtgctcctcccagtgctcgtgtgtgctgtgtgctgcgtgatgtgtgctgctgcgctctcctgtgcccctgcccctctggcatgtgttgcccgctgaccctgctgtgtcccctgtgctgcctggcctgccttagtctcctctcctgcatggtagctagtccctggctagggaggtctgcctggccatgttggctgctatcagtggacctgtagcttggtggcttggacacgatgcgatgtctcataggagctcgtgttgccatgcagccttgccttgcgcagcatagctagcttgccatgatttccacctcatctggacccatgcattgagaaccttcagtgaaaacatgcagatttagaaagaagcttagacagcggacaaagaacgttacgtccctaaacgttgtacattcactgacagcaagaccacttcgggacattccgtgttggccacacatcaggaccttacttcaacgcacgtgcgccaactaattcaatgacacaactgggatattcgagggactggactcagttcttgaaaccagtttcttttcttgaaacagagaacaatgtcccctgaagacagagcaacaattgcttcgaccaagaactgaggccatacaggcagaccatgatgccgtggcacacggaaggccaatgtcagggtagatgacaaggtgaataccactttcattctagttaacaacgtggattgcacctctatcgactttgatggaggattgcctttccggtgaaccatggtgccacgtcagactgacaccctgtgtgaacagagctgaccacagcctgcagcacaattacccgaaggatgacccagcacaagcccgattctcgcggcggtcactgcaagcagcaaagcgctgtggaagcgattagcagatccctatccttaaatcaatattccc

SEQ ID NO: 676908 - DNA, 1061 bp, Homo sapiens
gctacctcagtaccattctgttgggcgacgatctggccctgagctatcgtaattcgatacattgatcattgaagcatgattgccctatggaacatcctgggtcattgaacgtcatgttgcatgtgtgtacttgttgacccgaataagaaatatcgtgcgtgcgtcctgacacgcgatcgatgcatgtcatgcgaagtctcgaccatggcagttctcgtatgcggtccatttcacatgggcccttctcaatccagacgaggggcaatggtcccggaggacggaggcccttcctgcagtagtcagatagtattagcgacgctcgtgcgccatgtagttcaacccaatctcccttgcaaccaaagacgctggaacacgaaggggccccaagaaagggggcatttacagcgaattagtagagaaggcacacaagggcctgacacacacttgacaaaaccaacaacttgtgaatgcgcccttacattgggcctttcccctggaattgcaaggagaagagccccaaaggaacaaacaggaaacagttggaggaaggcttctgaaggagaagaaagattcacataacattaaaacacccattaaaggcgttccagtggaacggccggtcacttggccaagaaagaggtcgggacgactggacattggagaacagggaggaaaaaacgcaagggttcttttaaacggcgcgttgcaagcacatttcgggcgggagaccaaagcaaaggttacattatccccccaaagagttcccccaaggggaatctcccgaggccttccacgcttgcagggggccggcccccacaaaagagctgacctaggactttcggttggcattagacttagcaggacccttacaagggggctttccttggcctgggccaagtaggacaggaattcccaccaggagacaaagcctggcgcaaccattccatggcgaaacaggggtccacggaccatatggcttccggacttttaaaccgcactttggacaaccattttccccctttggactcttccattcaagttcttgaaggcgggagtccatg

SEQ ID NO: 676909 - DNA, 959 bp, Homo sapiens
  misc_feature (2)..(2): n is a, c, g, or t
  misc_feature (79)..(79): n is a, c, g, or t
  misc_feature (99)..(99): n is a, c, g, or t
  misc_feature (103)..(103): n is a, c, g, or t
  misc_feature (129)..(129): n is a, c, g, or t
  misc_feature (153)..(153): n is a, c, g, or t
  misc_feature (194)..(194): n is a, c, g, or t
  misc_feature (196)..(199): n is a, c, g, or t
  misc_feature (210)..(210): n is a, c, g, or t
  misc_feature (213)..(214): n is a, c, g, or t
  misc_feature (224)..(224): n is a, c, g, or t
  misc_feature (233)..(233): n is a, c, g, or t
  misc_feature (237)..(238): n is a, c, g, or t
  misc_feature (242)..(243): n is a, c, g, or t
  misc_feature (255)..(255): n is a, c, g, or t
  misc_feature (266)..(267): n is a, c, g, or t
  misc_feature (271)..(271): n is a, c, g, or t
  misc_feature (273)..(273): n is a, c, g, or t
  misc_feature (275)..(275): n is a, c, g, or t
  misc_feature (278)..(278): n is a, c, g, or t
  misc_feature (282)..(282): n is a, c, g, or t
  misc_feature (289)..(289): n is a, c, g, or t
  misc_feature (304)..(305): n is a, c, g, or t
  misc_feature (308)..(308): n is a, c, g, or t
  misc_feature (311)..(311): n is a, c, g, or t
  misc_feature (320)..(320): n is a, c, g, or t
  misc_feature (324)..(324): n is a, c, g, or t
  misc_feature (330)..(330): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (361)..(362): n is a, c, g, or t
  misc_feature (365)..(365): n is a, c, g, or t
  misc_feature (381)..(381): n is a, c, g, or t
  misc_feature (408)..(408): n is a, c, g, or t
  misc_feature (412)..(412): n is a, c, g, or t
  misc_feature (419)..(419): n is a, c, g, or t
  misc_feature (421)..(423): n is a, c, g, or t
  misc_feature (425)..(425): n is a, c, g, or t
  misc_feature (427)..(427): n is a, c, g, or t
  misc_feature (429)..(429): n is a, c, g, or t
  misc_feature (431)..(431): n is a, c, g, or t
  misc_feature (433)..(433): n is a, c, g, or t
  misc_feature (435)..(440): n is a, c, g, or t
  misc_feature (442)..(442): n is a, c, g, or t
  misc_feature (445)..(446): n is a, c, g, or t
  misc_feature (448)..(448): n is a, c, g, or t
  misc_feature (469)..(470): n is a, c, g, or t
  misc_feature (475)..(475): n is a, c, g, or t
  misc_feature (482)..(482): n is a, c, g, or t
  misc_feature (485)..(485): n is a, c, g, or t
  misc_feature (500)..(500): n is a, c, g, or t
  misc_feature (502)..(502): n is a, c, g, or t
  misc_feature (513)..(513): n is a, c, g, or t
  misc_feature (519)..(519): n is a, c, g, or t
  misc_feature (521)..(521): n is a, c, g, or t
  misc_feature (530)..(530): n is a, c, g, or t
  misc_feature (548)..(548): n is a, c, g, or t
  misc_feature (550)..(550): n is a, c, g, or t
  misc_feature (626)..(626): n is a, c, g, or t
  misc_feature (631)..(631): n is a, c, g, or t
  misc_feature (927)..(927): n is a, c, g, or t
anagtttatgaaggtggtttctcctgactccatgcatcttttacacaaagatgcccccttaaatatgccccgttatctnccccacctcagtgctggagnactngcagttagtaagtgggcagaatcttnagtctcaggaaggtttttaaaggnatttttgtggggaggaagttgtgggtgaaggggaaaggttngnnnnaagagtgagtnttnnattgtgcatnttgctgggnaatnnaaannccaaaggttttntgaagaaaagnncctntntnagngacntagaganagggagagcacaganntantgnttgggtgtnaggntgaggnagagagagggtaggttgnagngantggaganncangggagagagtaaatgnatgtcggggaggtgaggggagagaganagcntagaggngnnngngntngntngnnnnnntnggnngntgtgagtagaaagttttgttnngaagngtagaanggngttttagttttaggnantgggtttggtncaggananagagaaganaaacgagggaagggtggnanaggtagtaagggtggacagttaaggtagctaactaagagatggacactcgcgactgcagttttgaagctatatgcnagatnagggtacagaatgcattttatatgccctgttcaatacaatttaaatcgctgtttcttccatgttgtcccttccctatgaactattcccaaagcctcttccaaggcagaggacagggcagtaagaaggaatggaagaaaacactgaggtcactaagtggggttagggcttagattggataaatccctacccatccccgcccccactcgttctatagaaaagaattctctttctctctccccttgctgggctgttgggatgagggccaggtagaggcaaagggaggaaaacactcagnacattctttctcctactttaatctgaagtgta

SEQ ID NO: 676910 - DNA, 441 bp, Homo sapiens
  misc_feature (121)..(121): n is a, c, g, or t
  misc_feature (390)..(390): n is a, c, g, or t
  misc_feature (437)..(437): n is a, c, g, or t
tttttgtacttttagtagagacagggtttctccatgttggtcaggctggtcacgaacccctgacttcaggtgatccacctgcctcggcctcgcaaagtgctgggattacaggcgtgacacncaagcctggcctagtttttttatttttagtagagacacggtcttgctgtgttgctcaggctggtctcgaacgtctggcctcaagcaatctgcctgtcttagcctcctgaagtgctgggattacagggcgtgagtgggcctgtattttctttcttatttattctgtgggtaaaacttttaaaacacagacaacatctgtgttaatccaaaaacaaaacaggattcccataggagttgcttttgaaaggtgacttaggagtcagacaatcnggggttccacaaccaggggccctttacggggggggatttttcccggnaacc

SEQ ID NO: 676911 - DNA, 453 bp, Homo sapiens
gatccatatttcaaagaatgaagaaagatttgaccccttcctgtatgttctcaataatggtaaatgatggccattgtttatgttctttgctcagctctttctggttgtctggaaacagttatttaaaaacaaagttgcatctgtaagccttattatctccaaaatagaatgcacaataattttgaaaacagtttgcattctggagcttgacagaaaactcaggtaaggtaaccactgttagagcaacaagctgatttcgaggtaggtgtctccagagtaatatactaaatttaagagaatcagggaagggctaatggaaaatgatgtagatctgaggtcaacaaataatagcctgtttttgtaaatgcagttttattagaactgttgcggagggaaagttcttccttaggttcagtatcatggacgtgcaaatgaaagtaaccaaaaacatgt

SEQ ID NO: 676912 - DNA, 681 bp, Homo sapiens
  misc_feature (61)..(62): n is a, c, g, or t
  misc_feature (65)..(65): n is a, c, g, or t
  misc_feature (68)..(69): n is a, c, g, or t
  misc_feature (72)..(73): n is a, c, g, or t
  misc_feature (80)..(81): n is a, c, g, or t
  misc_feature (539)..(539): n is a, c, g, or t
  misc_feature (555)..(555): n is a, c, g, or t
  misc_feature (575)..(575): n is a, c, g, or t
  misc_feature (581)..(581): n is a, c, g, or t
  misc_feature (587)..(587): n is a, c, g, or t
  misc_feature (606)..(606): n is a, c, g, or t
  misc_feature (616)..(616): n is a, c, g, or t
aagaaagtgaggactgggccgggcgcggtggctcatgcctgtaatcccagcactttgggannccnagnnggnnggatcannagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggcttggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgcccccttggcatgggtgagacctgccagtcagatggtagttganggtgactttcctgctngctggcctttataatttacntactantttganatgtttgacaaattgactnatttgggggnatttggcctggattggtctcaattttaatctgaaatgaacctcgaaggaaatgtaaaactggggg

SEQ ID NO: 676913 - DNA, 173 bp, Homo sapiens
  misc_feature (12)..(13): n is a, c, g, or t
ctcccaaacagnngtctcatgagcacccatagcccccatctatggacaggctgggacagaggcagatgggtaagatcacacataacaagagggtctatgtcatatcccaagtgaacttgagccctgtatgggctcaagagatagaagacaaaatctgtctcccacgtctgcca

SEQ ID NO: 676914 - DNA, 113 bp, Homo sapiens
cggactccccctaatcgcgcgctccgtaccgacgcgccactggacggagactggggctgttaggacgttacggaaggggttaggagggctgttacggatgcgctcgttacgga

SEQ ID NO: 676915 - DNA, 700 bp, Homo sapiens
  misc_feature (61)..(62): n is a, c, g, or t
  misc_feature (65)..(65): n is a, c, g, or t
  misc_feature (68)..(69): n is a, c, g, or t
  misc_feature (72)..(73): n is a, c, g, or t
  misc_feature (80)..(81): n is a, c, g, or t
  misc_feature (539)..(539): n is a, c, g, or t
  misc_feature (555)..(555): n is a, c, g, or t
  misc_feature (575)..(575): n is a, c, g, or t
  misc_feature (581)..(581): n is a, c, g, or t
  misc_feature (587)..(587): n is a, c, g, or t
  misc_feature (606)..(606): n is a, c, g, or t
  misc_feature (616)..(616): n is a, c, g, or t
aagaaagtgaggactgggccgggcgcggtggctcatgcctgtaatcccagcactttgggannccnagnnggnnggatcannagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggcttggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgcccccttggcatgggtgagacctgccagtcagatggtagttganggtgactttcctgctngctggcctttataatttacntactantttganatgtttgacaaattgactnatttgggggnatttttggaaccgggaaggggtcatcaaatttttaatctggaaattggaaccccaaaaggtaaaaaagaaaaaacttgggggga

SEQ ID NO: 676916 - DNA, 1004 bp, Homo sapiens
  misc_feature (843)..(843): n is a, c, g, or t
  misc_feature (859)..(859): n is a, c, g, or t
  misc_feature (879)..(879): n is a, c, g, or t
  misc_feature (885)..(885): n is a, c, g, or t
  misc_feature (891)..(891): n is a, c, g, or t
  misc_feature (910)..(910): n is a, c, g, or t
  misc_feature (920)..(920): n is a, c, g, or t
ggtgatgacctctccagtgtacctctcttgcccgcgcctggcctaccgctgtcactcccgtctgcacgctttgatatggacctctcacagtagcctcgtggacctacaaccaagtagagtccgggcccgttcaccctgaccataagtggcacgagacatccggagcacccgatgaaatgtcacctacgccggggacgatcttgtacaagctgggcaaagtgctgcatgcccaaccagtgttcaagaatagacccaccatgaatttcgtgcgatgggtctcgattcaggggaagctctacgagcttggtcctgaccacacgcccggagtagtcctcccagtcaggaaaggatccctacacatactagtagaagaatggctactctatattccctggatgtctcgaagcgaggtgcaagggagcggagtgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggcttggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgcccccttggcatgggtgagacctgccagtcagatggtagttganggtgactttcctgctngctggcctttataatttacntactantttganatgtttgacaaattgactnatttgggggnatttttggaaccgggaaggggtcatcaaatttttaatctggaaattggaaccccaaaaggtaaaaaagaaaaaacttgggggga

SEQ ID NO: 676917 - DNA, 738 bp, Homo sapiens
  misc_feature (61)..(62): n is a, c, g, or t
  misc_feature (65)..(65): n is a, c, g, or t
  misc_feature (68)..(69): n is a, c, g, or t
  misc_feature (72)..(73): n is a, c, g, or t
  misc_feature (80)..(81): n is a, c, g, or t
  misc_feature (288)..(288): n is a, c, g, or t
  misc_feature (577)..(577): n is a, c, g, or t
  misc_feature (593)..(593): n is a, c, g, or t
  misc_feature (613)..(613): n is a, c, g, or t
  misc_feature (619)..(619): n is a, c, g, or t
  misc_feature (625)..(625): n is a, c, g, or t
  misc_feature (644)..(644): n is a, c, g, or t
  misc_feature (654)..(654): n is a, c, g, or t
aagaaagtgaggactgggccgggcgcggtggctcatgcctgtaatcccagcactttgggannccnagnnggnnggatcannagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatccagatcggttgctgaggatgggctcgtcacatgtacgantcagcaaccgatctggagaccaccgtggcaaattcaaggtggcgtccttccgtaaaaagtatgagctcagggccccggtggcttggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgcccccttggcatgggtgagacctgccagtcagatggtagttganggtgactttcctgctngctggcctttataatttacntactantttganatgtttgacaaattgactnatttgggggnatttttggaaccgggaaggggtcatcaaatttttaatctggaaattggaaccccaaaaggtaaaaaagaaaaaacttgggggga

SEQ ID NO: 676918 - DNA, 407 bp, Homo sapiens
aaggtgctatgaaaaggaaagttgaagtagaggaactgtgtggatgatcttccgtactggagatggggctgtagcagctgttgactgtctgctaatggcagacaggctttcctggcagaggtccctgattctgaggaaggggagtccgggtggactgacacagagtcagattcagactctgagcccgagacccagtgcagagggaggggaagaagacccgttgccatgcagaagcgcccctttccttatgacattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggccc

SEQ ID NO: 676919 - DNA, 450 bp, Homo sapiens
caggagtttctcactgtagccaccatagctggaaatatgctgggtctcacctgaagccagcacatcacagaagctcacccaagacccacagcgtactaactaggtattgctgctggttcctcagggcccaagggcactttagtcagcaggtaaagaatgccaccaggactggatccttctcttcaaggcaggagtttcccctctggcccagggtgtgtctacatatgtcatccagaagctagggcctgatgactccgcccagtgccctatcctccagtggttgagctggtatccaagatgtaagataaaagtactatgtactcttacctctcctcttctcaagcggaaggagggggtcttttttgaagctacaagctgtgcgcccaaaactgacggaggggtggcacatgtactacctcagacgccatggctggagtctcactaggtcat

SEQ ID NO: 676920 - DNA, 138 bp, Homo sapiens
ataacggcaactcgaattgacgggtcgcttgaattgacgggtccgtcagtccctagatcttcagcagatactctaggttcccaatatactcaacggccaactttagaacacgaacagctataaagcatcatccatcct

SEQ ID NO: 676921 - DNA, 206 bp, Homo sapiens
ttgggatgctttcccagaatggcggatgtgcgcggcgatcaggtcgacgtgcttgtgcccagttgcgggttcttttcccagcatgtgcccttgctcggaggtggtcaccgggactttcacggcggcgcgcacgcggtcgagctgcacgatcaggccttcgggggtgatttcttcccggaacaccgcttcgttgcccaccactacgc

SEQ ID NO: 676922 - DNA, 489 bp, Homo sapiens
  misc_feature (210)..(210): n is a, c, g, or t
  misc_feature (217)..(218): n is a, c, g, or t
ggagccaagctggtctggcaagggcgctcaggcctgggagagaagggagcaatggccagtcaccttcaccttctaactaactagcctccggatgaggtggctgccaccaggcccgaatgatccccaggagcccagcttccaaaccccaacatcgaatcaaacatcccatccccaagtgcagtaacacacaaaaaccaaaaaaaaaaaaanccccaanncttctggccccctgggaaaggcctggtgcgattctcagtaggactcacacccaccctacctagaagtactgggctggcctgggtactgcatccgtgtgttttgataagggggtgatgtggccacgcccttatctagatttcactttgtatccactgggcacagatattctagagaacttatctttcactcttgtaaaagccacatatccacatctctttcattttctcagtgtgttatgcagcaatttattaaagtatttattgtctaata

SEQ ID NO: 676923 - DNA, 721 bp, Homo sapiens
tgccgcccgagatgatctcttagaagtccccttaactaatcctgaccttaacctatatactgatggaagttcatttgtggagaatgggatacgaaggttagtgatgtaaccatacttgaaagcaagcctcttcccccagggaccagtgcccagttagcggaactagtggcacttacccgggccttagaactgggaaagggaaaaagaataaatgtgtatacagatagcaagtatgcttatctaatcctacatgcccatgctgcaatatggaaagagagggagttcctaacctctgtaggaacccccattaaataccacaaggaaattatagagttattgcacgcaatgcaaaaacacaaagaggtgggaatcttacactgacaaagccatcagaataggaaggagaggggagaacagcagcataagcagctggcagaggcagcagaacggaaagaaagagacaggaagtcaaagaaagagacagagaggacgagacagaagttagagagaacgagggacagacacagaaagtcaagagagggtcaaaaagagaggaagagacaaagaagaagtcaagagagagatggacgtagtacagaaaaaacaggtacctattcctttaaaagcagggtaaattctctctaccagccaggatatctctattgggtctcacctattgctctcagtggaatttgaatatctattaaccaatatctggcag

SEQ ID NO: 676924 - DNA, 151 bp, Homo sapiens
tgaattacacaagtcagtcatcaactgccatagagaagttgacaacacatagagtcgagcccggaaagaatgtccgtgaaataggaaacaacacttgctgggaactgactgggggtgcagagacctcccttgtcattgtccgggtccacca

SEQ ID NO: 676925 - DNA, 907 bp, Homo sapiens
gcgtgaacccgggaggtggagcttgcagtgagccaagatcgcgctactgcactctagcctgggcgacagagcaaaactccgtctcaaaaaaaaaaaaaaaaaaaaaaagattggtaaaaaaaaggattaaggcttccaagaaatttggaaattatgttaattgtcgaaccctaaaattatttagggttcctagggaagaaacgagaaattctaaaatgttgggaaaaccgtatttggaggggaattaatcaaagaaaatttccgtggccttggcgtagagattcgggagaaatacaaggaggtccaaagaacacctggggaaatttcttggcaaaaaagattttggccttaggcacattagtcatcaggttaatctaaggtcaagacaagggaaagattcttaagagctatgaggcgcaaaaggcttcagggtaatctataagagggaaaaccttatcagaatttaaaaacgcgagattttcacgagagaaaccttacaaggctagaagtgatttgggggtcctattttaaagcctcctttaaggcaaaacaatttatcaaggccacggattttgggtgttccaggagacgaaattaaggcttcattaattggaagggaagatactggtttttcccaagacaaaaccaattgggtggagagattcgcatattattaagccaagcagtacaaggagtcggttaaagaagaagtctaattttaaattaaattctttaaattaatccaaattaaaaatctcgctaaaagaataaatttccaaagagccttatttgacaattaccacaggcaaaatttttgtgtgtggtattatattgggggggaaaataggcaggacataaaggctcctccggaaaactgatgtgaatcaagccctaaagaaaagggagc

SEQ ID NO: 676926 - DNA, 301 bp, Homo sapiens
  misc_feature (219)..(219): n is a, c, g, or t
  misc_feature (257)..(257): n is a, c, g, or t
aagttccgatggcgagtgtggaggtccaggatgggaggcggtgttgctccattttgcattgcgtagtaaaggagtacctgaggctggtgtcgatttataaagggaagaggtttatttggctcatggttctgcaggctgcacagaggcatggtgccagcatctgcttctggggagggcacagccatccagtgggagcctcatgcccactgcacagataanaccaattcaccgagatcttggtattgtagtaaaatgtntaatgtgaggccagccacatggagtacatggggtaccgagctcg

SEQ ID NO: 676927 - DNA, 185 bp, Homo sapiens
tacaaggggagcgagtggtaaggggccacggagctgtcaggcagccaaacgggggggggggcaaacaagggaaaccgatgcggggtatgaccaggggggggacacatgtccacacccgtgaacacaagcggggctctgggagggccggcgcaaggcatttctgaagacccgttggggtaggcaaa

SEQ ID NO: 676928 - DNA, 383 bp, Homo sapiens
  misc_feature (11)..(11): n is a, c, g, or t
tgatgaccggncctgcgagttgaattcccaataaacatctagctgatgcttttgtgtcgattttccagcgaggtttacattgtgttttactaagattgtatcgaatccatcagttctaaggatttcttcgtatacctctctcgttagtttttcgtattcggtatcctggttcaacatgttcggctccttggatttgatgccaatcggagtgaagtgttcagagctttatttttgaagatctttacggcagtacatatggcaaagccagactatgatattccataggaaccttccgacacttttctcggcttgcctgtcagacctaccaccgctaaccttctcaagctgctgtatgtaaacccagtggccggaggtggaagtcc

SEQ ID NO: 676929 - DNA, 716 bp, Homo sapiens
ataattcactctctgcctcactagcacctaactactccgtatgcctcaactcgagtgagacagacctagacgttcctactgatggcttatcagtagcactatggcctcatctcacatatttagatgtaatctttgtgtagagagatacgagactggatgtaccactctactactacctgttaatgacaggccgtgtccgacacatctccctgtttccatgtactgtggtagccagctatcggaaagaagcgctgatttaaagagctcgcttgggaattttattgacacagtaccatttaatggtggaggacaaaatggggcaggggagggagaagtttctgtcgttaaagaacagatttggaaagactggactctgaaattctgttgattaaagatgagtctttgtctacgtgtcaaatagtttgtattgcgttacgcccgtgtcagcgctcctaatttgtttgaagctgaaatatataagctaataacatgtgaaaagaatagaagctaaggtttagataaatattgagcagatctataggaagattgaacctgatatattgccattatgcttgacatggtttcgcaaaaaatggtactccacatacttcagtgagggtaagtattttgcctgttgtcaagaatagcagtgtaataagcattttgtaataataaagcatagctttaatgatatgcctcgggactaaaataatttt

SEQ ID NO: 676930 - DNA, 153 bp, Homo sapiens
ttatgtgttgtcgtgcaggtagaggcttactaaaagtgtgaaaacgtaggctgggattaaaggcggacaagcggtattctctaaggataagctcagtgagatattagaattggtggaagatgataagtgtagagggaaagttaatggaaattc

SEQ ID NO: 676931 - DNA, 121 bp, Homo sapiens
tggattctccgccgttgcgggccccttccggcggggagtctgacttaacattgagcaacaatgaggcttgcaaagtgtggcgggtgtgcccacatggccccgggatttgccccacatggtg

SEQ ID NO: 676932 - DNA, 144 bp, Homo sapiens
gcccgtattctggtacgaccaactcatacaccgtccatatgaaaaaagtttctacgcacatcactcgcgtaacattacttgatttgatatgtctccatacccattacaatcgtccgaagtccttccccggcttgcacatccagg

SEQ ID NO: 676933 - DNA, 140 bp, Homo sapiens
  misc_feature (56)..(56): n is a, c, g, or t
agtcatcttgctttggacaggcttcaggacagaagcctgcaggtccagcctctgtncacaggtttccacaaatagccagcctttggccacctctctgtcctgaggtatacaggtatatcaggaggtgtataccttctctt

SEQ ID NO: 676934 - DNA, 528 bp, Homo sapiens
tctccaaaagctggcaaaaaaaaaaatgggcacaaaaaaaaatcttttcttggccgtggatttgttgcccgccaaccaaaaaaaaaaaaagatgctgctgcccaacccaaagggtttgcccagggttttggtccttaaaaaaaaattggggccccccccccccgggggaaatttttttttttccttaaaaggaaaaattccaatagggcccccttggggctggggaaaaaggcaaaaaaaaagggccccccaattggaattgcttttttttaaaaaaaaccaccctggcctttttttcccaaaaaagaagccccaaaattggtcccccgggttcttttaaaaaattttaaaaaaaaaaaaaaaaaggggggcttgggttttttttttcaaggggggcaaaaaaaccccctcccaaagaaaaaccagttttatatttttttttttaaaaaaggggtggaaaaggtgttggggggtttttgccccccaaaccccgggttcttttgacaaaaaaaaaaaagccttttgtta

SEQ ID NO: 676935 - DNA, 872 bp, Homo sapiens
tggagtttccacatttaacgggaactttttttggcttaaaacctaaactttgttcagttgtgaaaaaaaactccccgtggtgaccgtgtaaactgatctgtgtggatataaatctctagggttttttttttcgggagcttctcctgggataaactttttctctccaaaaaccagggactccttatttttttttaagacagaaggagaattttgataactcaaagattttgggcacgccccttgcctttttttttttttatatacgccccctaaacaactgctcccggagatatacaagaggctctcagtggggtcctccgaagtctcttcttgtgtgagtattacacgaggtggtagtagaaatttacaaaaaagaaagacgccctattccccctctcaatattagggggtcgggggtataacacccctatgtgtggccccaaccccctccactataaaagggggtataaaaaaagcagtgagattatcctgtctgtagactacaacacagccgttctacaaaaatatctcccatctctttataatttctcccatcccgcgtgccccctccatctgagggggagaagtatcttctaaacaagcggctacctgatgaatattctctgtctataagacacacacgctgtgtgaactcccgtgtggggtctcttatatgcgaaacacaactgtcaaacgcctaatatgtatctgacgaacgtgacaccaactgtgtggcttctgtattgttataaaaagggtccccccgaggttgagaaaaagacaagaggggcggccaccctccatgtttgtgcgacacacacataaaagacaactcttttctcaatacgtagtttgtggtgaggactcaacac

SEQ ID NO: 676936 - DNA, 867 bp, Homo sapiens
gactggtgagaagggcttcgagctacaaaggctccaccttccacagggatgatcccttccttcatgtgccaggcgggcgacattcaccaactcatgatggtcacagcgcgggaagtccatctacggaagccgctttcctgacgagaactttacatctgaatgcacgtggggccaggtgtcctgtccagtggcataactgcctggtccataacagggcaacggactcccagtgtctgtcacttcgtgcaccaataaagaccgactgggttggagtggcacgccatgtagtgtctcggatcacgtatcataagagggcactggacggtcgtgaataaaagtagaatctgttcgtgctctaacagtgtggacgtgacatccatggatgattgtcaatctacagacctgtggccacttgagcgttaatctgtgcgacaggccttgctggcatgagtggatagctggcacaaatgtccatgtctcccggaggttgtgcgggatggggctagtatagaccaaggtgctctgaaggagataccgtgtgcccactccatctgtcacgaatgtgacgtgcacgtgaggtgactcagtgaatgtggtgaggctcggacatgtagccatcatgatggcttgcgttactacccgagcctgttgtcgcgacctcatttcctcgggcgatcttgtgttggctttgattgtggcgtccccttggggaacgcctgtcctgtgttgcccgagccgagattcatcgtgtgccttggacctggtgctgggcgatggggtggcggccgggtgagggtctcccctgggcctccggggtgggcctttggcgcggagctataccgtaaagggccggcgggggctgttgtc

SEQ ID NO: 676937 - DNA, 105 bp, Homo sapiens
tgcgccataaccatccacatctggtgcatcaatgtccactttgggccctctgcatgtcgacatactggacactgtcagtttcaccattctacacttgtgaaacag

SEQ ID NO: 676938 - DNA, 196 bp, Homo sapiens
tagtaggaacactcagtatcacgctctgaggaaggtggcattaaagtctcatctctcagtgtatttgatgtattatttttcaaacctttgaatcaccagattttcattcaatttagactgcagcctgcaggcaatagagaacttcccagaaaagaaatctcttgttctatttccagttttttaaggaatctccaca

SEQ ID NO: 676939 - DNA, 175 bp, Homo sapiens
cgaagaggcactggtctctgaggacaggccttagttctgtggaggtgtgagcgaatgtcactatgtccattgtgagtgtctttgcctcttcagagatgtcatcggtgcaaagggtgtcaacgatggcttcctcaggatcactgcctgtaatggtctgaactgtggtcattccagc

SEQ ID NO: 676940 - DNA, 251 bp, Homo sapiens
atggtaaaccagtgcgggcagacactggagtagaggcggttggccagaatgaacttgaatgtcactgtggtaccaaagagtcagttcatagtgtcagtgagagcctggcaaagtgagtcattccaaacaggagccagtcaggattgagttcctgcaccccgaaaggtgagtgggagtcatggtccatcccacttgagtccttgtactgccacatgagaatgtttttgtggcccatgaacatggatcctgtg

SEQ ID NO: 676941 - DNA, 305 bp, Homo sapiens
gcacccgtgatctgaacttaggtaaaataggcctggcacggtggctcacgcctgtaatcccagcattttgggaggccgagccgggtggacagcttgagttcacgagtttgagaccagcctgggcggcatggcgataccccatctgtacaaaaaatataaaaattggctgagtagggtggtgtgtgcctgtagtcccagctgctcgggaggctgaggtaggaggatggcttgagcctgggagagctgagattacaccactgcattccagcctgggtggtagagccaggcctaagttcagagccagg

SEQ ID NO: 676942 - DNA, 161 bp, Homo sapiens
  misc_feature (15)..(15): n is a, c, g, or t
gtcagctccccaagngagctgagccccagagagagctctgtgtacaagtaacaggcccagcctccaggccctacttcgccagctctcccgctctggatctgcactctaacactcgactctgctgctcatgggaagaacagaattgctcctgcatgaacaca

SEQ ID NO: 676943 - DNA, 961 bp, Homo sapiens
cagttttcaaatcatgtttgaatctacattcactttttttgttttcttttttgagacggagtctcgctctgccgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatctgcccgcctcggcctcccaaagtgctgggattacaggcatgagccaccggcccagcctacattcacttctaaagtctatgtaatggtggtcatttttttcccttttagaatacattaaatggttgattggggaggaaaacttattctgaatattaaccggtggtgacaaggggacagtttttaccctaaagtgcaaaagtgaaaccataccaaaataagactaatttttaagagtactcagtaatttcaaaatacacgatttgaatagcagcattagtggttgagtgtctagcaaagggaaccaacttgctgactaaaatgaaggtctggtgtatatgtttaaaatactcccatatagtcacacttttacattaagccttatataggcccctctatttccaggatatattcttaactatcattatttacctgattttaatcatcagattcggaattcctgtgccatgccgtattttgttcacttcacccccttttcactgtgaaacggctcctcacgttggcaggtctgactacatggggtgttctgtaagaccgtcgttttgcctcacaaggtctcaaaaggcggtattcctttacactggcagataaggcatgacagaatgatacctcaagggaacttgccctccaaagaggcactcacgagccaagtgaccgttcctccatgc

SEQ ID NO: 676944 - DNA, 400 bp, Homo sapiens
  misc_feature (400)..(400): n is a, c, g, or t
ggctgtcagcaggaatacaaccacagccctgagttctgaggcggagaggaggacagaagaaacaagaggctgtgagatagtcaaattcagtatcccagatggctcttgagtcttggtgaaaccatacctcaacttctagagggagagtggttgatcatgaaactaattaccatcctttttctctggttcaggctggtactaagattaacccacgaatcacagtccgaggaaattgactgcaatgacaaggatttatttaaagctgtggatgctgttctggagaaatataacagtccaaacccaagtgacaaccacgttgtattgtgccgcataactgaagccactaagacaggtgggtctgacaccgtttatttcttcaaggacgtcggagggggttgtn

SEQ ID NO: 676945 - DNA, 657 bp, Homo sapiens
atcccagctctcagggaggctaagaggcgggaggatagcttgagcccaggagttcgagacctgcctgggcaatatagcgagaccccgttctccagaaaaaggaaaaaaaaaaaaaacaaaagacaaaaaaaaaaaaaaaaaaaaaaaaaaaaaaggggggggcgcgccgcggggccccgcgcgaaaaacgcttttcagaacaccacccgcgcggggggcgcgcgcgcggggccacggaggagaaacggcgacaacgggggcacacacaggggtgttccccagaggagacacccggggacaaagagaaacaagaggggcgggagactcccccaccccacataaacaaagcggccgcgggggaaaccacgggcaccgccttccggaaacaaaaaccccaaggaggcgcgtcctcgagagaggcgcacaaacgggggggaccctcctccccagggggagcggcacaacaagaggagccccagaatctccaaaaaatacgcccccccgcgacgcgggggccccccacaaacccccaccaccaccaatacccaacaaacccaccccccaacccaacatcaacacactacaaacacacaaaaccaccacacaaaataatataaacaatccaaccccaacaacaacaccactaccactacacca

SEQ ID NO: 676946 - DNA, 189 bp, Homo sapiens
ctagtgctggttcacaaggttatgctcacccttcaattaaaatctaaatgactgctagacttgccatcagctctcttcagtgacctctgctgggtccgaatcagaaaccttgggtgccatgaaatttttaccatatttgcgttccaagccaggctttgcagctagattatagatcacttgagtacgatc

SEQ ID NO: 676947 - DNA, 309 bp, Homo sapiens
atcgtttctccgggcctcagtgtcctcgtgtgtcacagagctgtccgactgttcagtaagattgcagtgcaaagagccctgaaaactgctggcccacaacaggaagcgcccagtagaccacggcaatgacgacgcttcatcttcagacagaaaagaaatggtcaggcgggcacagtggctcgtgcttgtaatcccagcactttgggaggctgaggcaggaggatcgcctgagcccaggagtttgaggctgcagtgaactatgatcacacccctgcaatccaccctgcatgatagcgagaccctgtatca

SEQ ID NO: 676948 - DNA, 102 bp, Homo sapiens
aggatctcacgtatatgtacaactcacatgtgcacatgtacctaaaacttaagtataatatcatttaaaattcaaaaaaaacacttgaagacattaaaaaaa

SEQ ID NO: 676949 - DNA, 515 bp, Homo sapiens
aacttacaggacctggaagagagtgagccatcaccggctgtcacatacatccagggaagggggtactggtggcgagggcattatacaaaaagaccaaggtgaacaaggcgacgacatgattaaaatcaagggtgagggctgctcccttttctgccgacaagaagtctccttcaatggtatgggtacgtcttttccgtttctggcggccttcatgaagaaatgaacggtgcagaatgggtgggtcaaggatatggccaacaatagttatgactaaatgatgatccactccttggtataacaccggtttatggagtgcctcctacatgccaggcacggttttcaatatcggggaaatacagcagtgaaaaaacaaacaaacaaagcaatccctcaagagcttaagctctcatagatgatgccaaggaggggtaacttctttggatcaggctttaccttacaaacatcccggctttgcttcacactaaaggtgctgaatcagcacatttagggtggtt

SEQ ID NO: 676950 - DNA, 293 bp, Homo sapiens
ggttttttaacccccccccttttttattccaaaaaagaatgaacaaccccctgatttggagtggtgtatactgcccacatcagtgtttgagtcagtccccagaggagaggggaacccttcctccatcttttttgcaacatctcattttttccttttggtggtgcttcccccctcacacacttggttttggtctatcccacatttgagatttttattttatggtggacctgccggctttttttcaaattgaaaagaggacatcgccccaagagccaaaaattaatggggattga

SEQ ID NO: 676951 - DNA, 946 bp, Homo sapiens
acattcctgctcctgtgcgctcatgcaccgttgcccagggcgaaccggtgcagttcaaggactgcggttctgtggatggagttattaaaggaagtgaatgtgagctccatgaccccacccactcctgccagctgagcaaaggatagtcttacagggtcacatgtcacccttcaccaaggaatattcagtctaaaagcaggaatggccgtggtgtgcatgggcatcctggatgggtcgttcccagttcccttgccccattcctggaggcctgatggcttgtatggagtggcaccattgaactggcgctgatccatcaaagcactaaggacactatagactatctgaataaactaccagtgaaagagcgaatatccctctgatacaactggtggttggagtggggaacttcgggatgacagagtaccaaagtcgtctgtctgctgggacatactcccaggtagcagagttcgtttctcatctcggtaatgtgcctcgagtgagttcggtgcgatcgtggccaagtgtagtctgctgagacgtcttgacagaacctccagctctggtgctgtcaacagaacagtgacttgctctccaatggtatccagtgtagttcgttgaatcaggaggtgctcctgtagcagaaacgtgagctccgggtggctggttctcagtgggtgtcgtcatgtctcttttgtgcggggtctccagggtggtgttccattaaattgtcatgcacttggttagcagatgtttaggtgaaggacattgaaccaacgattaactttggggggctctttctacacgctggtcattttactcgtgaataattaaaaactccgttgtggtcttggtcttctgcaaaaaaacaaaaataaaacggcgcgggtccttagcgggggggaaaagaaacgggtaacatgggcgcgtggcctagggtttcgggcca

SEQ ID NO: 676952 - DNA, 120 bp, Homo sapiens
tcgaagacattcctgcgcatgtgcattgccgctctgtggagggcagctgtgggttctaggtgcccgagtagcattctgtgacccctccccagtgcctctcctggctcttctgatgcagga

SEQ ID NO: 676953 - DNA, 300 bp, Homo sapiens
cgggggcctactggccatttggccagcggcgggcgtttgccacagttgccacagggggccgaccacggaagccctcagacaggaggagacagcctcccggcccggggaggacaagtcgcggccaccttcggctgccgacgcgacgccctgggacggaccgctgcccgccgtcagctgccggccgagcagggcctccgcggctcaggccggctcccccaccctgggctcccgtcccccgcagggccggcacaccgggaggagaacgcctaccagggctagcacccggacgcccgacgacgc

SEQ ID NO: 676954 - DNA, 826 bp, Homo sapiens
gtgtctctatactaaaagtccgtattgagctaattgagcagtttgaaatgaatattgtaggtaagttttaccatgatcctatactgtaaaatggaacaagggatattaaatcgataaaataagactgtcccaaccattttggtcctgggatacgtggcattcagtattgcacgcaccaaaattatcctcaaagacttaggtaatctgctatagctggcattttctccaacgtaaatgcaaagcccagcatatgcatatttagtggatgcttcaaatagatcaggctagggtattgctcgttaattcgcagcaaacatagtagaaaaggacaagcgcgattaacatgtggccgacccaataacatatacgatttgaggttaagtaattttcaaggtcatcaaaaagataaacaggtaaatcatcacatcatgaaattcgagttattacgatggtaatcgtggaaattctaatacttataccaagccccagcagcaaaagtattactcatccaggaccagggtaaggggaaaaccctacttcaagacacggaacctgaaagcaagggtgacactggcaccgagaaaccccaaggcctgaggtgggttcctaataagcattccgtctggaggcaacctgtagccacgggaccggtgttccgacaacaaccttgggtcttgggttcgccctgtgcttggtgttctatgaacttttccctggagatcccctttctcagggaaaaaaaccccgagtaaaatgttgcactatataatgatagaaaagagatttcccccaattgtttgccccattcttcatacaggcgtcttgt

SEQ ID NO: 676955 - DNA, 240 bp, Homo sapiens
cagatcgcctcctgtatgccctgttcttcggcggtgccgggatgcccgggatgcggatgagcgtgaccttctcggcaccccgcagtccggcggtcacgaggtgtatctggaggtcgccgcactggtgacggtgttcatcctcctcggccgctacctggagacccgcgcgaagcggcaatccggggaggctctgcgcgccctgttggagctgggcgcgaaagacgccgtcatcctccgcac

SEQ ID NO: 676956 - DNA, 147 bp, Homo sapiens
agtgatctagagtatccgttatgacgggctgctgtgcctatcagcgctcgcgtttttcggcaggtggaacgcttcctgttgtcctcagccgtaaccgcctgttgtccccgtgtctcagagtccctcacgcgttccctcccgtacata

SEQ ID NO: 676957 - DNA, 532 bp, Homo sapiens
gaaggggggcaagttgctcaccggttggcgttaaatttttccgcgcaaataaggactcactgtgcggagcctttcacagagtactggacttgccttgattctcccaacatgcagctgtttcgtcactcccgccagcagcaggcaaagtttgaccagtgtgtgctggacaaactgggctgggtgagcccggacctggggcagttgtctaaggtcaccaaagtgaaaacagatcgtcctttgccagagaatccttatcactcaagagcaaggccagagcccaaccctgtgattgaaggggatctgaaacccgccaagcacggcacccgcttttttttctggaccgtgtagagatgggttgacggtccacacttggtcacctcggtcatgcgcccagacaacagacgacgaaaacacccgtgccgatctcgtgttctttcctggatcacagacattaacaaaaaagttaatttatgtgacttggcagttattctatacatttcctgtccattaaaaattttaaaggaaaaaaaaa

SEQ ID NO: 676958 - DNA, 422 bp, Homo sapiens
atagcatctctagactgccagagctggcgaactcgccaccctgaagggaaagacacaagcctggctggcttcgcacctgctgattgtacagctctagggtctgtgagcaaacgtaggcagaagccaaggtagtggttacagggggccctgggtgagacccagttgctatgctggcttcaggtctaaccccacacaggttccactggtggtggccacaggggtgcttttgtcactgcaccagctccaggagctcacacacacacgagagattctcttgggagaaagtaagggagatataagagcctctttctggtaatccagagatcttctggatctatccagacaccaggtggtacctcatagtgcagacagtatacagattgggatgcccctaatgcagtatgacttgctgaccagcatct

SEQ ID NO: 676959 - DNA, 1235 bp, Homo sapiens
  misc_feature (210)..(210): n is a, c, g, or t
gaacccacgggttcgcgcccacggaccgacgagcactcgagcagtctctgttgaacacttgctggtgggctcccgtgtgcctgagaccaagtgtctagttctccgagcagtcattgtagtttcctgtcgactgccccgtgtcatccattgtcgtccaggacagatccattgtacagcagctagtgattgacgttgagatggacaagcaantgggcattcgtgcttgtgccactcgatagcgactaacatgtagacctgtggatgtatctcgcgaggcgacgtagtgtagctcactgtgacgcagggaacgatgaacgacggggcccagagccgcacagttcagtcagcttcaggcggagggcctgagccctgcggcgtatccgaccagctggatcagtcgaccgatctgcgaggagcatccgcgccctccggcgacttcctgcagcaaggagtacgggggcctggacgtgctggtcaacaacgcgggacatcgccattcaaggttgcgtgatcccacaccctttcatattacaagctgaagtgacgatgaaacacaagatttctttggtacccgagatgtgtgcacatgaattactccctctaatagaagcccaagggagagtggtgaacgtatctagcatcatgagcagtcatgatgcccttaaaaagcttgcagaccagagctgctagcagaagttccgccaggtgagaccatcactgaggaggagcctggtggggctcattgaacaaagttgttggaggataccaagaaggggctgcaccaaagggtaagtgctggcccagcaagtgtcaatacggtggctgacggaaaaatttggcgttaccgagttctgttccaggatcccagccttaggcacacctgactttaagcataaagacaaggggtaccgaggattccttcctggaatgccttctggcccaggtggtgtgaggactgaccatgcgggacccagcgcatccaagaagcccctgacacaaagcggtgcgagagaacccccgtgtgtatcagtgtggcctttttggcccccagaatgctgagagggttcccagtggagcattttgtttcgacataacaggtctaccgggacgatggtagttgttcccggccatctgagtgccgcaatttggcaccgttcagcagtgtgccaaagggagtatacagggctaccaacactctctttgcagacaaagtgtcttttctatcccacacctgt

SEQ ID NO: 676960 - DNA, 832 bp, Homo sapiens
cgttggtggcgcggtgcctaataagtcccagtatactcgaggaggcctgaggcacggagaagtcgcttgaacccgggacggcagagagttgctatgtgagccaatgatcgatgtccatcggctagctcgaaggccgtgggcatacagtacgtgaagaatcgcaagtttctaaagaaaaaaagcacagacgaactaacatagacaagacagtgcaaatagcgatcaacagtgcgcatggtagaatcagacgccgaataccgtcgaaaaggatgccacagagggcacgggttgacataggcgacaacattggtatcaccacgattggcaaatcagttcgcagtacgatcttataccggcgatgagcaagtttggcatctgaggtgaacgcgaaggaggcaacaagcgtgatcggagacgagtaacgtgggggcggacgaaggctgagaactgccagcgtcaacggatgaggcgcagagaagggatggaagacaatgttagacgaccacggatcccgcaatacagtaacgcagacaaaggcgtcaactcgcagagggacgtatgcgacacctttgggagatccgatatacaacttgtccacaagaacgcaatttaggtgtggggtgggggagcagagagatgggcacacatgaggcgagaaggtatgcgaaagagcagtcggggcgggctgtaccctggtagcgcgaactacggctctggtggggccaaagaagtaacaatcaccattgtgctagcgcgcggagagggatgaccagatttggagcagagcgagcatacaggagagggcatatggtgcgcggcgagaccggacgac

SEQ ID NO: 676961 - DNA, 141 bp, Homo sapiens
tagctactccagcctgggcattaagagctactccaggctggagtagctcttattgcccatgctggagtagctctaattgccatgtgctgaagtagctcttattgccatgtgctgaagtagctcttattgcgctggctgtat

SEQ ID NO: 676962 - DNA, 436 bp, Homo sapiens
cataaaaaaggaaaaaaaagactttaaactggagtggcagggcaaataatccttactttcaattcatggctgctttatattcatttgatgaaatcatttgaatacaaaccagggagagttttctttacccccctggcaatatatcccatactcttcaaggtcataataatatccttaatataaattttaaccacatggcctgtttagaaaaaatgctaattgctatggtccccttatgtttgcttagcttttatttgtttttctgtgaacagttaaaaagctaatttttttcaaaggggattgtaagtcatattttataaagccttttgcttgattatttgctctggactgaatttggactctattgcccttagatcttccaataatgttcccctctgcaaatttttaaggttcaaataaagtttaattgtttgca

SEQ ID NO: 676963 - DNA, 377 bp, Homo sapiens
ggtcgagtttcagttgtgtgggcgtacgagacattcggactcagcccctttggctctgggttggaggtctgggatgtgactcctgtggcttggggcgcggaaacatttggcgcagtaggagggtctgttgtaggtgcggacgggtgaggggagtgctgctggccaggtttgtgggtttagtatgtctcgcaggccctgatcagaggttctttcatcggggtgaggaaggtagtgctaggcctcccctcagggtggggttgttgggtcccttggccccgatatcttatcgttgggggtggaagagagagaagtccccggttttgtgcccctatagtcaccatgtttcacactgtgagaggctgtcctctcctcgtgcc

SEQ ID NO: 676964 - DNA, 340 bp, Homo sapiens
tcttgatatatgcagtggttacgtaaagaggtcggtagaaagtcttgctgactatcacaatattggaaaaggatgtagtagactagactgcacggatgctcgctacaccactgacgatttgaatatgctgctgtaagcacatcttgtgatctatcaagtatctgtcaactgaatatcccttcggtattcgttcctcctgtctaaggttccgacagaagcattacgttagcagcaagaatcagtagcttcacagctcctttgggaggatgatctaggtcagcaccatataccgattcactgttcatttctaattccaagttatcatcatccgttatgtctt

SEQ ID NO: 676965 - DNA, 115 bp, Homo sapiens
aggcagttgtcagtggtctctcctcttccttgtccctcctatcttgctggcaaatggctctgtgggaaacccattctgcttacctgtataaacatgtagaaacaattcatttaat

SEQ ID NO: 676966 - DNA, 876 bp, Homo sapiens
  misc_feature (823)..(823): n is a, c, g, or t
gagaagctggccagtgatctgttgtgagtggatccgccgcacaatcccgtggctggagaaccgggtgcccgagaacaccatgcatgccatgcaacagaatgctggaggacttcctgggactacctggcgcctgcacaatgccgcccaatggtgcagtgagaatgtgccacgctggagatcaacgttcaacactgctgcatgaccaacgctgcgtgctcagacaacctgtgccctgcctctcactgcccttctgatgtgtgcagtgaatgtgctctcgtgcacactcacacaattgcctgtgtgtgcttgccttgtgagcatgtgtgtgatgaatgtggctactgacgtgatgttgtgtttgcttgacattgatgactcctgtgagtgcttggatgctgacttggaacgcacctgtgcacgagaactgttcctggccagaagtgcctcacatacacgatggccttggacttgactggccaaaggatggcacatgcatgctgcacagacaggacctactgatgacctgcacaccactactctgggaagactcaacgtgccattgtctccacagacagccattgacgtgcactctcgaagaagtagaccctgtgcatgccacaccaaaggagccgctgttggatgcacgactttgccagaccatcggcaccatggaggctctaatgcagcttggacctacttacttcgactcaaccccagttgtcaaacgccctgttgcacgaaacgatcgtgtgacccagtggtgacacatctgatggggcccctaacctcacaaaagccgacaggtgaaccgctactagcagcncggacctgacgaaaacctgcttggacgagccaacttgaccagagctgatactt

SEQ ID NO: 676967 - DNA, 137 bp, Homo sapiens
  misc_feature (118)..(118): n is a, c, g, or t
tgatggcggtatccatgtagccagtgatggtggctcgaggcgcaatccagtgcacagtaaaagagttggacagtaatatcagaaaagtcaatgccagttgggagaatcaatgacctgnttttcttgtctttcctcta

SEQ ID NO: 676968 - DNA, 510 bp, Homo sapiens
ttggcgggcgatattgtaggacttttcggccttcataccctggggatctcttttcataagaagggaggtgagagattccccttttccattaaattaattggcccccatgggttgtgacctggagagtacacggattgggggggaataattttaaattcctacatatttccccctttttttttagaaccgggggacctgggattctttgaggttgccaatggagtagtattcccgattaaggccccctttggtataataattacatcacaagaggttttgcattcatgaggggtccccccattgggtttaaaaacagatgcaattccggggggtttaaaccaaaccacttttccccgctaccggccggggggtatattagggtcaatgttttgaaatttggggggcaaaccccagttttatgcccttggtcttagaattatttcccctaaaaatttttgaaatgggggcggtttttaccctatggccccccctttcccccttttagggcca

SEQ ID NO: 676969 - DNA, 816 bp, Homo sapiens
cccccccaaaaatttagtccaaaaacatacctgaattcttggatttccttgcctaagtggctttggtaggggggacagaggatgcttgaaaatagtgggttctggaccctatggtgaaagctctagtgacactggcaattaggcccaggtcccgggaggaagagggggagagaaaagggggcgtagttttccaaaagataagtcaggggacaacaaaagtccagggcgcctatgagccggtgagactccttgcccctgttggtggcaaagcacctgggagatgatagaccttcctagggaaagggtgcttggagtccccaggaatgctgggccctggtgtcaccaaggctccctggggaaggtctctggtactgggggcacacagaccaacatttttgaattggcaagcttaagagcttgtttgagcagaacctgttgcagaccaggctaagagggctcacctaaatgtttggcattgtgtaagacccaggacctttcgagatctgcagagggaacaaccataataacacaaccaggtgcggataacactcatcccatcttatgggtacagacacctgggttttttccccgagagaaaatacagcaacacaaaatgtggggcacgagacctaaaaattttaaacactgtggggcgcggggccaaggagacacggcacgtcccaagcacgccaacagttgtccaaaacaccgcgaccggtgacacacgggtggaccgaaaaggacgcgtacgccaggctggcaccacaacgacgagcagagaactctgagacggcaaccgaatcactattacgccat

SEQ ID NO: 676970 - DNA, 1013 bp, Homo sapiens
gtggcgacgatgacctacacattgcttacgtggacctggaaaaggactttgctgctgaggttgtacatcctggagacctgaagaattctgttgaagtcgcactgacacgaagttgctggatctcaatccaggtgcgaaaagtttaatacctgctgccctgaaaggaactgggcatgcgctgctacccagatctctcaatagcagaagcgaatgtgacataaaggtggctgtcgccagatgcaattccagaaccagaggaggtcatcccatcccggctggatatccgtgtggggaaaggtcatcactgtggagaagcacccagatgcagactgcctgtatgtacagaagattgacgtgggggaatgcttgacaccacggggctgtggtgagcggtgctggtacagtatgtcgcccaattgcattggaactcgacgggacaagagtataggggcaggtgaaaagcttgtcgctatcccttgaatacaccccagaagatgaagaaggaggtcggactcccgatgggactgtgcgttcatgttgctgctactcataggtaacgggatagaacgcaggcgtggttagtgttccttgctgtgatccctcgctgggatggctcttgattcctggtgagcacgtgtttgtgaatggcttatgaactgggtcgaccagacgaggagctcaatgcccaaagacgaaacgtgcttcgaagtagagctgggggctgactttcaaagatgtccgaggaggtgcatccgcagcagcgtatagtcaaaggcaccttctgatcccaggctgggcgcccgttcctgttacatcgcttgacacgggggggggtttgcttgcagcccagaatttcccctgttttcgcgcctgggtctctggtgccctccggctgggccgcccaccacgggtaccctgtccgacaggaggcgcgattggcctcaccgggcgatcgggggggagccccccccggcactctgtggtgggggcccccggggcccggggcccctccg

SEQ ID NO: 676971 - DNA, 869 bp, Homo sapiens
tggtaccggcctgggatgtttgggatcgcgaaccaacggttagcggtggcaggcgctgactgagagcgtctgcttgacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctagccattagagataatggattctgaacttaatgcatagtatagctaggaagctatcataaacctccagaaagacgtatctgttccctcattcacccagaatgaaccatctcagaacttgccatcctgcaacacttagaagttacctctcctaagcatacttcatagcccaaatagccaagctcttatcctacgccttaccaaactcttcaggaaccacattcatcgctctccaccctggcacagaaccacaaccctcgcaccataaccctgacacacttctcttcccagagcacaccacgcacagctataaccaacggcccttacccacacatcgaccccacatctgactcactaacactcctgcccaacacccatccacccctgcactccccccccaccactatctatagtacttttaccgtctagtaccagtacttacaatccaccgactcccccgctccctcgcattgaattaccttcacttccctatcacctaacgtcaccccctaccccccttcttaccaccaccacgacatctcgacaacat

SEQ ID NO: 676972 - DNA, 123 bp, Homo sapiens
ggagtgtgaacggaacaggtgtgaggagcgaatataagaggtcagcacaaatgtgatgaagctgtagttccagagacctgatttaaaaccacgaccagagacagcagtccaagccctcagtga

SEQ ID NO: 676973 - DNA, 422 bp, Homo sapiens
  misc_feature (125)..(125): n is a, c, g, or t
  misc_feature (143)..(143): n is a, c, g, or t
  misc_feature (345)..(345): n is a, c, g, or t
  misc_feature (373)..(373): n is a, c, g, or t
  misc_feature (376)..(376): n is a, c, g, or t
  misc_feature (381)..(381): n is a, c, g, or t
cccgtacagcatcctaaccagttggccagtgtattcttagtcatcgtgatggcttgactaaaacctaaaagaaggaccctagcatgtatttgccatttttcctacagtgccttggagtaggtatnctaataaagaaaggtgtnttctttaatattaatgcccttaagaaaaatgcctttctctattaaaataactctgagcctagtgcctttggaaccagtgggattggaatggggtttcctatttgcttttgatgggatggtggtaaaaagaagggagcccaaactacaatgattttttgcttaattattcctcggtatacctaccaaaatctttgtaattgtngtcatttggtttccttaggtcattagtngtnggggntgtggggtatgcaacgaccacttgctggttagggatggtgg

SEQ ID NO: 676974 - DNA, 350 bp, Homo sapiens
  misc_feature (350)..(350): n is a, c, g, or t
gcttagctctcacacactcttaaccccgtgacacatataatagcgactctatgtgtgtgtttctatggaagagtccaaggggtgaacccacatgaagaagggttcttcagaggccgcgggcatataacccttggcacaggaaaaaagaaaggttccaagccgagaggctggcccacacggccatataaggaaggggctattgggctctggcaagccaaggaagttgcacattgaaagtgtaaaggaaaggccctgagacctgagagctcgtgttacacgttaacccaccaggaagggccattcgaaatataggtgatgaggttaataaccatgtggctctgttcccctcn

SEQ ID NO: 676975 - DNA, 1275 bp, Homo sapiens
  misc_feature (444)..(444): n is a, c, g, or t
  misc_feature (708)..(708): n is a, c, g, or t
gtgacgcgtggactcggaggcgtacagacgtgtttcaaggatgaagctgagtgagtctccttcccagttccactgaagtggccagaaattcatggaagttggacgatgaacgcaagacttcgtactttaactaatgaagaaggcgtgtatgggccactagcagagcttgtgctgctgaacgcttctgtggatgaagtaactggcaagggttactgtggctccgcatatcagtggatgaggtaatcgcatgaaaacaatggctttccactcactgcaagccatggggttgatcttagagccatggtccgtgtcctggccttgcctactgagatagagggcggcattgcctcgttgtacgagaccacacgggaggaaactgtgcagaacccgaacagagaacatagttcatgttccgttgggattcggtcagtatgataggtatgncaatattcctcgagtcggttcatcaatgtatgcgttgtacttgtgtacaaatagagacggacgatgaatggaatactatccttgtgaatcgtcgcacctgtatacttatctaggctagccttcagcctgccccgttggagcgccccagaaaaggaagactttagacgaaggaaatcccgtcatatacccatttctttcccaactacttcttcttcatatatggaaaggatcgcactggttcccagccgcgaagctaactcgttnacggtttagacgaagatatgcccctcggtattaggggattaggagaaggcatagcggtgacaggtagagaccctttgaggggaacctcacattagcaacccccaatgaaatatcgagccgtttcgttcggttgaaacttctcgaactggttgttcacgtggccaacgcacaaaaactgggtgtgaggcgcgctaattgggcgttcttggatacggaaaagccaaggtcggttaacgcaacttggtaccaacacaatttccccgggcacacgaagtgcctgtcccgcaacaattattgccttaagagacgtgtctctggggggcaaagcatgaacactgcgaaagggaagggtgtaaagggaaggcaacggcggcccaaggggaacctaagagtttgggcgaagagaagggaccgccgaggaacgtttttccacgtctatcttgtccgaaggcgttcgtaaccttgtcgtacaagttcgtgaaactttccaggttcgagacaaaattaacgaattttcggggaagttaaccataactccgacttagcgactcccgaggctcgggagag

SEQ ID NO: 676976 - DNA, 226 bp, Homo sapiens
  misc_feature (14)..(14): n is a, c, g, or t
  misc_feature (75)..(75): n is a, c, g, or t
  misc_feature (133)..(133): n is a, c, g, or t
  misc_feature (155)..(155): n is a, c, g, or t
  misc_feature (164)..(164): n is a, c, g, or t
  misc_feature (176)..(176): n is a, c, g, or t
  misc_feature (194)..(194): n is a, c, g, or t
  misc_feature (205)..(205): n is a, c, g, or t
  misc_feature (209)..(209): n is a, c, g, or t
caaactcctctgtnacctccccttccaggtcatctatcgatgtccttggggttcaccatgttgcgtagaaccatnaatgtagactcctgcttgaggagagcttctgcatcaccatgtgtcgggggctactgcncgagatgctcatgtgctcctgntcgctcagnatctctggccgntctgactcgggaaaaagntcctcttcttncttnttcttcttgggctccag

SEQ ID NO: 676977 - DNA, 900 bp, Homo sapiens
  misc_feature (7)..(7): n is a, c, g, or t
  misc_feature (462)..(462): n is a, c, g, or t
cccaccntctccccccccccccccccccaccctcccacacaccactccccacccctccaccatcacttccccacactttcccccaccccccccccccaccaccccacacaccatccccccctctctcctcctcccccctccacatctcacacctcccccttcctcccctctccctcctactcctcctcctcactatccacctccccctcacacccccccctccctcccactcccccccctcctccccccacaacctccccctctccccccccctctccccctcctcctcccacctcaccccctcccccccctccccctcttcccccatctcccccctccctctcccccccccctccccctccccactccaccctccccccccccactcacttccccccccctccccccccaccaccaacctctccaccccctcacccccccccaacccccctccctccaccncctctcacccctcccctccccatcctccacacccacccacccctcaaaccccacacaccacccacataactcaccaccacctcctccataatttccatctcatccccccttctcaacaccatcattccatcctttcccaccccatcactacctatcatccctccaaccctctccatctcaccaacatcaaaaaatccaaccacccctccccaatacaactctacacactcctacacactttacccaacccacaccacacatcaccacaacaaatttccaaattttacctcccaaactccaacaacaatccattttatcacaccacacactctcacacatccatccatccacaccccccactctcctcctccctctacccttccaatcccaacaccatccctccctctccacacatcaccccacacccaactcccacat

SEQ ID NO: 676978 - DNA, 130 bp, Homo sapiens
cccattgaaatcacgctatgacaaattaagacatctatgccatgctggtgatataatcttacctaacctaatcaagaacacattaatggaaaagtatatggcctggctacagaaagaacagcatagagga

SEQ ID NO: 676979 - DNA, 618 bp, Homo sapiens
tggggactgccccaaagggcaaacaggtttattggggcagcagcggggaaaatcaggcggtgggatcttggccacacgctccagctcgtccttcttcttaagtggcattaggagtttcgaggagcccttggcagcatttgatgagctcaatctgtgccaggcacctcagcaagtggctcttaagtgtctccggaaggcagccttcacgagcgccctgtggtgcacagcagccagagtggccgtggttcacagcgggcgccaggggtggaacacatctctcacagccgtgtgtcgttctctcaccagtctccgcgggcgcgcccaatgtggcgtgtgtgtggagttcctctccgcggggaaccacctgtgtgtgtgatgtgatgtgggcgtttcaccagagaccgtgcagaggggtctcctcgcctgtgtgtgacgcacgggtgtttgtgatctctctcgaaggcctgtgctttgacggatgcgcgcgcacaggtgctatggaccgctttcttggcgcggtgtggttggcggcgccgtggctttcatcatgggatgttacgggagggcgctccacaatgggggcccttggagctttgggggaagcgttgggggggcatt

SEQ ID NO: 676980 - DNA, 267 bp, Homo sapiens
ccttatgatacaggaacctgtatcccttcgacgggtaagtcatagtgttacggagcacctcacactttcctcaggagaaacacacaaccatgtaccctcagctggggacccctaactccaggccctctgccccaaacctgcccagccagacctgaatatgccagtcttctacgagtttgaagctaggaacccaaggtgaactgactgtggtcaaggcagagaagctggaggttctgcaccacaggaagcggtggtggctggagcgtg

SEQ ID NO: 676981 - DNA, 380 bp, Homo sapiens
accggacccttcatctcctcccacctcagctctgcagtctcaaatcatcttttctgaatctgcatctcacatctagagcacaggcatgtgatggctgggctcccaaggccttgggcaagtctgcacctgtggatttgcatgatatatcccccacagctgccctcatgggctgggctgtgttgagtgcctgtggcttttccacactaagggtgccagctattggtgcatctatgaatctaaggtctggagggtggtagccccctatgtgggggctccaagtccatattttccttctgcactgccctagtagaggtttcccaagaactctgcatctgcagcaggctgctgcctggaaacagtgggaggtgggaggagaggaa

SEQ ID NO: 676982 - DNA, 1145 bp, Homo sapiens
  misc_feature (137)..(137): n is a, c, g, or t
  misc_feature (264)..(264): n is a, c, g, or t
  misc_feature (450)..(450): n is a, c, g, or t
  misc_feature (855)..(855): n is a, c, g, or t
gacgtaccgatgggagatatatgtcagcaacgcaatggctctttgtggtatgaaaacatattcactatcttcctgtgattgatgaccccgtatgtaactgaactaatacacaccacgtgcaatgtcaacccggtgtntaatcttctctggtggcagcactactgatgattgttcgctttagtgagaattggatagtttggtctactcatagtaagtatacctagaaagctcactgaatactagtgctaacgagagagacgtctnccactgggtgagtgccgcttgacttcgggacttcggaagtcgttcccaatgttagtacatctacgtctcaattgcaaaactaatacggtacaacataacttgtcgttcctcgcataacaacgccaacaaggaatactaataatgcctcatagagttcaccctttctacacaatgtgctctgtatgntgatcggcatacttggcgctagtgttgttaacatcgggttcctatctaaaagttcggatacacaggctccgtcttcgtagaaagaggggaacagatggtatcgggcgccctctagggcaaatctgggggggagcgaagggcaggttcccatggaggttagctgcgctcgtgaggtgatgctcgctagctctatgcggatattttggcgcctaaaggggttacaaagtaaggtttccgttacccgacgaaaaaggaactcatgtcggagatgatcataaaaaccaatcggtgagtttccccactaatcgtaccagtcctccgaaggtcctcgcatgggggaatttctctgggtgatatgtaaagcaatcgaaacaaattcttcgcattaaaccttcctttccgagncgtttggggggttgggagaattcgcttgataacaccttcggtggaggtcctcgaaagtaatacacactcattcgttgaaaagaggtgggggtacaggagggggcaatttaaggctttttatgggtgtggtccccactatgctgtaccttgcaaagcggccacatttggtaagcccaaaactttttgtgatggtgggttgacccgtctccaaaccttgtgggtggacaccctttttttaatttatttccctctgggccaaacgagggtttccatcaacattcaaagggggg

SEQ ID NO: 676983 - DNA, 151 bp, Homo sapiens
  misc_feature (17)..(17): n is a, c, g, or t
gacaaacaaagaagagnaacaacggagccgccgaactgcataaaacactcttattgagcaggctgacagacgagactagaagaaactgaacataaagagaagggggggggggctagtttcaagtgggacctgaagtgaaaagcacagaggg

SEQ ID NO: 676984 - DNA, 266 bp, Homo sapiens
tcctgagtcttcggagcatattagtagcaatacgagccacctacaaaaattcagtgctgctgattttattttcagtttctattccaagtggggtctctctattcctttaaaaggcaggcatgtgctgagtcagcctcgggggaattttttttttttttttttaatttatagcctagactatggggtctctacaatgggggggaaagtcagggcgtatggggacccccatagagcgaccgcgaggcagtgcaagcggggcacggggc

SEQ ID NO: 676985 - DNA, 925 bp, Homo sapiens
cgtaggtaatccgtgaccggtgtcttcagtgtgaagtccttgtttattcttggggtgactgaaggtttcctcgtccttaagtgcagacctggccatgtatgctatcacagcagtcatgtttcgttcccattcccttgagtaggaggaccaggcgacctcacgcctagcaagtcctacaaggcggttccgtagccctacaaggttgcaccggatcacgtgtttttcttggcccatagctcgcacattggcgctccagccgtaccattccattgtgctaggtagcctctcaccaagctccgcacacttgccctcgtgccttgccacgttccttcgcagtgcgtcagttgtctaagagctcccaagacagctctagtcgtctaacaatagattagaactcccagacaggtggcttctgtgttcttctgactaattggattcctgcttcgtccagactcctaggcagccgtcctgttcaccattgcttggtcacaggctctagccagcaggcagaatggaaagtgggcccttccagagagaatatacgcacgcgcatttgggaaacagctagccgtcatgctccacgctgaaggcctgggtagtggcatgtcagtgcgagcatgagggacgtctggaggtggacactgcctcatcagcttacacggaatgccctagtccgtgccaccaatatggctctctatagcctcctctcctgtcaccatccctgtgtaagtcctagcttcgtgtcacaacgtcttccgcattccccatacatgctgggggtcattaggtctatcaaggctacagcgtctctcatccactgtccatccctcctatcatctgtagaagcagagcacaggcagtagtgtgacattgggcaccagggaaccctccatcaacataacccggagtcagtatatagggtctt

SEQ ID NO: 676986 - DNA, 631 bp, Homo sapiens
atgcacttcagagatcggacatatgacatgtagagtgtccctgcaacagcatggtgaaacctgggccttcaccattcgtgactacagtgtacaagacagacacttcaatatcattgctggatcagaccacttcataactcctgcgtggagtctactgtctaaggatcacactgtgattaacggcacatgtagtggagtaaaggactgcactaacgcgcgtctaccatgcatgtaactgctcaacgttatacgagctctaaggtcgttgcatgacacatgcgcccaaactgccaattgctacgtgtgacacatgcagtagcaagcaggctgactgccagttaccatggctaatcatgttaaacctagtgcgagcctgtcggtgcaagtgtgaccatgtgccattctctgcatatgcctgcagatagtccgtcacacgtgtagtcgaactgctcacattgaactcgtagatctggaatactgagatctcagtgcagagaatgaataagtgtagatgtccgcagagtggagatacagctgggaacttaggtcttagcgatcatagaatgccatgcagactatgccgtgaatgagaatatggtgacagctgagcggtgggatatcagcatgttcg

SEQ ID NO: 676987 - DNA, 276 bp, Homo sapiens
gctccacgcctggcttctgtggacaggagattcttttcgttctcacaaggggctcatttaaaatttggaggctgggtgctgtggctcaggcgtgcaatcccagcactttgggagagtgaggcgggcgggtcatgagggtcaggagatcgcgagcatgcctgctaacagtgagaccctgtgtccactaaaaatacaaaaaattagccgggcgtggtggcgggcgcctgtagtcgcggctactctgaagactgaggcaggagaatggcgtgaacccag

SEQ ID NO: 676988 - DNA, 370 bp, Homo sapiens
acctactactcgccgacactgaatcaccgcgttctggaacatagccctatccatagcggggaaggaggatggctgatgcccgaagcaggatactctatcgcttccaccctaaagagcagacaacggtggctgagaaaaatctgtatgttgattatgggtgccacgttgagaaagtattgactacgcctggggctcacgatataacaaagctaacacctgtactaaaccccagaagagcgatcaaataggcgcaggaaggctgaatcgtgctgctgacatccgacaaccgcttcccttgcatcatgaaagtatggacatgaccctgattgaccaactagctgatgatatgagtcaggcgagaagagggtac

SEQ ID NO: 676989 - DNA, 542 bp, Homo sapiens
cgaaggctgccatttttaataaatcgaagcacatacaatataggcaaaatgctacatgaaaaatatggtttttaaacagggagttggctttacaccaacgacatagacaaacagatgaataatgctacagggcttcatttcctttctctgattattaggagaggctggcgatgctcttaatgtgaagttatgagcctaacgcctgttgacttgcagcaacaggtcttttaccctactcggcaaagctggtattcttatcgtaagccttgcgccacttttatacaaaagctgcgatactattcataacaacttacacttactcttgtgttggcgtgggctaggatttcacaggctgaacaagagctccttgctccttgagttcacatatgttgtcagaaacgtgtgcataaaaatgcacggaggtgaacgatcactcttagacgatgtgcagacctatgtacatatattctcagagctgacaatgatgggcccctgttcaccaatgatactgcgcagcatgtggcgacttttgcactgactgg

SEQ ID NO: 676990 - DNA, 433 bp, Homo sapiens
  misc_feature (41)..(41): n is a, c, g, or t
acgtcatgtacgggattgaagacacacaagacacggtgtcnctgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtgatgtgttccacctcactgtccccagtaaattcaccttcgaggaggctgcaaaagagtgtgaaaaccaggatgc

SEQ ID NO: 676991 - DNA, 334 bp, Homo sapiens
  misc_feature (2)..(2): n is a, c, g, or t
  misc_feature (8)..(8): n is a, c, g, or t
  misc_feature (10)..(10): n is a, c, g, or t
  misc_feature (24)..(24): n is a, c, g, or t
  misc_feature (46)..(46): n is a, c, g, or t
  misc_feature (53)..(53): n is a, c, g, or t
  misc_feature (82)..(82): n is a, c, g, or t
  misc_feature (92)..(92): n is a, c, g, or t
  misc_feature (114)..(114): n is a, c, g, or t
  misc_feature (116)..(117): n is a, c, g, or t
  misc_feature (132)..(132): n is a, c, g, or t
  misc_feature (146)..(146): n is a, c, g, or t
  misc_feature (156)..(156): n is a, c, g, or t
  misc_feature (164)..(164): n is a, c, g, or t
  misc_feature (180)..(180): n is a, c, g, or t
  misc_feature (186)..(186): n is a, c, g, or t
  misc_feature (192)..(192): n is a, c, g, or t
  misc_feature (248)..(248): n is a, c, g, or t
  misc_feature (259)..(259): n is a, c, g, or t
  misc_feature (261)..(261): n is a, c, g, or t
  misc_feature (263)..(263): n is a, c, g, or t
  misc_feature (273)..(273): n is a, c, g, or t
  misc_feature (281)..(284): n is a, c, g, or t
  misc_feature (306)..(306): n is a, c, g, or t
  misc_feature (329)..(329): n is a, c, g, or t
cngcaggnancccgaaagctcacncggaagatgttagagacaaacncaaaccntcgagttaaagttgatcctgacgctgacntgaaggcaanccgtgattccgtatgaacgttncnnaagtggtaattgagnaaaacagttccccngattgttaanagttcacngaagatattgacgcgnttttanaaaatnggtaaaggaatgtatataatattgctctcgtgtttaggtaagatttgttgctctcngactgtgtaanangnaatttattcntgttttcnnnntattaaaaaatcttattgtacnaactggtaaactattaaatgccnataaa

SEQ ID NO: 676992 - DNA, 380 bp, Homo sapiens
accttaatacatccttcaatctcagctcagatggcgctccctccaagaggcacctgtactaccagaaagtaaatagtcccgccaccctgtgccaatatcctacctcgtatagcacgtcatgtggtaccatgacacacttccatgtctatacgtgtatttagccacgagatctgttcccaatgttttgtacggaacaaagtcagtgagcaatgcatgtctggagaatgaataaattcaggaatcccattaatgacagtatctatctgtttaacaaatattcatggagcacatactaagtgctagggactgaggataccacattaaagaagaagaaaggacagattcctgtcctcatggggtttatgttctagatacgggga

SEQ ID NO: 676993 - DNA, 331 bp, Homo sapiens
gcacatgtaagtcccacgagcacaagtaacctgactcttgccacccaatattaggagcctcatggcctgggtcggggttagcccagaacacacaaaggctttctgtagactcctacccttctcttcctgacccatttctttttttttggagacagagtctcactctgttgcctaggctggagtggaatgttacgatctcagctcactacaacctccgcctcccgggttcaagcgattctcctggcagtgcttggcatggcctcggcttcttactaggtggatgactgtgggtgtgtttcagctcctctctgggccttaatttccttgtcag

SEQ ID NO: 676994 - DNA, 530 bp, Homo sapiens
  misc_feature (41)..(41): n is a, c, g, or t
acgtcatgtacgggattgaagacacacaagacacggtgtcnctgactgtggatggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcagatatcccatccgggctcccagagtaggctgttatggagataagatgggaaaggcaggagtcaggacttatggattccgttctccccaggaaacttacgatgtgtattgttatgtggatcatctggatggtaagatgtttgagtttctatatcttcgtatgaactgagaaaactgagggaagaccagaagttcattggaatagagcaagtcttctgtgcttgtttggattccaaacggtggcattttgtttatacgactgtatgattttgggtaaataaccgagatcgccgccaccgcgggg

SEQ ID NO: 676995 - DNA, 404 bp, Homo sapiens
cttgtatccaataaataacagcgcagcctggcattcggcgccactactggtgctccgcatcttggcggtagtggtccccgtccccagctgtcttttcttctatctctttgtcttgtgtctttatttctacgatctctcatctctgcacacggggagaaaaacccacagaccctgtagggctggaccctacagaatttcatgcacggtgctgtcaaataaaaaatgttatttagggccggacgcgttgactcacgcctgtaatcccaacactttggaaggccaaggtgggcaggtcacctggggtcaggagttcaagaccagcctggccagtgtggcgaaaccccatctctactaaaaatacaaaaattagccgggcgtgatggtgcacacctgtaatcccagct

SEQ ID NO: 676996 - DNA, 1424 bp, Homo sapiens
  misc_feature (1424)..(1424): n is a, c, g, or t
gctgtgaccctgtacacgtactcctgatagaaatcgggagggccttcaaggctctcatcgctgctcagtaccagaggggcctcatgtcccgcagtgctctccgtgacgcgacaccaatttccgattgtgggccgaaaacgaaccagcagcacccatgaaattgctccggtgaattgtccatggccggcaataggtcgccctagacatcccgagggtgatgcgatcggattcatgagtgtttgagagcaacgcccactctggcctactactgctgaagctacatcgcaggagcttgcagtgggaaacgctacatccaagcagcgcagactagaccacagagtaggtagcaccagggatgagctattgtctgattccggatatagtgcccccatccagataccgtggtgctgttcccctatccttgggctctctatgcaacaacacgatacccagcaggccactagagaatgcagaaggaggaagtgagggcggaatctctggggcttgctggatgcttacttcgaagactagcgaccttgacctaggtgaggcgaatcgagtgacacttgtccttgacagtcccgagcggtctgcaccctgataagtgaggtcctcataaggcaaggttcatacgagccattcttatccagcgaggacctgttcctcgattacgcaaacccgagtgggtttcctcgaactggcattgaagccaagggccgcacgtaccggggacctggtcttaggggggaactggaaactggctgttgagaacgatgggccactatgacgctaacaaagttcgcagtagaacccaaccctataaaacgggacacagccacgggaaaggagacagcggttccacggggaacaaggaagcagagaaacccaccagggtgcaccggacgagcgcgcaacaaacggcgacgtgggcccttgatacctgaggagcaggcagaacgcgctacaatggagacagggccagatacagagacccaaaggccaggagacccccgtcaggtcaccccggcgccaaacaaagaccacccggggagggcacaagtatacacgcgggacgacccacaggagagcgacacaccattggggacaggaaccacattattctggggcacaccccatagtagaggaaagagagagccacggttgatcaccaacaaagacatccctagggaaacaccctgacgacacgatgagcagacaacacaacgaaaaccatacaggggagcatcaagcaagcaatgccggtacctattattcgacaagaagacaacaactacagagtgatcggacccagcactccacaacccaacaaaacatcaaaatgtagcagagcgacgactaggtacctcttctctccccaccccgctcgatccttgctatctcgctcctctatctccggtcgcgan

SEQ ID NO: 676997 - DNA, 353 bp, Homo sapiens
caatgcggtgagactcagtctcaaaaacaaaaccaaaaacaaaaaactttcccatcaggcacagtgactcacacctataaatcccacctcttggggaggccaaggtgagaggatcacttgagaccaggagtcggaccagcctgagcaaaacactgagacccaatctttaccaaaaaaaatttttttttaatttaaaaattagtcagggctggtggcacatgcctgcagtcctagttacttgggacgctaaggtaggaggatcacttgagcctgagaggttgaagatgcagtcagctatgatcgtgccaagacactccagcctatgagacagagcaaaagcctgtctctttaaa

SEQ ID NO: 676998 - DNA, 988 bp, Homo sapiens
gacgggatttcaccatgttggccaggatggtcttgatctcctgacctcatggtcggcccacctcggcctcccagagtgctggggttacagacgtgagccaccacgcccagccagccaggctggtcttaaactcctgatctcaagtaatccacctgcctcggcctccaaagtgctggaattataggcgtcagccactgcagctggccacagatatctcaaaatactgtttctgttcatcacaaacacatgtattgcatgtaccagaacttttgtgatgcattaatatgtataattaatatgcattaatgtgtacaagtataaaaaatatatgcaggggcagggtgtggtggctcatgctgtaatcccagtgctttgggaggctgcggaaataagattgcttgagtccaggagttcaggaccagcgtgggcaacatggggagcccctgtgtctctacaaaaaatttaaaaattggctaggcatggtggtgcgtgcctgtagtcccagatacttggggggctgaggcacggaggattgcttgaggccaggagttccaggctgcagtgagccatgattgtgccactgcactccagcctgggcaacagagcaagaccttgtctcaacaacaagacacttacgacacagaaacgcaagacaaggaaaacaacaccaaccactcactatctactctcatatcatactcatactgcaacacgacagtatcaccctcatcatccatcgctactggccagcatgctactgtcgcggtcctacgccagtacactcctactcttacctggctctcgcacagaacaaccacctgatccagcaaaggcgtgctactctttaggcacgtctccatccatcgggacccacagagtggacccacgagatcaacatcaaccggcagcaccataggtcaccagcacagagaatgcagcgcatgtcggcaccaccaacagcgcccctcggcccacaccaggcgcacgt

SEQ ID NO: 676999 - DNA, 865 bp, Homo sapiens
cttaccagaggagaaattatataacgaccctgctaatatcctttctaaagtaattttgctccttgcaaatttaaaaaagcaataagagaagagaaacaaccatgtgtagaatatctattcactatctcaaagacgttcaatgtcctcatgacactgcagacgtgcagggattcctgcgcatttggcatgccatttctcccatcagaatctgggatgatggctcagaaccatggtaccacagactaaggaggtaacctgtggttgacccctgtcaaaggggggtgacataaccaataaaatatgcaggctctagggatgcctaattctctggaagaattggtatgaataattcagttcaataccacccctgaatacacttctctgcgtggcagcggcaacaacgtgtataatattgtgtattaaccccgaaattggattatttcttcaatgtgtcccttaaactgcagtggcattaataaatcaagaggcatgtcttacataagttacctctttctgtgttaacctcagtcatttcgcgccgtggccacaaaaactaacactacttttaaccgtgaccacaaaaacacacaacaaaataaactgaacaaaaaatatgttgtgggggcgacacggcccgagaagaaagcacacaaacaaccacacgtgaggagcgcgcggccccaaagacgacagagcaactggcaccaacggggacacaagaaaacccgggcacacgacaggtgggggtaccccaccaaaaaaagccggggaccagacgccgacaacccgagcgcagggccacgggggcacaccgggcagggtgataccacgacgcgcaagaaccagcaggcacaccccaacgcca

SEQ ID NO: 677000 - DNA, 258 bp, Homo sapiens
ttctggccaacgactcgacgacagacgaatcagacggggtgtctctttaggaccaagacttcagctaccgggctggctctgtccagaatggcaggtcttggtaacagggcagctgtttcaggctaagcaggaaaacctacctattcttaagcgggccagtggcaggagactgcctctgacgtcacgcactcttacacagtgcactacgacgctggtgctggtggattccggggacaggactatgacgacgaaacgact

SEQ ID NO: 677001 - DNA, 1010 bp, Homo sapiens
  misc_feature (460)..(460): n is a, c, g, or t
  misc_feature (486)..(486): n is a, c, g, or t
  misc_feature (490)..(490): n is a, c, g, or t
  misc_feature (495)..(495): n is a, c, g, or t
  misc_feature (516)..(516): n is a, c, g, or t
cgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaactctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaatgccgacccccaagaggccattaactgtttgatgcgagcaatcgagatctacacagacatgggccngattcacgattgcggccaagcaccanatcntccanttgctgagatctatgagacangagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggcctctgccacttctgcatcgacatgctcaacgccaagctggctgtccaaaagtatgaggagctgttcccagctttctctgattcccgggaatgcaagttgatgaaaaaattgctagaggcccacgacgagcagaatgtggacagctacaccgagtcggtgaaggaatacgactccatctcccggcttggaccagtggctcaccaacattgtttgttggcataaaaaaccatcagccaattaagagacggtaaaccaacaccccca

SEQ ID NO: 677002 - DNA, 105 bp, Homo sapiens
  misc_feature (76)..(76): n is a, c, g, or t
atccctaagacggtaccaacatttctcaccactcctcactgctttctagttttacctccatgaacatactaggcangcagtgtaacctatggtctatattctacc

SEQ ID NO: 677003 - DNA, 812 bp, Homo sapiens
  misc_feature (262)..(262): n is a, c, g, or t
  misc_feature (288)..(288): n is a, c, g, or t
  misc_feature (292)..(292): n is a, c, g, or t
  misc_feature (297)..(297): n is a, c, g, or t
  misc_feature (318)..(318): n is a, c, g, or t
cgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggccattaactgtttgatgcgagcaatcgagatctacacagacatgggccngattcacgattgcggccaagcaccanatcntccanttgctgagatctatgagacangagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggcctctgccacttctgcatcgacatgctcaacgccaagctggctgtccaaaagtatgaggagctgttcccagctttctctgattcccgggaatgcaagttgatgaaaaaattgctagaggcccacgacgagcagaatgtggacagctacaccgagtcggtgaaggaatacgactccatctcccggcttggaccagtggctcaccaacattgtttgttggcataaaaaaccatcagccaattaagagacggtaaaccaacaccccca

SEQ ID NO: 677004 - DNA, 152 bp, Homo sapiens
  misc_feature (140)..(140): n is a, c, g, or t
cactgaaggagatgaaaccagttgaacctgaatttgaactggaacgtcctggcatcttgaaattagtacctggtagtccaagctgtctccgtctggtggcaccccaattcccctgccctagaccacctcctttcctcagncaccttcggctg

SEQ ID NO: 677005 - DNA, 168 bp, Homo sapiens
cgcttcgcgcctgtgcagcgccgacaggtcgcagtcgcccagcgttgattgtgccgctgtcgaacggcaagaggacgagcgacgattctgcagctatggtggtcttgccgcagccgttggggcccagcaggtcagacgaattcgtgttcgccgatagacaggtcgatg

SEQ ID NO: 677006 - DNA, 417 bp, Homo sapiens
gggggccccctttaaaccagtttggccaaaaaaaccgggtggggccgggccgggatttccggggttttgtcgacccccggggccggttttctgttttttaccccgggggtttttttcccttggtttcccgccagggtttttcttaaggggtccccttcccaggcccttgggggggattggaggaaaaaaggttgggtttttttttaaaaattggttttaaaggccggttgcccccctgtgtgggccccaaggggggcttttcccttccccggtttttggccccttcctggggggggccattcggggctttgggccccttttttttccctggggggttttcccttggttcctccttttcccgggtggccttatggtttggtttggggggaaatctttgggaaaaattttttttttaaa

SEQ ID NO: 677007 - DNA, 534 bp, Homo sapiens
atgtcacaaaagctgtatggtggacttggcctaagtgtcaaatgacgcagatgtctattttctaaggacctccgaggcaacagagatttacatgagcccagaggtcatcctgtgcaggggccattcaaccaaagcagacatctacagcctgggggccacgcgtcatccaccatgcatgacgggcaaccccaccctggggtgaagcgctaccactcgctcatttctatccctccgtacctgtacataaatccacaatgcaagcacctcccactggaaggacattgcagcatgactgcagtccacgggatgagacgagcttgatagaagcttccctggagagaaaccccaatcagcgaccaagagccgcagacctacaaaaacatgaggccctgaacccgcccagagaggctcagaccacggctgacacagagtctggactctgccctcttggagcgcaagaagactgctgagtaaaaaggagctgaaccttctgagaacattgctgattcttcgtgcacaggaagcaaccgcgga

SEQ ID NO: 677008 - DNA, 738 bp, Homo sapiens
tataaaattattagtataaaaggggaaataggtaggagtagcggggtaagggcgatgagtgtggggaggaagggggggggtttggtatgttcaaactgtcatttatattttatacgtggttaaatatgaggagtagtgtgattggaggtggagtaaattaggctgtaggtaggaatgtagaggttaaggagggtgatgggtgggctatgatgggtggggatgatgaggctatggttttttggtggaattcttcgataatgggcccatttggggcaaaaagccggtaagcgggggcaggccctcctagggagaggagggctggagtggaattaagggtgtatagctcagtgttagctggttctcagggtgcgaaaatagtagatagggtcggtggtgctggagttaaagttgagtagtaggaatgcggatagtagttaggataatattaaactcagttaaacttaaaaagggtctcatgtccagggtggtacggtaaaacggctataatacatcctagtgggggtcactggaggagtatgctaagaatttccgcgataagcggggtctgggtttaatcccacctcaagtgcctgctatgagggatcacaatttgacagagtgacggacaagggtcacgtcacagcgacggcggcaattggaaatagaggcaacggggccaaaaggcagggacaaaaaggccggtgcaagcggcctggaaccttggcccaatgaagggcc

SEQ ID NO: 677009 - DNA, 1118 bp, Homo sapiens
cgttgtttcctgcctggttgattgcggtctttcgcgattcctgcatagctgttggccttggtggcaggcttctccccgtgtccgctgctggtctgcccagtgcgtttgttggtgggtcttatccccggctgttgggccactgggctggtgcgcttttcgtcgacattgtcactctggcagattgcctcagctccgttgactgtcttttacggtatggggtcggctgtctatatgtgccaacttgctacgttcttctgtgtgtcttttccgaacccctcggagtcgtcggatttgtgcgtcactgtcgtccttgtgataccttctgctccatttgttcatggttgtcgtctggtgccccgtaatgtgcgctgttgacatggtgacgggagtggtcctctttgccagttcgtgctttcctgcttcctatctgttacgttctttccaaactttagtgattcttgtacgtactccactgccttgcagcacttgtcgacttgtacttggaggtatacgaccggctccgtcccatgtgtgggctccacggagaatgaaggcctcgaggtatcttgggctagtctcatctgcgtccactgtgtgagaactgtccgtagaatgtcttcttccgtgttggcagcatctgagcccttgaggccaatgtgctgcgctgatgctggagtaatactcgggtgctcgaccgcattgggggattgttgtccgcatcaactagtgatgaacacgcaacctctacctgtacgggccagcaagaagaagcccacatgtttgcccatgagggctgaggagactgttcagagactgcctcagccctagggcagtgtgcccaccctcattcctccagagcttgaccactggacatttagcactgacttcatccagaccgaaagagatgcctcttggtggcagtattcgccacagaggggtagctgggatcagtgctagtcacttcactgcccccaggccaccgtgctcaaagactggaccgccccactactcctcaggggactgtccagggcgccaagtggtagtgagggagagtgtcatcctggttctatttgctcagcctgctgggccctataacgtcttgagtatgctaattgatt

SEQ ID NO: 677010 - DNA, 203 bp, Homo sapiens
cctattcctacactgtacgaagcgacactccacctgtaacgcgcgtaccgcacatctcggtcagattcaaggcatttctatacagcttgctacttgcagtcctccgtgctgaagaggaccgaacgatgcgggctgaggattgacaaacatggatgcgatcgtggtagccgaagctggtctagaggatcacgctcaaaatgacg

SEQ ID NO: 677011 - DNA, 799 bp, Homo sapiens
  misc_feature (265)..(265): n is a, c, g, or t
  misc_feature (516)..(516): n is a, c, g, or t
cagtctacaaaggacagggcttctcactgtccgtctgtagcctgttgaggaatctggctagtctggttagctatgggctccatgaattcctcacgtgagctctcagggacctagtggcctatctcgtggcctagatgacagcctgtgcgcggtagccaagtccttttgatgcactggcctccgttaagggcctgccaggaggcaggagctgccgcccgcttgtgagcgagggcgccatgcccttggtgccctgggcacgtcctcnagggccctcttggctcgagctccgtgctccttgtagtagcagccgcgagaggaagtctttgtggaacacgtttaataaccacagtgggcggttccccgagcaattcttgcgtcatggcccaccttcttgtagtaagccggctgtgcagctgggagctgagctcatggaggccacacaggtccggggatcacccagtctctctgcagagtgggacttcaggatgactctggattcttagggggacagcaagnccataagaaacatcttctccttgcatttacaatcccaagctctctacagaacctttgtatgacctggaagtggccttgggaagcaaaagtatttgatgtaagaaagtggacctcactcagcgagtgggcgtattccttctgaggaatgggttcgccctgttgaactctgagcatgcattcccttcctcattagggctccatgccagggcaggaagaagaagggccagatcaggggcaggccaggccaagggaaactgagaccagagcctgtgccccgcaggtg

SEQ ID NO: 677012 - DNA, 1330 bp, Homo sapiens
gagccgtagtggagatggcaatgaagtctctgaatactcttttatcttatttagaagaatgcagagtagatgggaccttgcttggttgtgcttgcgatggtagactatctcaaggtgatgaggagactatgaacgccacgtacgttccagagtgctctcatttcgtatgtacccaggatgacgtgaatgcttaagtagaaggctaggcagagtcatatcaaggtcagcaggccaggttctgggtaacaaagctgaagaagttggacagggacgaagtggagaggggttctgtcttacaacccagctcctgtatccttctatggtgatggtactgtacgtagtagtcttataacaagctacgttccattgtttgcgtcaattctgcccttgtaattagccctaatgggcaaattagaaggtgcaagcttacgatagattgacttgtgccccgaggttgtcaatggtttgttgtatgagtctcgggtggcaattaggaagtatctttggataatgtcatgtgtcggctttcgaaaggagttcgaggtgtcttttgagtcgcccaattatttagagtgcgtgtgagctttactctaacaggaaagtactctcgttctttgagcttttggtcccttttcagtgaatcctgatattagcgaaggacgttcctttttgtcgcagttttttgagtaagagaacccatttgcaagctaacgttcaggggtttgaaagattacattccatttgggcgagtttataatagaaggaatcgtttcctggcgatagataagggcgccccagaaagaaaggggttcgctgtgtgtcgagggattgcccattcgtataccaagagggaacgcgttagacgaacacactttttaggcccttttgattggccctttttggaacactctaatacggggttgccgaggaaaggtaagaaattaccacttcaggggtcgggttgccacttaaattcccggagaagaacacacgaataagggaagaatatttttgaagagcaacacgtgtgtgttcccttttccccatttgtcttgaaccagttttatatttgtacgtttcgttaatcaggttttttaaaagcaaaaatcccacacagcatggtggggttaagttggtcttgataagggcgaagaattttaatttaaggtgaattgtaatccgaagttgtaaattcgccaagatccaggagttgattttaacgggagaggttttgagaaaaaccaaaaggggtgaagagtgggagggggccccacattgagggcgcaaaaaaagggaaaaaggtgtcaaagtcacaggcaaagaaagttag

SEQ ID NO: 677013 - DNA, 407 bp, Homo sapiens
gtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctgggatgctgtttgtacaattggtggcaggttgttaggagagacgatgctattatttgtttcgagaccatcatttagcatcatattgggagagtcacgcagtgtgtgtaatttgtgtagttggactcttgagaattagagtgggctgagttaaattttgatactacttcagaggggagagtgtgcactctgacagacgtctctaggtattcatctgtatatgcaagcgtcacacatacgacgagatgggcgctgatacac

SEQ ID NO: 677014 - DNA, 963 bp, Homo sapiens
atttactcggcgtcgaagtacagtattgtgggtcagttgtttcggcagtgtgatacacacagtgggaaagtggttactcaaacccgtttcaccgcgatgtttgattgttgcccccgccgttgggtaaaaggttttatggggttcaaccggatagtggaccactgttgtgacagtggaagtgatgtctaccgccctttttcatagggtgttaccatgagccgcattttggggtacacagcccctcggcgcccgatgtggcgccgccgtcgtgtaatttaggcggcgcaaaagagggcccacctgttttgaggaaaggacaatgtgtcaaccagtggggggatataaaaaagtgggccccacggggcactggtttctaacaaggcggtcccaatggcgccgaaagtgtgtgagacaaggggattacgatcaaagccgagattgttgaactactcacaggggggacgggaaagtgttccatgagaaacgtcacgtcggcgagtgaataaggccgcccttcctccagtggagcgtgcagtattgaagaatcagcggggttgggcgccccacagcaaaaggagaaaacactcgggtggaagatcacaaagaaccccgaaaaagggggagcgacgtatgagctaaacccgccccaaaaaggaggttttctctctgaaaaaaaaggccacttttgaaagatgtagtctcaaaattattgctctgcaaacgagtcccccccaggaaatgttattattatttcaccgtagggcccagtagttaatacaacgcaagatcacctccgcgcttgaagggaaaacaccccgcgatgcctcgggtccctggttgaacggttgatttttaacctcttttgggcctgcgggagaaacaggcggtcttatacatacggacaatgcagtgtcctcgacgctcgccttaaccaaaaccaaatttgtaacaccccacaagaca

SEQ ID NO: 677015 - DNA, 307 bp, Homo sapiens
agcggtgggtgaggggcgagcgggccgaggccccgcccccgatcctctgccccgccgcgacgcgattatagccgatgactcagggcggagcatcacgcatacaaacccgtggaccgcggccaacttctctggactgaagccagaagtttctagccggccaggtatgcgtacctcctctttatctccgtccttcccctctggcatccgaggaggctatgtccaggacatttctcacgctcgcgtactcaatggaccaacggtacccacctgacctttaattcatcaaggtgtcgccggtcgtccaggc

SEQ ID NO: 677016 - DNA, 223 bp, Homo sapiens
aagctccacctattacccgcttaagcttgtggactggggccatttgggtgaggggcttgtaacacaccgattcattgtctgatctttcaccactaaatagcagacaggtgaagagctttttagagaagtggaaggttggtacccttggaatttgcctggttactgattttctttggtagtctttaagtggaggttcattcagttcaaccaatagtccgcagca

SEQ ID NO: 677017 - DNA, 383 bp, Homo sapiens
  misc_feature (4)..(4): n is a, c, g, or t
  misc_feature (20)..(20): n is a, c, g, or t
  misc_feature (36)..(36): n is a, c, g, or t
  misc_feature (63)..(63): n is a, c, g, or t
  misc_feature (130)..(130): n is a, c, g, or t
  misc_feature (136)..(136): n is a, c, g, or t
  misc_feature (200)..(200): n is a, c, g, or t
  misc_feature (266)..(266): n is a, c, g, or t
  misc_feature (336)..(336): n is a, c, g, or t
  misc_feature (374)..(374): n is a, c, g, or t
aggncagtgagctggttcantagacgggcagcgggnttttgggactatatcggctggctgcanaaagtcccaacaactgtgtgagcagcatcgagaacatggagaacatcagcacagccgggccaaggcnggttgnggatccgggtggcactgatggagaagcgcatgtcagaatacatcaccacggctctgcgtgacanccggaccaccagacggttctatgactctggagccatcatgctgcgggatgaagccaccatcctcancggaatgcttgatcggactgagcgccatcgactttcagcttctgtctaaagggggaagtcctgggacggngaagacccccgtgggtcatcgatttacaaaggccttanctaaagttt

SEQ ID NO: 677018 - DNA, 284 bp, Homo sapiens
accaggcaaactgtgcgggcatagtcaatctcaacaccaaatttcattcagtcaattcaaggaacaagtaatttcaacaccacatcaaattttcagcccatttcatgtttgtcaaaagtggtcaagcaatgcagcacatgtgcaatcatatgtcagtcccgtcaagcacagtttcaacagcccagttttcatctcttcatgtcgccaatccaacatatggcattcaacaccatcatccaacatcgccatcatcatcatcatcatcatcgccatcgccatcatca

SEQ ID NO: 677019 - DNA, 452 bp, Homo sapiens
tgcacctccaaggagatcggggaggatgcctgtagacctgttagacatgtttaacttctcctcaaaaaacatgcctgcctctttgcatgtataactgtcataagagaacatagtgctactttgcaccagaaggcaaccatcactccagaccacctgtgcatttagtaaacaacaattcgcagcccagagcagtgggtttgctgctgctgcaaaaaagaaaagctcaaaacccagtgtggagccttcacaggccacctggctccaaattcaccctcggaattcacaaactggtgtgtctggagctgtttctttaatgggtgtctggtgtcaggcacagagaaagacaaagggacaccagttggcggcttaatcacatcagacccaaacctcagtactgtgtgtccatctagacgccactggggctgaatgaaccacgagctgctgcccctgag

SEQ ID NO: 677020 - DNA, 1124 bp, Homo sapiens
cctcggtgcttcggtgtcggctcctcttcgttctgcggtcggtcacccgttggctgtcctgcgctacatgccattcctcggtcccggccgcccgcctgtcttggtcgtctggtggtgtgcgtccctccttctcgtggcgtgactcacggcgcgggtcctcggtggttgtccaggcggctaccggattttccgcgtgtcgccggcgccttcacgtcgcctcttcgtccgcgcggtcgcgtcccctgatggcccttgtctccttcttgtgtcctatcgttgctcgtcgctgtgtgtcgtcttccccgtcgtcctgcctgtgcgtctgcaccgctgtcctgctcggtctgtcctcttgtccgggagggccctgtgctgggctgtgtcctcctaccattcgcagggttttcaagcaccgtcgtttgccgaccggctctcttcgcttcatctgtctccctttgtcttccttctaccaccctcgtcctggtcctctttcccacccagatcctctactccacatatctaccgagtcctgtccgcttccaggggccccttcgttcggctactacttctttcagacgggcttctgatgtctgcctgcagcctgctgcacgtgtttctgggtccttgcctcacttcctgcgcatgctctatagcttcactgaacgaagggccagatggacgaacggacattcgtatgtgatgtacgaatgaatcacgatctccagtcgacggacgtcgtctggcggcccaggaagcctctgcctagtttaatgtatcggggcagcttgagggcccaggccagcccccactgatggccctcggagcctgggtggccgggcgtctgaccaacaggcacatcaacagccacatagccggggcggggatggctgtaacgtggttgccctccccgccagtgcccttggatatttctggggtgactggactggcgcgcactagggccacctttctggagacagggagggccccacccggggtgggtgctgaaggctgatgatctgtctccagccccttccattctgcccacccacccttcttccctctgggcaactggacagatctgggagccagcagctggatgctgtggctggccagagaatacgccc

SEQ ID NO: 677021 - DNA, 128 bp, Homo sapiens
gaatgctagcaaaaggaaacagagtagtgtaactaaagtgtgctagggcaaggtcatatagacacagataatcaaagaaatcttcacaagcaggtcagtgaaaaacaaaaaagtagaaataacgctta

SEQ ID NO: 677022 - DNA, 133 bp, Homo sapiens
gggttaaaaaacatgtggggggggggcccccccccccgggggggggggttttttcccttttttcccggggggggggtttttttggggggggggcccggggggggcctttttttttaaaaaaaaaggcccttta

SEQ ID NO: 677023 - DNA, 141 bp, Homo sapiens
tgtgtacgtgcctggactcgagcagagatggcacggtgcttcagctctcctggagaagagtacgagctgctgacggcaggtcatcaccatggcatgagcggtccgctgccctgaggcactcttccagccttccttcctggg

SEQ ID NO: 677024 - DNA, 94 bp, Homo sapiens
aagacactatccagactcacaaaagatgtttcacccaatcagaaacagtgacccctaccctagtgagggcacacttccacccagggcccttaat

SEQ ID NO: 677025 - DNA, 950 bp, Homo sapiens
ggatggcatggtgccgcggtcctgtcttgctgtgcctgcgtgctaagggctcggaaccaattcattcctgcacggctggggcaggagccccttcgagggagctcggtcactgtgttgcaggtcctcgcctaagacctgcgagatggagaaagagagcacgaggaccggcacgaagaggaaagccccaggagcagagtcttgcccatctctccctctgagcatctcggacattgggactggatgtctttcgtcacgtggataaacgctcatggaactgcgctgacgctgcgggaagagtcatcacctcggagagctcgtaggactcgagcggagaccaggtccggtgcgtgtcccacacactcagggatccgaggatccttcgatgctctcgctaggcccagtccgctaccgaggtcgaagagcgtcacgtctccccttcttgttcaatcttccagagagagaccctttcaggctggggagctgattaatagctgagcactgtgggagggagaaactagaaatttcagagcaaaaattactctactgttgaacaactgccggactcttcaagagtagtaactggcggagggcacgctcccgcttcgggagagcattcgctgggtgaaagtatccaccgagagccagcatactgaggtgagttcctctggtgatccagcgagtacatggctgatcgccagggccagcccttgggaatagaactaatgctaggtgttgatagaaacggacggtgatctgcacaataagcacttccgcaaatggattactagatacttgattcatctcaactggatggatagtcaagaccgaggttgattggctggcaaagggaagactggctccgggctctggttggagttgagcccactttgaatccgaaagcaggttggcctctctgagacgagccgagagtcagagggctgaatggagcc

SEQ ID NO: 677026 - DNA, 1514 bp, Homo sapiens
ggaaaggtcggtggcgccggtactgtcgctgggtggctgagaagccaggacggcccgagaactgacagtacggagtgacgagacggagtgacctagtggctcgatcatggctataaacccatccagccccgctcaagaacctgattggtccgtgtgttctttgtgacggcgatgtagcctggatgttcgatctggatcacccttctggtacgactggttcagagggtccggactgctagaacgacagtcgatcgaagctttgcctggcacatatctccctatgagttagatcgtgtggaaccgtttaagcacatgatttcccgtggaaagtgacttcttgttgttagacagcaggagcagatcaacgcggagccatcatattccggggggcaatggactgatcccttgatctgatcgagggatccactcacacgattgtgtgtgtcccgatggtgcttctccttatggtggggcttactggggtcttctgggagggcaacacggagcaaaccgttagcgagatctacgtagagaaccatcactccacggaacaggtactggctttggcttcccaaggcctaattcccgcccgaggcgtttctactatgggatagccgttgggcgcattgctattcattcatggggccgctcatttgccaagccgatcaaggcgcaaacgttcgattgcacgcttacccctttggcgacatggactacgggtggcagtcccaccatgggtcgaggcttcaattttaacccaggtaattttcccaacgggccctttccattttccacggtggaaaggacaacacagagacacaataggttaagccgagcattgggcgttaacaccattttggtcgcaacattttgtttggcccaacagcgtacagatgcctttgataaacccacagcgaggacaggggttctctggggggggacactttccccggaacagagggcacaacttccgtttacaccgcagcatagggggaggaacccgttggtatggccatatgacagccacccgtttttaaggtttgcaccgcacagaaaattgggttcgccgcgaagggcactaacgggtggtggaacacagttgggtttacgtctatacacagtttggcacaccactttaacgtttgaaactacgatggcggccctttggaacacgacacagaattacagttccgattgtcgacaacgacttatccccagggcagaagggggtggccaacaacacaagcaaagcgtgcgagacttccaagcggattgtgacaaaaggacatatcccaagcgagtgtgcgcactcgccgcagttctccagagtgatgacgtacgcagtttctcgtgcggcatcagcaggtcgcactctgtgtgctgagtcgttggtcacatacattagtggccgacacgcgacggacaacattgcattgattcatgaaacacagctctggtgttcgggtcgcttcggtcttgatgcagccgaaaagtctgatcctacgcagccacag

SEQ ID NO: 677027 - DNA, 329 bp, Homo sapiens
gctgggtgatctagaggaccttcgggtgcatcatgtgacacattcccacatgtgtacgtatccactcatacacctgggcacacacacacacacactgtgcatacaccccatgcacacaccccacacaacccatccactcatatacctggtcacacatgcccccacccacacacccatgcacacatacccacacacacccatccacacatacccctgggcacacatacacacacacatatgcacacatcccactcacacattctatccgtgcacccatccacacgctcatacccctgcgcgcacacacacacgtgcacacaccccatgca

SEQ ID NO: 677028 - DNA, 217 bp, Homo sapiens
gttttggaaaaaaaaaaacgatgaaaaatgggccccccccccccaaaacattttttttttcctaggggtactgccctcccaagttgggctgtttttttttatgggtaatgtttgccccacccatggatggtggggggtcatttttgttgttttttatccagcttttacaggtttttttgggcagtgagttggtttgaaacaagctactttgtttcca

SEQ ID NO: 677029 - DNA, 864 bp, Homo sapiens
  misc_feature (213)..(213): n is a, c, g, or t
gaaggaaacaaaggaagtgttgggacgacagcgagcgggaaagcggggtcaagaaatggaagataaagtgactagtcccagagaaagcagaagaagcaaaattaaaagcaagatatcctcatctgggacaaaagcctggaggttcagattctctttaaggaaacggtgtgcagaaagggcaccaaatattctgattctggggattacaacatngctaaagcaaaaatgaagaaacaaagcaatttcctactgcagctccggataagacggaggccactgttgaccacattcccactccgaaagaccttcctcaaggaaagccgtccctgtgtgtggtagcaaagctgtgtgggtgataaagaggctgaacgtgatgaatctgtaaaatctcattatttctccttaaatatgtaattatctacttttaatttcctttcattcactagtcatttgagactgacagttgtggaggtagcagtagtgtgtgctgtatggtggaatatacgtgtgtagagttggatttagttaaccatgtgcacgtggttgaacgaggaaccgtgttagagcaaataagtaaaactactgtgacaataagtgtgtatattataactaaattctagtgtaagtacgttgttctaacaagttaacaagcaaagttttaaaatttacgtgtgtgggttacattacttcatcttaaattatagtgtgtatgtactctttattaatataaccctaggggatgggagctcggaattaccttgtggttgtgtaaaactacgttagcccacagttagaaaagggcactttttcaccacataatggggtcgagaattgagttttgggagagaaggaacaagtgtaatt

SEQ ID NO: 677030 - DNA, 513 bp, Homo sapiens
tcgggggccttaaccctcacagaatcacatctggatcctcaagactaaccaaccagagcctacagtgctcacacaagatcacatctggatcctgattgactaaccaaccagagcttacactgctcacagaatcacatctggatcctcaagactaaccaaccagagcctacgctgctccaagaatcacatctggatcctcaagactaaccaaccagagcctacactgctcacacaggatcacatctgatgtcctcaaggcctactgttagccaggctgcgacgtggacactgtagcaaccagactggaggattctacagggaacagagtcctcactccacgaatgatcagtgcagcatcataaagattcaaaatacgtctacagaagccccagaaagacatgtctcaagttagtccacaaggttttagaacacagggaagcgactgctatcttccatacattcacaacacttcaagtgtcaatcaccagggttacgggctcccggggggtaccg

SEQ ID NO: 677031 - DNA, 116 bp, Homo sapiens
gcacatgaagccaacagcatgatgatgataagtatgtgtggaggctgaatctgaaggtttagttcagaagcaggccttgaagttgatagccagcatgaataacagtcggtgcatgt

SEQ ID NO: 677032 - DNA, 125 bp, Homo sapiens
tatccgcttagtggggatgagctgttcttgaagtgaactgtgttgtatggaaacttttgcaactaacaaaccttgtgcattgggatcaccgatctgcagaatcctgacagagctgatggggccct

SEQ ID NO: 677033 - DNA, 504 bp, Homo sapiens
  misc_feature (116)..(116): n is a, c, g, or t
  misc_feature (135)..(135): n is a, c, g, or t
  misc_feature (348)..(348): n is a, c, g, or t
ttgttactgggtatatggttaaaaaaaaaataaatttttttaccaaaaaaacccctgcactcagatgttttctgcaccagatttcgcaataacaaaggcatggatttaaaccaggnacatatgaatcttagattnatgtttcacgttcatttgcttagattaaaggcctgctgtagccacgttgctgcaaagaacattactttttcttttctatggctccatagtattgcatgtgtataagtatctcaaataccacatgttcttatttataagtgggtgctaaaccttgggtgaacctggaaacaaaaataaaaacaataaacactgggaattctaaaaaagaaaaanaaaggagataagctttgaaaaaactacttatcaggtatgatgtactctacttgggcaacgagattattaaatacccaaacctcaaaatcatgcagtatacctatgttacaaatatgtatgtgtaccccttgaatctaaaataaaagtaataaaaca

SEQ ID NO: 677034 - DNA, 956 bp, Homo sapiens
  misc_feature (1)..(1): n is a, c, g, or t
  misc_feature (71)..(71): n is a, c, g, or t
  misc_feature (74)..(74): n is a, c, g, or t
  misc_feature (175)..(175): n is a, c, g, or t
  misc_feature (209)..(209): n is a, c, g, or t
  misc_feature (212)..(212): n is a, c, g, or t
  misc_feature (246)..(246): n is a, c, g, or t
  misc_feature (249)..(249): n is a, c, g, or t
  misc_feature (271)..(271): n is a, c, g, or t
  misc_feature (273)..(273): n is a, c, g, or t
  misc_feature (278)..(278): n is a, c, g, or t
  misc_feature (286)..(286): n is a, c, g, or t
  misc_feature (292)..(292): n is a, c, g, or t
  misc_feature (295)..(295): n is a, c, g, or t
  misc_feature (305)..(305): n is a, c, g, or t
  misc_feature (318)..(318): n is a, c, g, or t
  misc_feature (323)..(323): n is a, c, g, or t
  misc_feature (349)..(349): n is a, c, g, or t
  misc_feature (354)..(354): n is a, c, g, or t
  misc_feature (360)..(360): n is a, c, g, or t
  misc_feature (382)..(382): n is a, c, g, or t
  misc_feature (396)..(396): n is a, c, g, or t
  misc_feature (403)..(403): n is a, c, g, or t
  misc_feature (406)..(406): n is a, c, g, or t
  misc_feature (409)..(409): n is a, c, g, or t
  misc_feature (419)..(419): n is a, c, g, or t
  misc_feature (430)..(432): n is a, c, g, or t
  misc_feature (435)..(436): n is a, c, g, or t
  misc_feature (441)..(441): n is a, c, g, or t
  misc_feature (454)..(456): n is a, c, g, or t
  misc_feature (463)..(463): n is a, c, g, or t
  misc_feature (466)..(467): n is a, c, g, or t
  misc_feature (470)..(470): n is a, c, g, or t
  misc_feature (473)..(474): n is a, c, g, or t
  misc_feature (477)..(480): n is a, c, g, or t
  misc_feature (483)..(483): n is a, c, g, or t
  misc_feature (488)..(488): n is a, c, g, or t
  misc_feature (497)..(498): n is a, c, g, or t
  misc_feature (507)..(508): n is a, c, g, or t
  misc_feature (529)..(529): n is a, c, g, or t
  misc_feature (545)..(545): n is a, c, g, or t
  misc_feature (550)..(550): n is a, c, g, or t
  misc_feature (564)..(565): n is a, c, g, or t
  misc_feature (574)..(574): n is a, c, g, or t
  misc_feature (577)..(577): n is a, c, g, or t
  misc_feature (873)..(873): n is a, c, g, or t
  misc_feature (885)..(885): n is a, c, g, or t
  misc_feature (953)..(953): n is a, c, g, or t
ncaggcggggtggggggctggcactcaggcggggactaggcaggggaagggctgcccccaggcatgttganganaaactgaggccagccctggcggagacctagcccagcggggtaaggagggtgggggaaaactgggtctgaaggaatgagggccccctccctatgggatttcnaaaaaaagggcctcagtccctcctgctggctggnctncacgacccccaatccttgctcccctaacccgganganggggccagaccagggagggcantngacanggagcctngggganttngggagcgcanggcagggtccatngtgtncagagggggtggcagccacctaggtngtcanttcctngcagcgatgaccacagagagtnccacaccccccaangcaacancantcnccccaaacanccacttccatnnnatnnaccangcaccctttccannncacttancanncanccnnctnnnnttncccancattttccnntacaattcnntctcctttctcctcttctccncattcttcttcaccanctttnagagctctgcgttnnatcgtcttnttngaaggttccagcttcagggctgccctcaggatggggatggcctcactgtactccccctgctgggccagcaccttgcccttgcggaagagagccttgatgttgtctggctggtgctccagcacaaggctgcaggagcgcagggctgcgcggtagtggtcgagcttcagctgcgaggccgccaggttgttcagacacttcaccttcaattgcaggagctgtgcctcctcctcgaacgtcatgtccactttggcgctggaggtgatagccttgatggcgaggtcgtaggagttggcggncaggacgaatangcccgctggtagtgggcgttgcgcactcccgcttccggttggcagggcacgcgctcctgcccgtgagntct

SEQ ID NO: 677035 - DNA, 195 bp, Homo sapiens
tggagagggagtttggcttttctgggcccagaacgggaggggagggggggtgatctgggctcagggcaacctccgccttcgggttccaagcgattctctagtctcagcctcccgagtagcggggattacgggtgcccgccatatatgcccagcataattttgggtgttttggcgagcgatagggggatcctcata

SEQ ID NO: 677036 - DNA, 209 bp, Homo sapiens
tcaggcgtaactgtgccaggcttgtgtgcactgcgtgatcgggtatacctccacctcccgggtcgagagatctccatgcctcagctcccaagtagcgggaatacatgtgcatgccacaagcccagttaattttgtatttggagtagagacagggtttcaccatgttggtgaggctgatctcgaactcctgacctcaggtgatctaccca

SEQ ID NO: 677037 - DNA, 1060 bp, Homo sapiens
  misc_feature (501)..(501): n is a, c, g, or t
cgctggttcttctctgaagtgcctcgtgtggctctttatcgaccacctggttgaatggaagtgtgagatccagatatggatggaaggccttctccttattgtgctctgtgcaaaactggggggaagcgtggagcctatgctacagtgggtgactcagagcgtctgagagcaaggtgacctaagcctggaagtcacagtaggcaatcatgatctagcttgagtaattctatggttgtcaaaagcgtgtcagcgaatgccgtatctagagaatgaccatagtggactagttctgttacgagaatagtatggagaatagacgaagtccgtacaaatctcgtggtcggagaattacgaaaacgatcagagccaagaaatcgctgacgggaaaagacacaaagtttgcgaggggtatctagcgattgagccacggcctcgaagacatataccatgagaacgcgtagtgacgtaacgcaagagacgagccatgttactggaataaancagcaaagcacagtagcagccaatggaaccacgaagtcgatgaatcccacgatacattaatcctacgatatctggcacgtcgcaacgtgattgtttgaccaaggtgccgagaacaatcatcggggaacaggacacggcctcttcagttaaagtgatgctgggaaaactggatagtcatactcagaaagagtaagacctagacccccgagctcttgccctatacaaccagttaaccgaaaatgcatctaaacctaactgttcagacgaaaatgactataaacactactaaaagaacaacataaggggaccctgcttcagcaccatcgggtcgcacgaccggattccagtgaactacgaagcttcaagaggcaccgtaacagccaagaagacaagcaataacaccagaatggggaagtactcatgaaagtcagcacggttcccctggtagccccaggaacaccaaaccggaccagagtgcaatagacataacgtacagacagggccgacacacaagtgcgccacctgactcaatccaatggcgggatccccgacccagaag

SEQ ID NO: 677038 - DNA, 932 bp, Homo sapiens
cgtggtggtagccgttgggttgggaaagttgagggattttgtgggcctcgttctcctgcttcttttctcctcccttttactttgccggtagaacacagttatgggtcgcaagatgaagaagcagctgaagccgtgggtgcttggtattgtaatagagattttgatgatgagaagatccttattcagcaccaaaaaagcaacagcatttctaaatgccatatattgtcaccaagaaatcgtatacaggacctgggcttaaggctattcattgcattgcaggtacataaatgaaaccaatagattgccgtaccaagatgcattacccttggaagaacagacatacgagtttggaacatactagtggtcatggccggtattccagaaaaagagacattggttggaaagacgacgacttcttgaacaagaaaaacaccaaggaaaggttctaaaaacagaagcaacaaagatgattctgagtgaactatgatgatggacagactctgcagactacaaattacatatacagccacagccttgttcaaaccctcaggcaaggttatattcctccaatggcaaaagccagggactgcaatcaggtaaccagggaggcaccagtgaattgcctccagggattccctcccaattaaatgcccaggggtggtccgttccgttcttacttcccagggaaatgccaccaatgtaattgccaggcaatgccaccctgggattgcatgtaatccgaggagaagatcccccaagtcttttgtgtggggacaaccttagtttgtccacgtggctggaatgtttccccctgtgccacggaaattcaccctatgtagccgcggaattcgaccgtgttagccccccctgtgtactcggcgtggagctcaagatacgcaacggtgtacccgggtgtttaataacacgtctag

SEQ ID NO: 677039 - DNA, 343 bp, Homo sapiens
ggctcactcaaatgacaatctacgcgactctcaacaagagccagctagaagtgaagtctcggaagggcccgtagagccctctaattgggacctgaatgtccagagtatggagactcaaatcgacaaagcccaagcttttactcagcctgtaccccttgcgaataagcctgtacctgctccatctacttttccttcaaaaacaggtgggatggagggaggaacagcagtagcaacatcatcattaacagcagataatgattttaaccctgtgggtattggtctaccccattcagaaaacaaccaagataaaggcctgcctcggccagataatagagataataga

SEQ ID NO: 677040 - DNA, 332 bp, Homo sapiens
agtacctcacaggaacagagtcacatgttattacactccgcaggtgaggaacctgtcatcattcatagattatgtcttgtgcaacaagatacattagtttgtaggacactggggactacaacacaacatacaaagtaagaataaatccatgctgtttaaccttccaccattctcttgcagtattaaacccaggccacctttggccacctgtcaggggtgtcttttcttctttattctcaatgtacatacgttgctccttgggacaccagcagtttcgcttcttccactctctcttcatcacaggctaagtgtagaggagtgttaccctcagt

SEQ ID NO: 677041 - DNA, 517 bp, Homo sapiens
  misc_feature (349)..(349): n is a, c, g, or t
  misc_feature (514)..(515): n is a, c, g, or t
tgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactagtaaatgacggtgcgtatacaagtcaaaaaaatacaatgcctgcctcgtaagtgaaagttgtagctctccgtaagtaatgtatattttnactcaggttttcatacattttgtagaatagttgacatacctgaaagttcctttgttagattgtgcatattaatcattcgtgttggtattctagagtggttccgttgaaaagttttatggtataaaatatgtaacaataaaaaattaaaactcttgtttcaaaaannaa

SEQ ID NO: 677042 - DNA, 218 bp, Homo sapiens
ctagcagggatcccctgatcagagcttgcagtgtcagcttacttctactctggctatctttcagaaatttagctgccttatctatagctcacttgtcgtacagtccaattaggtactagttcatagtgttaataaatagttactctgttaagaatactatatattagaacatactacagtaagatttcctgaggttttagtatgccttatagaatgat

SEQ ID NO: 677043 - DNA, 346 bp, Homo sapiens
tcactgctacgacggctcaacggcttttggaaatctctattcccatatacaaatatttaattcatattttaaaaaaatctcactacccatactatttataggtaaagaaaatccattgaaaataagattattaagatatataattatttaaactacaatgttgagaaatacaataaaaatttatagagatactataacgatcttgaagcaacttacaaataaaattatttttctttgagatgagttatatgacttctccattataggcaaaactggaaaagtgttataatttagaatactaaagttagtgttttggatttagaatactaaagtagtgtttagctaa

SEQ ID NO: 677044 - DNA, 108 bp, Homo sapiens
agctgtgaactcgcctgactgcggacttttctcctaccgactctgtgcggactttacacccgactactggtggggactcctctacgacgtcaccctgacggactgaac

SEQ ID NO: 677045 - DNA, 616 bp, Homo sapiens
caatagcgtagttgcagtgagctacctctgttccggggactgtctatgcatgtcccgtttagagacatggcgcaaaatgcaatcacgtgtctagagtgcgaaagcattgcctaatcagagtggcaatatcattaccagagcattgtcacgagctcatggtagtagatagaaaagttatagattgagggcacttctgcagacttacgcagttggatctgtgtagatatgtatgtgtatatatacatcgaccatgtgcatattcagcctatggtgttcgtcccatttctcagtttccagttcagcattcagcattctcagcgtatgccatgatatctctacgcttacagccaccgtatgacggtttaattactctatgctcattttcaggcatcatctgaatcaccgtatatactcgcaagctcatcctgtttagtcaatgaagcactttctcatgcacatactaccgatgttttgaacatgaatctggcaattgatcaggtcttacgattagtaatttagactttgtcatatcgagcaagtcatctgatattattttagggaatctgttgaataacagccatacagaaatagtatagaagtcataaccatgctggca

SEQ ID NO: 677046 - DNA, 675 bp, Homo sapiens
ggaccgctttccgggaaactggagtcgaatggccgatgaggtattgtttctaagtcagccataatggcaggtgaagactattaatgaatgactatccagtagaaatccacgagtatttgtcagacgttttgagaattccattggtgctgtggatgagagtgctgaagaaccatgatgtctgtttctagaaatgagttgttgctagaagttggatccgagattgtaactaaggaaaagtggatttggtcttctgctgtacagcattatattcaatgtgtggggttctatttggcaacgcaaggagttaatcctaaggatacagtccagtagaacaggaatgggaagagaatcagagtatatatgaatcagagtcaaggaaataagagacaagaaaaaggctggcaagctggacagaggtgcagcttcaagatttgtaaaaaatgcgctctgggagccataattggagaaatgcgatcataaagttgcgaagtagaggtaaacagtaccgggttaagttcccggttgtgatgtacactatattcaaaaagtattttttttccccctggccgtcagcttaaagatgggaggtacctttgcttggttgcaggttgtatggactgtctgatagggaatagtaagtagggtgggttggagggaatggtggggaatatggtg

SEQ ID NO: 677047 - DNA, 150 bp, Homo sapiens
gtacagtacatcggtctgcatgttcgaggcatctatcagacgccaaaggttcttcgaggtacagatggctgcctggtatgacatatcacatgtgagtcaatgtcttaagaagtcttaaagtgcgaatctatattgctctggtcaagctga

SEQ ID NO: 677048 - DNA, 410 bp, Homo sapiens
gacagcaaatacttccgtaaaacagaccatcaagctttccacttagagcccagtgtggccccaatacctttccttgtcgctcctgcgtgccagtccgcctccgcgtggtccggccgctgcgccacgcccccgctcgccccgcccctggatttgctccctcaaagctgaagtgaggccgggctgaggctcttacagtggtccctgctggcccttggtgacgggtcgcctcagttccgacccggacccgtacgcttgcgctgacgtggctcccaaaagtagggctggcgtagggccgccatgttgcagcaggtgaggggctgagggctcgctggtagggtggcggctcctgggactggctctgcaggttccgtgggactggaggccgcgtccgcgcgcgcccgctactcgaa

SEQ ID NO: 677049 - DNA, 139 bp, Homo sapiens
caggtgtgcaagatatctcttgatagagagctgtgcatccacccccactctgtgcttggttgatgaggatagggacctgagcaagcctcttgaggccagctgcagtagcagagtcacattgccatcccagctcccccag

SEQ ID NO: 677050 - DNA, 153 bp, Homo sapiens
catgcaaataccccagctgggggactacgaaatcagcccaaggctcgtggttgagagaaacttcagagccagctggcagagttaactggtggcgtgactccccaggaaggctgaggtggaaggaatccaggaccaaagacatttgttccctgg

SEQ ID NO: 677051 - DNA, 879 bp, Homo sapiens
  misc_feature (4)..(4): n is a, c, g, or t
tccncctcaagaataaatggggatgctcgaccagagtctcgaggcacgcggtctatatcatactgggcctcagtcagttaactagttcttgagtttgttgtcacaaaccggcggatactcttccttcaaaaagttggtgcctgatacctctcttataaaattgggccctttcccgtcttctttgcggccccggcggtcttccacctctgtattttcggtgctttgctccttccttagtggcttggtccatacccttttctcagtcctttccagaccaagtagaaacctgggctgggccccacaaataccacgtgtgttgggggcccccccctgagtccctcccgagttttataaattaccccgggtcaatagccgcgccccccttggtcgcccgctttaagtccccggaggtggcaaacaactcggaaaacccctggtaagtctgccgccaacccccttgggattcccccttaattaaccgcctaggtatacgtgttttggtgagggaacactaatgccccgctggcacatttgtcgacagaatatgtcttgttctccttgttttgttctttaggagaacaatcttcgggatgagtcatggatatgctccgcccctctaatcattgcgattttgttctcaagacacaagaagggtggttcagaatggaccacccgggacaacacaatcattgaatacaagtccctcggcctttctaagtttgctaatcaagcaccccctcctcggcccgacggattgttgcccagcagtaatttcatgttttgctaccagaaaacagaaacatcatcctccgggcgcccagctccctacgaaatctctgacctcccccttcccaaaaaacctaaaacccgaacaaaaca

SEQ ID NO: 677052 - DNA, 397 bp, Homo sapiens
tttttttaacagaaaaaaaacttttttttaaggtccccctttttcagaaataaaaggctgccccaaattggcccgtttttattgcctgttggatttttgtctggggtttctttaggttttgggaagtttaattgccttatttaaataaattttttttgtttcaaattaatgggggtctaggcaggacctggggccaagtttttagttgctgtatgtctcgggggagggctgtaaaaaagggaactgacccttcccgggggggtagtgaatcccgtaaagctaaaaatgatcccccccggtttatgcataaataatttcccccttcccgggggacgtttttcctgtttttaaaacgggattttgctgtaaaaaagggcccttataacccaagccctta

SEQ ID NO: 677053 - DNA, 928 bp, Homo sapiens
cccgcaacccacaaaaaaaacgagcactcagtaatggctaggtacgaggctgggttgaggaaatctggcctccgcctgcggacctagcggaacccgtttcccgcctccacggggcagtgccagcggcctggtcctttcaccggcagctccgtgccgacgctctcaccgcttcttcctatcgccgggagttggctgggccgaccagggcggcggccgtgctaccgtccgccatatcccgctgtctctgcgccctcgggtgggccggccgaagccggtcaccgatgccgctgtggcctgaagcccgacgctgtcagccgtgtgccagaccacgtcgtcctccatttgcgaggcaagggagcgcacggggagatccttctgccgcatcattgcccttgcgcccgtgcggtgtttcaccaggccatgcgtggggccgcagccggctcgggtggtgcggtctgtccggcgaccttgggtggccagtcgaccgagccgggcggggcttccgggccgcggggggaccctttcggccagacaccttccggccacccccttccggtcagaggcaaactggtgggcgagggtgcgggacagagctcagaagttacagccaggacaattccaccaaggagggttctgactcgggctcaaaaaaaccactaaattactaattctgctcccggcttgcttgagacaggaaagtcttccaccaagagggaaaacggggagcaggacttttttttaggttgaaaaattcccattcaaaggctcctgaagtcagtttcccacttataaatcactgcaagaatcagtcttctaccagggagtatattaccaatttggcagattcggtcctggtgagtttgtgacacgatgtgaagcgcaaaatgccaactccggggtttcccggcccgtttggaaagagtgactt

SEQ ID NO: 677054 - DNA, 282 bp, Homo sapiens
cgtgtgcgtctcctgagttccgcctgctgctgtcgtgccttatatttgtggtacgccccggcccgcctgcaagcatggcgtttgtctgcttcggccaccctccagccaccacaccaaccacacgctctgttggctgcaggagattaccttcttggcagccggagggccgcttcacacggcgtcttcttgcgtctcacgggtcttggctgacggagcagaaagcatggaacgcgcgcagaacgcagtgaagcacgggtcttgcgtgacggggcaagaagctag

SEQ ID NO: 677055 - DNA, 141 bp, Homo sapiens
ttgactggcccggaggcgtgaactggcccggtatgcgtgatggcccggaggcgttgaatggccctccctaatacagagaatgtacatacacagaattgggagatcaggtcgatacggccggaagggtgtggccattcaacg

SEQ ID NO: 677056 - DNA, 326 bp, Homo sapiens
gccgcgctgcccgcgttaagattcccgcattttaatgttttcagggggtgtcatagccccgggtttggccgccccagccccgccttccccgccccggggagccctgccccctgccacgcgtccctgcgcgaccgagttagcacgacatcgagtatgagcctggctcaccgtctccctgacaacgcagacatgtgggcgcctgggaacatgacaagagcgccttgggacaagggggatcgtggaaatgtcatccgatgggacaatcaggaaacaggtgagcagattgccatcaagcagctgacgggcgagtgagctcagcccccgga

SEQ ID NO: 677057 - DNA, 426 bp, Homo sapiens
ctggagaaagtgccatcagtactgggagaacaatcggaactcgggcgagtttcggaagactggggtgctcgacgcggagttcgaggcccatatgatggacatgatggtcaaggccagcaagatcgacgtgtgccggggcaattgagccgggcctaaccgagaccgttccggcccatctatcgggcaccgggggtccagcccgggacccaggaccagcaacccgcgacccatcatgatgcagcccaggggcgtatgctgtgccccgccaatcacgagactgggggcccggccgggcctgacacccatctgcgttgcggtcgggcggagcttctgtatatcccagccaatcatgtgactcaaggaaaacttctggcgatgtgtccagtctccgccaatcaatgacctttggggccgggccagcggccg

SEQ ID NO: 677058 - DNA, 193 bp, Homo sapiens
gttcacatgaaaggacgagttcacacatttttcactttaaatcaaaggctagaattgattagcttattgaggaggtatgtcaaaagccaagaaaggccgaacgtgaggttcctgcaccaaccagccaagttgtgattgcaaagggaagttcttgaggaatttaaagtgacatagttgttaggcagcaaaccag

SEQ ID NO: 677059 - DNA, 399 bp, Homo sapiens
atatttgtgtgtagacatgcacatttgtgcaggtggacaggcatctatatatgtggagtcttggtgctgatgttgggggtctcccctaattactattcatcctattaatggaatcaggatatttcagtgggacccagaccgtgcctggcttctctacttagcaggctggccctggagattcatgtctgtgcatcttgtgcactggcaacacaggatgtcagccctgtccagttgacatgtatgtgggttcagaagatcaagattctggtccccatgcatgtatggcaagcgctttaaccattgacctgtcttctaagtccttgatttgtactattattactatgcttcttagcctgccccttcaacagtgaaatcttagtcgacgcgcccgcgaattta

SEQ ID NO: 677060 - DNA, 161 bp, Homo sapiens
actttccaagttctcaatttttccttcatcatccttagactcatccacataatcaatattttccttgacagatttcactagaaaactgagcaatatctgccttgctatctcggacttctcagattcagaaatactgttttttgtggagctcccctcctcgt

SEQ ID NO: 677061 - DNA, 389 bp, Homo sapiens
gctgagtgcgggaagtgatcacccgagcccaggatgtcgaggctgcagtcgagccgcgattgtgccactgcactccatcctgggcaacagatggacaccccgtctcacaaacgaacaatataagacaacaaacaaactaacaaggaacagagacagtatgtggcctgcaatgcctaatcattatctgtcggacactgttttgcccagccctgcctgcacagcttctttatcattcctggctttagcttgcatatcccttgggatggcgaccgttctctacctctcacgacagagtttccatggttggaaaccaagctctgcctgcgcttctttatttccggatgaaagctgtccccttgtagcttccatcctgatccctttgctagcca

SEQ ID NO: 677062 - DNA, 245 bp, Homo sapiens
  misc_feature (79)..(79): n is a, c, g, or t
  misc_feature (160)..(160): n is a, c, g, or t
gggggccggggcgggtggttaaacagggtcggggttgtggaccggcctgcccaaatatggtgaaccccttctctccttnaaataccaaaattaagaccgggtgtgggggcccgccctgtggtgcccggctcctcggggggctgggcgggggatcgcttgnccccaggaggtgggtatgttgctgtgggccggggtataccccccacctgcactgcaacctgggcgtacggggctattcttccgtc

SEQ ID NO: 677063 - DNA, 305 bp, Homo sapiens
  misc_feature (11)..(11): n is a, c, g, or t
  misc_feature (65)..(65): n is a, c, g, or t
  misc_feature (158)..(158): n is a, c, g, or t
  misc_feature (299)..(299): n is a, c, g, or t
aaatgcgtcanttatgttcaatgtagatatggccaagtcacttctgtacagagcctcagaggagnctttctagggacagcaggctaagatttctgggatctgccttcccactcctctccaccttctgctgggagatgcctagcagctaagcttgctcntgacctggtgatgttcttgaacaaaaagaaaccatgggtcgtacttttgttacattctcttgttcttcataataactttaccagaaggaaaaaacagaaatggtgataaaaataaaagattgtgtcttctcaggaaaaaanaaagta

SEQ ID NO: 677064 - DNA, 1063 bp, Homo sapiens
aagatgaagaggagatagaagaggagctacaaggtgatgatgggagtcaatgtagtaagcacgcatgggtaaaacacaagcacaaagtcagcaaggatgatgcaagcaaccaaattgctacatacaggcagctcttgcccggttattccaagcaacacaagaacacagaaaggcacagaacaatgcatatggcaaatggaaaattcaaatgggttccaggtcgttcaacagaacagtgcagaacgagatggtcaaaaacaaattgcgaaggacaaggactcaaactagacccctgtgggcaacaatttttagcatgcaagcaagaacagagaacaacaacagcactgacaaaggcaaaccagcaaggctcttgctcgaagaggcccagtgaagaggaacttccctctgcatcgttgatttgaatgacccatacttcgctgaagcacagttaaacaaatagcgtataacactcaacaaaatcggctaacatctgcaacaagatggcacatctccagaagcacagcaaatctgcacctagaacagacacacaaggctgcaaactggccttcgccttactgatggcatgcaggcacgaggacagtaagcaacacacttcacattacaaacaacgattgtgagagcacccaagaaattcatgatgccacaaagagaaagaaaaaacatgcctgcctccatggaaaacacagaaagcggcacttacactagacgggaattgacctttggagcttcaaactgttacaacgaatccaccggattccatggccaacatgtaccactttcacaacaatggttgcaaattcggggaaccgccttaggaattccagattttcaagaaaaatctaaaggcccagggaaaacaagccctgcacggcagcaaagggccggtgcaaacgcaaaaccggaacggaaaccacgaactcacaacaagcgcagtaaagacaagcaaaacacacgaaccacgtgaacaggacaaccccagacagaccaagaaccccacgcaacgaaccgggagaaacacacaaaaaacaacaacacaccacat

SEQ ID NO: 677065 - DNA, 713 bp, Homo sapiens
  misc_feature (27)..(27): n is a, c, g, or t
  misc_feature (30)..(30): n is a, c, g, or t
  misc_feature (42)..(42): n is a, c, g, or t
  misc_feature (59)..(59): n is a, c, g, or t
tgcagaatcacactcacaactcagtanganaaaagcagctanatagacagaatatttgnacacatatttaaccaaagtagatatacagatggcaaatgaagatataaaaagatgcccaatgtttagtcattaagaaagtacaaagtaaaaccaccatgagacaccactgtacacttactagaatggtctaaaaacaaaactgacagtaacaagcactagtgaggaagcagaggaaatgaaactcacataaccctgcactgggaaatgaaaatggaacaaccaatttagagaatagtctggcagtttcttaaatttaatcatacattatagtatcaccaggcaatcccaccattcagtatttacttaacagaaataaaaatctttgttcacataaaaccatgtatatgaatgtttatgatagctttatctattattgccccaaagtggaaaaaaccaaaatgtacttcagctggtgaatgtacggatttaaaaaatgaaaaaaatattcatacaactacccagcaataaaaaaagaatcaactgataaatacaacaataggaatgaatctcaaatacattaagaaaagccagacttaaagggtacatactgtgtgagtccaaatttacagcatactcataaaagaggaactatagggacaaaaaagcagattagttgcaggaactttgagtgtgttctgccgagatcctctggg

SEQ ID NO: 677066 - DNA, 709 bp, Homo sapiens
aattcaatacttttccctgattggaggagattaaagctctgaatggatgggcacatagtgacaacgcgaactagaccacttcggatggcaaatgaagatataaaaagatgcccaatgtttagtcattaagaaagtacaaagtaaaaccaccatgagacaccactgtacacttactagaatggtctaaaaacaaaactgacagtaacaagcactagtgaggaagcagaggaaatgaaactcacataaccctgcactgggaaatgaaaatggaacaaccaatttagagaatagtctggcagtttcttaaatttaatcatacattatagtatcaccaggcaatcccaccattcagtatttacttaacagaaataaaaatctttgttcacataaaaccatgtatatgaatgtttatgatagctttatctattattgccccaaagtggaaaaaaccaaaatgtacttcagctggtgaatgtacggatttaaaaaatgaaaaaaatattcatacaactacccagcaataaaaaaagaatcaactgataaatacaacaataggaatgaatctcaaatacattaagaaaagccagacttaaagggtacatactgtgtgagtccaaatttacagcatactcataaaagaggaactatagggacaaaaaagcagattagttgcaggaactttgagtgtgttctgccgagatcctctggg

SEQ ID NO: 677067 - DNA, 749 bp, Homo sapiens
  misc_feature (214)..(214): n is a, c, g, or t
  misc_feature (222)..(222): n is a, c, g, or t
  misc_feature (386)..(386): n is a, c, g, or t
  misc_feature (463)..(463): n is a, c, g, or t
  misc_feature (485)..(485): n is a, c, g, or t
  misc_feature (533)..(533): n is a, c, g, or t
  misc_feature (543)..(543): n is a, c, g, or t
  misc_feature (567)..(568): n is a, c, g, or t
  misc_feature (593)..(593): n is a, c, g, or t
  misc_feature (603)..(603): n is a, c, g, or t
cactgctggctaatttttgtatttaggtagagtcagggtttcagcacatggcacagtctggtctcaaattcctgggctccagtgatcctcccaccttagcttccagagtggccaggatcacaggcaggcaccaccatgcccaggtaattttatttttttgtagagacgtggtctggctatgttgtccagggtggtctcaaactcctgggctcanctgatccncgcacttcaacctctgccatagccaggacctcaggtgtcagccaccacacccacagctaattgttttttttgtagagatggggtctggctctgttgctcaggctggtgtgtagtaggggcacagtcatagctcactgtaaccttcaacgcctgggctgaagcanttctcccgcctcagcttcccaagtaactgggagtataggtgtacaccaccatgcccagctaattatttagtagtagnaggaggagtattatgtttgagntggagtctcgctctgtcgcccaggctggagtgcagtggcgcagtctcngctcactgcnacctctgcctcccgggttcaagcnnttcttgtgcctcagcctcctgagtngctgggattncaggcgcccgccaccgcgcctggctagcttttgtatttttggcggagatggggtttcgccatgttgcccgggctggtcttgagctcccgacctcaggtgatccatccgcattggcctcccaaggtgctgggatcgcaggcgtgagc

SEQ ID NO: 677068 - DNA, 427 bp, Homo sapiens
agtcttcccttgaagcaggggaggcagatggatagaggtgtgtcacacgcataaaacacgaggtgcgggagcagggcggggtgaaggctgagtaaactgagggctgaataccgtggaggtccagatgcggcttccctggagggcagtgccggaggcgtcgcccccctggggttgaggatgctggaccccgtgggcttggaggcctgccgggatgatgccttcaggcctctgtgcctggcgggcatcctcgggccgagtttgaccagcagtgatagactcttcgtaaccggttcagaataaatttttcagtgggacagaaaggagaggtaaaaaacattgttttgaaggtggtaagatctggcgcacagagggagtgggtctgttttatgcaaaataaaagtttgtggaatagaaaaaaaaaagaaga

SEQ ID NO: 677069 - DNA, 425 bp, Homo sapiens
cagctcggtaccaacagaacatgaccagtcttctgtctcatgtaggcagagatactactctgaagccttagtagtgggcctgggtacgtttgggagcctgagctggaattgaagctggcgtgctgctgcctgggcctggtgcgatccttggcctgtgggcttggccttagggcggcgcaggctgagccccttgggaatacgggcacgagcacgcttcccaagcttggggtgggcaatgtaggcaagtcgatcgagcttgcggctgacaccctttgggatcttgggcttaacctccttgggctttacgaggaccttgatagcctcggcacgtgcactcatggccttggcattgttggcctgcatcttctttaggccctttttgttgtgcttcttggcaaagcgcatgttcctcaggaacttggggt

SEQ ID NO: 677070 - DNA, 491 bp, Homo sapiens
  misc_feature (128)..(128): n is a, c, g, or t
  misc_feature (205)..(205): n is a, c, g, or t
  misc_feature (227)..(227): n is a, c, g, or t
  misc_feature (275)..(275): n is a, c, g, or t
  misc_feature (285)..(285): n is a, c, g, or t
  misc_feature (309)..(310): n is a, c, g, or t
  misc_feature (335)..(335): n is a, c, g, or t
  misc_feature (345)..(345): n is a, c, g, or t
cttgctgccatgcccggctagatttttttatttgggtagagatggggtctggctctgttgctcaggctggtgtgtagtaggggcacagtcatagctcactgtaaccttcaacgcctgggctgaagcanttctcccgcctcagcttcccaagtaactgggagtataggtgtacaccaccatgcccagctaattatttagtagtagnaggaggagtattatgtttgagntggagtctcgctctgtcgcccaggctggagtgcagtggcgcagtctcngctcactgcnacctctgcctcccgggttcaagcnnttcttgtgcctcagcctcctgagtngctgggattncaggcgcccgccaccgcgcctggctagcttttgtatttttggcggagatggggtttcgccatgttgcccgggctggtcttgagctcccgacctcaggtgatccatccgcattggcctcccaaggtgctgggatcgcaggcgtgagc

SEQ ID NO: 677071 - DNA, 301 bp, Homo sapiens
attatatcatatataatattgatacgtgaacgcgtgcaggacctgcgccttgcaaagctaactgcaccggtatgagatgatgtagcagcacctttagtttgtgatactcgctgagatgtcagtattctatgatgacgccagatactaacctatttgaggatcttgccacagtcgactggtctaacacatcggagggtaagtcattagcctccatcagtattaagctctacgccttatacgcaccgtcgccgggaacatgaccgacgtccatgcttttgacgtaggcctacgctgctgtcct

SEQ ID NO: 677072 - DNA, 274 bp, Homo sapiens
tttcaggatctcaggtatgtgactaactcttctatgcccagagctggaatgaggggtccctaactccctgggtgccaactgccacttcaacatttgtggccattccttaccactttttgcccttgagtgccggctgctgtgcctcagcatacggcttattgatccgattcttctccggcttggaaggcttaggaggatgtttttattcctcctcctcttcctcactctgatcctgaatcagggctgcaaaaacattaccacccttggtattctt

SEQ ID NO: 677073 - DNA, 127 bp, Homo sapiens
cctttccctgacagctgtgtactcttaggctaagcgatgtgactacagcctgcccctgactgtgttcgtcccagggctgatgctgtcccaggtacaggcaggagattacacataggtaagatctcat

SEQ ID NO: 677074 - DNA, 201 bp, Homo sapiens
ccttattctagactccatatcaatcaatagggtttacgacctcgatgtttgatcaggacatcccgatcgtgcatgccgctattaaaggttcgtttgtattcacgattaaagtcctacgttatctgagttcagaccggattactccaggtcggtttctatctacttcaaattcctccctgttctaaaggacactattgttct

SEQ ID NO: 677075 - DNA, 333 bp, Homo sapiens
cggtcaaacgcaataaaagcgtgtattaggtaagtgagggtagagagcgaagataggcgttgaccgacgtatagtttgttaaacagccgctcgctttgagactggagaaaaaagaaatggtagaagtttgaggattgagaattcaaagtaatatcctcagaaagaaacatggaatgatcgaagttattctaagttctccattataactctcccaacgtactcactgccaaccaacagataccaagtgccttcctccccctaaaggatatatttagtcttctagaatatccaaggtgacaatttaatggatatgtaaaccctggcccctgtgca

SEQ ID NO: 677076 - DNA, 623 bp, Homo sapiens
ttcatttcccgaactgaagtatggaaatttggtaatgttgtcattgaacatctataccactggatacacatctgttcagctctcatgaagataaccaaacaactaaatagtggtattacacctccgttgccctccaagactgacaattatatgtatgcaaaaatgccaggggaaggtttgcaagagaagtgataatggatgataatggaattgatactgtatttaggatcctttgtttgttatcagttttgtttgttaactataaaatattttccattggaaaggggtacctataaatgtcttctgctgctaatatttatctcagcactttctaaacccaaaagtgctacctaagaagaaatttagccaaaaaatacccagctaaggtagccatagccaagtgtatttaagtatgttatagaatatatttgaaagcttcctttcagtttgagctttgtatctgctgtggaactgttatggttgattgggtagttatttttcattcttataaggttcaaagtaacagctgaggatttagaaaacaagaataccaaatagaatacgaaataataaagataaaccaaaagaataccaaataataaagatttttaagaaatggaaaa

SEQ ID NO: 677077 - DNA, 103 bp, Homo sapiens
ctgctgcgtcgtctctagaggtccctgttgctacggtgagtgcagtgtacgactccatctctacaaaacaaccacaattttagccaggtgtgctgtgacgtgt

SEQ ID NO: 677078 - DNA, 461 bp, Homo sapiens
  misc_feature (34)..(34): n is a, c, g, or t
  misc_feature (63)..(63): n is a, c, g, or t
  misc_feature (74)..(74): n is a, c, g, or t
  misc_feature (76)..(79): n is a, c, g, or t
  misc_feature (128)..(128): n is a, c, g, or t
  misc_feature (130)..(130): n is a, c, g, or t
  misc_feature (137)..(137): n is a, c, g, or t
  misc_feature (158)..(158): n is a, c, g, or t
  misc_feature (195)..(195): n is a, c, g, or t
  misc_feature (212)..(212): n is a, c, g, or t
  misc_feature (214)..(214): n is a, c, g, or t
  misc_feature (242)..(242): n is a, c, g, or t
  misc_feature (258)..(258): n is a, c, g, or t
  misc_feature (271)..(271): n is a, c, g, or t
  misc_feature (301)..(302): n is a, c, g, or t
  misc_feature (315)..(315): n is a, c, g, or t
  misc_feature (328)..(328): n is a, c, g, or t
  misc_feature (365)..(365): n is a, c, g, or t
  misc_feature (427)..(427): n is a, c, g, or t
gtgtgtatttatccaatttacataaaagaaagcncctggccaaatctaccaaagcgttttccnggaggaagtcngnnnnggggcagggggaggaaagacattcatctcagtctttcacctgagctttngnacaaggnaggcaaattgccccctgaccncaggcagatgtttaagccttcaccaactaagaaagcnctgttattctggcctgngngcttgccccagactcaggaacatctggncaacacaagcatcacngggcgggggaatngggggggggcggcaccacccccgacccccnngaagccccccccntcccccccccacncttacatgccgacacagacagacacagtctggttggnacatgcagtggcagctcctggtgtataacatctttcacacaccttgagtctatctgcttgcngcctttgactgatcctgaaatggttggcctttca

SEQ ID NO: 677079 - DNA, 760 bp, Homo sapiens
  misc_feature (2)..(2): n is a, c, g, or t
  misc_feature (103)..(104): n is a, c, g, or t
  misc_feature (109)..(109): n is a, c, g, or t
  misc_feature (175)..(175): n is a, c, g, or t
  misc_feature (184)..(184): n is a, c, g, or t
  misc_feature (196)..(196): n is a, c, g, or t
  misc_feature (225)..(225): n is a, c, g, or t
  misc_feature (227)..(227): n is a, c, g, or t
  misc_feature (250)..(250): n is a, c, g, or t
  misc_feature (293)..(293): n is a, c, g, or t
  misc_feature (310)..(310): n is a, c, g, or t
  misc_feature (324)..(324): n is a, c, g, or t
  misc_feature (334)..(336): n is a, c, g, or t
  misc_feature (354)..(355): n is a, c, g, or t
  misc_feature (358)..(358): n is a, c, g, or t
  misc_feature (368)..(368): n is a, c, g, or t
  misc_feature (387)..(388): n is a, c, g, or t
  misc_feature (427)..(427): n is a, c, g, or t
  misc_feature (498)..(498): n is a, c, g, or t
  misc_feature (532)..(532): n is a, c, g, or t
  misc_feature (539)..(539): n is a, c, g, or t
  misc_feature (545)..(545): n is a, c, g, or t
  misc_feature (547)..(547): n is a, c, g, or t
  misc_feature (569)..(569): n is a, c, g, or t
  misc_feature (572)..(573): n is a, c, g, or t
  misc_feature (576)..(576): n is a, c, g, or t
  misc_feature (578)..(578): n is a, c, g, or t
  misc_feature (582)..(582): n is a, c, g, or t
  misc_feature (586)..(586): n is a, c, g, or t
  misc_feature (599)..(599): n is a, c, g, or t
  misc_feature (613)..(613): n is a, c, g, or t
  misc_feature (627)..(627): n is a, c, g, or t
  misc_feature (631)..(631): n is a, c, g, or t
  misc_feature (640)..(640): n is a, c, g, or t
  misc_feature (643)..(644): n is a, c, g, or t
  misc_feature (695)..(695): n is a, c, g, or t
  misc_feature (699)..(699): n is a, c, g, or t
  misc_feature (760)..(760): n is a, c, g, or t
tnattaggtggaaaaaagtccctttatgtatttgtttcagctaaagaacatactggataaggattactaaaattaacatcggtacagtaaaaacgatggcaannagggntttggcaccacatttacaaagtaaaagcatgcactgttaatacactttagatgtttctcaacaganaaggcaaanaagatggaaaanaagaggcaccatgtacaaaactccctatnantgagacaaacaagcaagaatcanagtggtcaatttagtaaatatgtagcaacaaagtcactggttntgtttggaatttagcantttgcatttctggntggaagctgnnntgggtgtgtctgtatccnngangctgactttntcatactacatcagcagtnntttggtaatctgcacaaagaaggttaaccttcaaccatnagcttaaagaaaagagagaactagaatcttattgcagaactttccaatgtaattaccatatggaaaccatnatggtactttgggcaggttaattacatttatttnatttaanaagttntntttatagccccagtggccgggnagnnttntnagtnattntgggagtattatnttctgaccataccnagagttaaaaacantttnttcctactnaannggttttttttctggatggtctggtcacatcgtgtgcatagttgagattgtntgtnttaataaagattcttttgcaaataaagaaataaaatttagtaaagttattcttctcttgan

SEQ ID NO: 677080 - DNA, 113 bp, Homo sapiens
ggtataagcaaatgcctttcttcaagttatcaacagatcaacaaacttcctctactccagttcacaattgaagcaaagttgtcatccatataccaatcatgtcagcagcttgc

SEQ ID NO: 677081 - DNA, 893 bp, Homo sapiens
ggcctggaatcagaaacagaaacgttctagactgatgtggttcagtggtgcttacataggctattgtttactacatctgcaccaacctttcaggaagcaatttggcttgtaccatttagctctgtggcccactgaacgagaatttcctgtgaggcagtggggtgaggaaccctgccttactctgctatctcagtacatctgtggaaccacacctacaaccagcgccttccttctgcgcatccctatggccaccttgtcctaacttcctgttttgggaaatcccccacgaggaggctagccaccagtgctgacacttgtataacaatttctggaggtcagaagtccatgatcaacggtgccatcaggattgatttcttgtgagggccttttctctccctggcttggcttgtggtcctcagacatggctcttcatctgtgtatgtgcaagagcagaaaaccagatttctcctgggtggccttctaacacacacacatcacgtcttcagagggccaaagtatggacattcccaaaggatggctttataataaaccctgacccaggacagagcaaggatggccggttgttaacactaagcaggaagggaccatcctatcaaaagacaaaagagccagggggccggactccctatgccctttggaccagacgtcgagaatccagcaacaccggccaacgcggatccattggcaccagaaccgggtggcctcacaagggaatcggatagcgcaacacagcacggggacagcggtttacaggaacattacagggctaatagcgcgacattgcgtgggagcacaaccccgcagttggaacgcccgtcagaactgctaaacgtgcggaacacgatgcgggaacacacacgagggtaccgcaa

SEQ ID NO: 677082 - DNA, 179 bp, Homo sapiens
tatgcactactggacaatgtggaccccaacccgcgcacttcgtggggcgggatcatctggactaaagccctgcaggttggctgtctgcttcgctggagccaatgcccggcccagatgttaccggctgaccctgcgcaccagcaaggagcccgtctccgtcacctgtgtgagctgctggc

SEQ ID NO: 677083 - DNA, 286 bp, Homo sapiens
  misc_feature (273)..(273): n is a, c, g, or t
  misc_feature (285)..(285): n is a, c, g, or t
gttcaagaccaccctgggcaacatggcaagaccctctgtttataaaaaacaaacaagtcaggtgtggtgtctcacgcctgtaatcccaacactttgggaggctgaggcgggcggatcacttgagtccaggagtgtaagaccagcctgggcaacatagtgagacctcatcgtacaaaagacttaaaaattagcaaggcattagtgggaacctgcctattagcctcagctacttcagggaggctgaggtggggaggatcactttgagcccagggntttcaagggttnc

SEQ ID NO: 677084 - DNA, 168 bp, Homo sapiens
catgattgatccaccgttcgctataatcctcctatcacattaaataacaagtggttaaaaggtgaacattaaggcctcacttactaggtgaaacaaagaacagaagaatctaagctactctagcaggtgtttgttttctactgtagaaacagcctagctggactgggt

SEQ ID NO: 677085 - DNA, 403 bp, Homo sapiens
acccccggttttttccctttttttccattggcctttgtttcctaaaatttttttgttaattttttccccttttttttccccccctttttggttccggattcttttggggaactttgggaaattttggatttcccattttttttttttggaattaagcttttagttccactttccaaatggcctgggtttttttttaccccctttttaaggccaatttccccccattttccagggtttttgtccccccctccttccccccagtttttttctcttttaggtacccccttctttttttttcccccgtttttttccccccaattttctttttttttagccccttttttccccttgttttccaaatttttccgtttgggggaatttaagttgtccgttcccttttcca

SEQ ID NO: 677086 - DNA, 335 bp, Homo sapiens
tggcgatagcactacaatgtgcaatagtgggcttctggaaaaatgcagaaattgtctggatggtcagcattgtctggaagatagctaatcctgcctgtacttagtgcatggtataaatggagagagatcgcctctcctcttggtcatgattattagtgttctcagtatctctactccctgctacccgctttctctgcagacttgattgacactgtgcatatatccctttagtgaagatgtggggggtgcagctaagagatgcctattttgggacagcattcctctcgtctctgcttgctgtagacatctccctactccttgctatgtaccgcttg

SEQ ID NO: 677087 - DNA, 160 bp, Homo sapiens
tatcttgatctcttatgacgaccgaaattaccaaaatcctctttggatatgacttgttaatggatcgcaaatagatgtgtcataaatttcatcgacagtaaacagataagaaaagaaaaaacgacaggcaaacatagttggtagtttaaattataggaga

SEQ ID NO: 677088 - DNA, 482 bp, Homo sapiens
  misc_feature (57)..(58): n is a, c, g, or t
  misc_feature (88)..(89): n is a, c, g, or t
gacccccacacgcatagatattaccgctcttgtacctccacccagccccggaatgtnngctgctaggcctgtaccagcattccccagnnatggactcaggagggccaggcttacctgggaccacttctgaaagttgcaccagccccagcttccctgaggacaaggctgagtcacgaagcatggacgaggctgagctgcagtctgcacaggtggagttaaacaggccatagccaactcgcccctcacccagggtctgcacagacctcacctgcagccaaattacatttgagcacacagtaaaaggatggaaactgatgatcctcctgctccctcccttccatttctttgctctcagtttagtcactgttttttgtttgtttgtttgattgtttgtttgtttttgagacaatgtcttcttgctctgtcacccaggctggagggcagtggtgcaatctcagcccgggcgacagagcaagactccg

SEQ ID NO: 677089 - DNA, 222 bp, Homo sapiens
  misc_feature (1)..(1): n is a, c, g, or t
  misc_feature (30)..(30): n is a, c, g, or t
ntcgttggtatcccccccgagcgtcttggnacaacgaatccctcgggaattcatctaaagatttatccaatccacattggtaaagacactggttgaagagctagatcaacgtggtaaagttctttcatcaaggattcactccatgaagaaaagacatcttaagtgaccatcggcaagacagaacaaagggtccctttctagctgtcatttagagaaaagaat

SEQ ID NO: 677090 - DNA, 502 bp, Homo sapiens
  misc_feature (207)..(207): n is a, c, g, or t
gggccataaacgtcgaagccaggtcttgagcgtcagacagaatgaggtgtcccagagcggcggaggagagccagacgcacgctggttccggtctggacggaatcgccgcggacacggcagaggctagggcggaatggctacggcagcgcagttcgccaaggctcgctccggtgtcggcgtggtaggcgcgactcccccgggacgcantagtgctaacgggggtttacgtactgccgagcgcggcaacggagacgtgaagcccgtggtgtccagcacgcctttggtggacttcttgatgcagctggaagattacacgcctacgatcccagatgcagtgactggttactacctgaaccgggctggctttgaggcctcagacgcacgcatgattcggctcatctccttagctggccagaaattcatctcagatattgccaatgatgccctgcagaagtgcaaaatgaggggcaaagctccggaggctgccggggcaagagcaagg

SEQ ID NO: 677091 - DNA, 227 bp, Homo sapiens
ccatgtcccccgtcctgttctcttcccactgcctcctcttccaagaacgtttttctgatcttcttgtccttcttccctttcttcaccactttgctctgatgggctcgtgctctctccgtccccgtatccactcgggctcccggcggctgcctgcttgcggcgccttcggccatcgcgcgtggcagttaacagcgttaccgtttccggggcatcctcatagagtcgac

SEQ ID NO: 677092 - DNA, 293 bp, Homo sapiens
  misc_feature (57)..(57): n is a, c, g, or t
ccgtttttaaaaaaaattttaaagggcttttgtttttttcccttggggccccccctnttagcccctttttttttaaacaggggaagaattttttttaccccttaagccttcaaaaaagcccgggccaaagtttccaaaggtttttggccaaaaggttttggtctcccccccaaatggtgtttgggccccaaaaaaaaatttttgttttgcctttggccttggcttaagaccaaaatggttttaaaaccaaacccctttttttttttttttgaaagttttttcccccaacccca

SEQ ID NO: 677093 - DNA, 301 bp, Homo sapiens
gtgcagtacgagctgtgggcgcgctgctggcgctcggggtcgcctggctgctgcttcgtggcggcggccgtggccctgcgctggtccgggcgccggacggcgcggggcgcggtggtccgggcgcgacagaaggccagcgagctgtggccttgggacgaacatgtgacagggcggcgcagcgcttcctggctccatgaaaaccccaagaacctgtgaccttcagaagggcgcttgcttatgcccttgtccccttgccctcaagctgggttgccacgaacgcttaccaccatggtacggaacg

SEQ ID NO: 677094 - DNA, 283 bp, Homo sapiens
tagagacagggtttcatgttgcccaggctggtctcaaactcatgggctcaagcaatcctcctgcctcaccctcccaaagtgctgggatgacaggtgtgagctgccacactcggcctttcttttctttttatgagacagagtctcactctgtcacctaagctggaaagctgtggcacaatcacagctcactgcaacctcaacactcctgggctcaagcaatcctcccacctcaacctcccaaggagaaaaagcaatgaactttaatggcacgtaccaaatatca

SEQ ID NO: 677095 - DNA, 932 bp, Homo sapiens
  misc_feature (932)..(932): n is a, c, g, or t
tctttctttctcccctcccccccttaaccattcccctgggaggggcttcccgcgggaggggagagcgggtcaccgaggaacaatacagaggaatgcagaatactataaaggagagcagagggaaacggccgaacacacagccaggacaaaatagacaaagaataagaggacaaacaaaaagaggaagcaaacaggagaaacaaaacaaggaaagctaagacaagtgacgaggaggcagcgcgcagacaggaaaaacaggaagcagagaaaataaaacaaagaagacataagacgaacaagagaaacatacataaagcagaggcaaaacaacagaacgacgaaagacgaaaagaaaccgcaatgaacaaaagaggcgacacagcgacatcggaaagcaacagcacaaccagtgagacgaacagccatagacagagaaagagcaaagagagcagacaaaggaagaggcacaaaaagcacagagcgaaacaggaacaacagaagaagcaggagacacaaagagcaaccacagacagaaaaatgaggaagagcaggaagaccaccaacaaacgatagagacataggtagaagagagcacgaagaagaggacaaaaagaagaaacgagacgaaccaaagcaagaagagagaacaaaagaacgagacacaacagaaaagcaacaagaacgaaagagaagcagaagaaagcaagaaaaaaataagcaaaagagacaagagagacaaataacaggacaagagagagaaagatagcgacgagccgaacagacacaacaagaaaaacaagacaaagaacggagagaaagaagaacaaagcacaaagcagaggagacacgaaacaaagtgaacacacagaagagacaaacgaaaggacaaacaccgagaaagagatacagataaagtacagcacgagggaggn

SEQ ID NO: 677096 - DNA, 102 bp, Homo sapiens
aattttttttttttccccaaaagggggggggggggggggggggggcccttgggccccccctttttttttggggtttggggaaaaattgggggtttcccccca

SEQ ID NO: 677097 - DNA, 120 bp, Homo sapiens
tatccaagaataacaataaatgatggaaatcagcccttaggaagcccagacgttggacttagcagacaaaaactttttaaaaactctcatagatcatgaagtacctcttcaaggagaact

SEQ ID NO: 677098 - DNA, 590 bp, Homo sapiens
gctccctagcgggagatccccccagtggcacaagccaagggctaacccagtgccttgaattatgtttcagaacctgtgcccccccctcccccaccccgaagccaatacttgtcagcaaaggggaattatgaaagcggccccccttttccaaacacagaaggggggtatttttttcccctttaccccccgcccccctttccctggaaggactcctcctgagggggggcccccctcctttgactgccccccacgtaaaaatgtaaatataaatttggtttaattttggagggggggagggggcttttaaaaaaggattgggccgcccctggcccgtttaaattttaaaatggggtagggaatcctggggatttttggccaaaaaaaaaggatttttttatttttttttaaaccccccgatttgcggcttgggccctaaaagtttgtataaaaaaaatttggcctaaaagttttttttttgccaactaaaaacccaaagcctccctttaaccccgtgaagcccctgggtccaaaggaacccggaataataaaggcctccctgccccaaaaaatttggggtttttttatcccca

SEQ ID NO: 677099 - DNA, 916 bp, Homo sapiens
ggtacggacccactgtggattcctaagttgtggatggttgatatcagtgatctcagtgcctgtataaccctcacctgtataatgactgatctacgtagtaatccttgcctcaggttgagtagtgagctgctgtgaacttcagtgaaaagctactggtacaacttgtctgttacttgtacaattcgtgtgctagtgttggtgatgcacatggagtacgcgggcgcgggtcttgttgtagtgcgcacgtcgagttcttagtctgagtaaccggctctgttgcgcgaaccattgaatgttgatctttagtctgttcacctgtcctgtgcctacgggccagtggaactgttacttctttgggatcctgatccatggactgtggcgcccacctccctgaggagatcaggtgtggccccgggaggttcctgtcgtgggtcctgctcctttccgcttccctacgtgttctcttggtctcatgatgttggtcgcccttgaggttcgcgcctggtgtggagctacgctgcagactctcgtgtatatgaccttcgggatgagtgagggagtgcgggtcttatccgttcctaggtctgcgggtgagacggtgggagttatgtgctgatggcttgggtctatccgtgtatagtcctattcagatgggaccccatgatctcttggtccggtagagagcgtctgctcctggagctatgggctgggaaggagctgatcgtccgagtggctcttgccttcctgtgtctcgtcctgaactgtcggggcgcagttagtgggcacccctggtactgtcttgcgcgcacggcggtggctggtttggtggtagcctgatgtttggtcttccccctggtcaacttctcggtgctttggttccagggacggcttttcggaagggcccttgcggccggag

SEQ ID NO: 677100 - DNA, 393 bp, Homo sapiens
cctccatggttgcggggcagaagcattagatagcgggtacattaatacttggagggataatgtttgtcagaaatgtagaggtgagattccaatgtgtttaccataggtctgccttggaaacactcataggctgagcacagtggctcatttctgtaatcccagcactgtgggaggctgaggcaggcagatcgcttaagctcaggagcttgagatcaaccagggcagtaaggtgaaaccctgtctctacaaataatacaaaaacaaaaattagctgggcatggtggtgtgcacctgtagtcccaactactcaggaggctgagttgggaagatggcttgagcctgggaggtcaatgctgcagttggctgtgattaagatactgcactccagccggg

SEQ ID NO: 677101 - DNA, 390 bp, Homo sapiens
cgacagggcatcttcaatccatcttgagttgatatctcgtatatagtgtaaggaatgggtccagctttccatctactgcatagtgctagccacttatcctagcaccagttaatgaaatgggagtctttaccccattgcttgctttggtcagctattgtcagaaagatcagctggtcctaggtgtgcaaccttattactgggtgcactattctgttccatagattaacattattctgaaacagaatgtgcctttattagtaccagttacatgctgtattggttactgtagccctgtagtatagtctgaagtagtatactgtgatgcctccagctatgtccaggccgcttaggattgccctatgctattcaggctctatttgggtacccgta

SEQ ID NO: 677102 - DNA, 104 bp, Homo sapiens
aacatcatcaataggtaaactaacctgtatagtacttaaaaatacaaaaattaccaggtcttgttggcacaagcctgtaatctcagatactcgggaggcagaag

SEQ ID NO: 677103 - DNA, 1029 bp, Homo sapiens
ggcagttcggcggtcccgcgggtctgtcgtcttgtcgttcagacagtgttgggacggacacagatccggggactctacttccagccctccgaccgccctccggatttgcctctccgcttgcaagcctccgtggcaccagtcttctcggccatctcctgcttctgggacctgcccagcagccgtgcttgtggttagcgtccttcttgccaacacaatccatgagctcccagtattcgtcacgaattattccactcgacgtggaggcagccgtcatagcagcctggttcaagtttgtacctgcaggcctcctacacctacctctctctgggctctctattccgaccgcgatgatgtgcgctctggaaggcgtgagccaattctatccgctgaatctggccgatggaagaagctgcgagggctaccgagacgtcctccttgaacccattgtcgagaacacagcgttgacgtgccgggccttctctttccatggacattccataaagcccagactggaacgaatgagtggcgtgtaaaagtccccgagacgcccattgaaaatgcttgcccattggcccctggcaagaagatacagcctagaaaccaagggcccctattgggcgattcttgcaatggccccatggggttatctggccggcacggaaccccccattctctggtgacctttgcctgggagtaatccacgttatgcataagtactggagggcaagtggaatggcttttgttccagtgaacccatgggtgcgaacccaccgtgaacccaatggcctcccaactagggccttggggtttgtgccccgtgaacgggcttgggctattacgcagcagagttaattactctaaccaaacaagggcgtccaatacctaatcggccagcgcttaagaaagcctcttgtcaggaccaccaggctgagcttctcatttgggggcccttctgcaatacgaacatagggtatatcgctctaggcctcttccttacaggcatacgggacgcttgtttacagatagccc

SEQ ID NO: 677104 - DNA, 315 bp, Homo sapiens
atctgttcaggttcattctcatgactatcaagacgtacctactccaagctcttactgccttacagtaaaatcgtgacattagctcccaagctcacattgcacaatctgtgtccaagctcccatttgtgagacacaggttgtggtatatactgatcgtggatattttagttcctttcataaaaacacaaaattaaaggcttggttctcagcagagggttctaaatactctaccattctttttttccttgagacagagtctcgctctgtcgttcaggctggagtgcggtggtgcgatctcggctgatcacagctaga

SEQ ID NO: 677105 - DNA, 300 bp, Homo sapiens
cacgaggattttcatcgatgggcatgtagttgctcgcaagtctaacattacagaccatctgctcaagcaatgcggtcgcagtgacaggccaatcacatcatctctttaaaaaagacgctgctctcactgtaactgcatctttcaagtctgccaggttctgacatagacttatattacagtgcaaacgttatcgcaacactttgatctcattattacagtttggaactctgaggtcataggtccatagtaatcatccccccagacacaaacactttaccatcaatcttccccctgggacat

SEQ ID NO: 677106 - DNA, 162 bp, Homo sapiens
cttgcggttctcatatccgccatgcatggtgatatggcccaaaaggaacgagactgtgattatgagggagtttctgtgctgggctctagcagagtttatgattaccactgacctgcttggccagaggcattgatgtgcagcaggtttctttagttcatcaac

SEQ ID NO: 677107 - DNA, 127 bp, Homo sapiens
accgaggattaggtgtaccctatagatctaacatagtacttggcatataatagatgctcaataactattctactattgggtcccaagcatgttgtgtatcacgaagttaaacatagcaacgggttat

SEQ ID NO: 677108 - DNA, 107 bp, Homo sapiens
tgggacatagagtaggcctcttagaaagtgtaggcaggtaggacactacaggacggaggtactggtacctattgacagcgtggagacctaggagtaggataggagta

SEQ ID NO: 677109 - DNA, 655 bp, Homo sapiens
gggttcaaagcttgaacactctagtctacggaagaatttcgtcctgtgggttgggaatcttggattgttccgcccgtttatgaagctgtactggctgtcgaccaacagacacctgaccgcaaactatctttatctgtgtattcccatatttctagacaatgattatcggtaagacaataaatttatccaaaacaaacaaaaaaaaaaaaacaaaaaaaacttgacggggcacggccagcgcggaccagagaggagaagagctttcagaagaacccattgcgggaggcgaggaggccgcggggacacagagaaagagacacggcgaaaaacggtggccaaaaagcgtgagacccaagggagaaccgcggggcaacaggaggcaacaaggggcgcaagcgagacgaatcctcccaacaaaataataaaaaaacagcgcgcccgggggggagagcaaacaccagagaagagcgtatttcagagacaaacagaaatcgctaccgcaacatgggacgagtaccaccgagaaggggcgaaaactaacaacgatgggcacaccccttatcacaaagagaggagcagctcaccaaaagtgacagaagccccacaaaaaaccatcaaaaaatttttcacgccccccagacaccggggtggcagg

SEQ ID NO: 677110 - DNA, 660 bp, Homo sapiens
agcgtgaggaacgcggacggcggaggtttgatagggctgatactgggacctgccgcggatgagtggatgtgagcggcggcacgcgtgcgtggctactcgccggtcccgcggttgctaacttgttgctccgttgattgagcgagacgggtggttgagtagcactctggtcgtgcttacccgcgatgacctgctcgggcgagacgccaaaagaggcagggggtcgcgcgtgaagcggaggacaggacggcggtctcggagccgacggcctgatggcgaacccaatcaatggctcagaccacgataacccaggatagtatgccgacggaggctgtcggaaaatgctgaaggagttgtgccaaaggcgccattagggtgcaggccgcaggaactcatccagtggggagccgattattgtggaggccctgtcccgtggagagacagcctctcggtgagagatgcggtctgagcgagatgtctttgtgtaaccgggcagagctaacgaccatgatgcttgtaaagaggatccatgcagttctcagtgttgctggcatgacgtgagtcatccgtgcagaggagctggcgccagatgtggaaagtgtgtgaatctcccaaggagatctgttaatagtgtgatgaatgtgggtcgattaacggaggaga

SEQ ID NO: 677111 - DNA, 88 bp, Homo sapiens
ttgatgacaaagcctttcaaattggggcagtgagattgaaagagttgatagccttcgagtttgaggagaaagaatttaaaggcaatgg

SEQ ID NO: 677112 - DNA, 192 bp, Homo sapiens
cctgtaatcccaaagtgctgggattacaggcctgatccaccatgccggctataaattactttttatgattaaaaaagtcagtgactgggcatggtggctcatgcctgtaatcccagcactttgggaggctgagtcaggaggatcacttgagcccaggagttcaagagcagcctggcaatgccatctctgttt

SEQ ID NO: 677113 - DNA, 554 bp, Homo sapiens
gcacaagcctgttgaaccaagaagtccgttagccagaatatgtggtagtcactctgaatgatgttattgaaactgcacccatctctccaggcacaagcactcaactaactgaactgatagctcttccaagagccctcaaattaagcaagggaaaagtaactaacattggccctgcctccaagtatgctttcttagtccttcatgctcatgctgccatctggaaggaaaggcacttctttacagctaatgggctctctataaaataccatcaggggccgggcgcggtggctcacgcctgtaatcctagcactttgggaggccaaggcgggcggatcccaaggtcaggggatcgagaccccggtgaaaccccgtctctactaaaaatacaaaaaattagccgggcgcagtggcgggcgcctgtagtcccagctactcgggaggctaaggcaggagaatggcgtgaacccggaaggcggagcttgcagtgagtggagatcgcgccccagcactcccgcctgggcgacaaaacaagactccgtctcccaaaaaaaaaa

SEQ ID NO: 677114 - DNA, 415 bp, Homo sapiens
taattcgggtagtgtagcagtgacactggcacatgtaattgggatgatcagtctagcaacctaaatagatgggggagtttagatcgatccatgaggctatataaagaaatggagactgattattcaacaaattctggctgggtgtggtggctcacacctgtaatctccgcactttgagaggccaaggtgggcagatcgcttcagcccagagttcaagaccagcctgggcaacaaagcaagactccatctctacaacacttaaaaactgggccgggcgcggtggctgaagcccgtaatcccatcactttgggacgccgatgcgggcggatcaccacgtcctgagattgagaccctcccggctaacacagtgaaaccccatctctactaaaaatacaaaaaattacccgggcgtggt

SEQ ID NO: 677115 - DNA, 227 bp, Homo sapiens
ctacaatgctgtggagacataggaatgctttacactgttggtgggaacgtaagttagttcaacccactgtgggaagacagagtggcaattcctcaaggatctagaacccagaaatatcatttgacccagcagtcctattactgggtatataccccaaggaatataaatcactatctctattgagacatatgcgtgtgtatatttattggcgtactcatatgcaagac

SEQ ID NO: 677116 - DNA, 1758 bp, Homo sapiens
ctgggccactgtgcctggcatcggagaagaactggagcaccgactctcaacatccaggagatcatgacccgtgcccccggcgatcgcgttctcgctggtcatagttgtcgtcgcgcttgtgccgtgaaaggccgccgttcttcgggctgctgggctacagctctgtactggatgggcctgccggaccggtgagccgtggtcctgtcgctgtccgccgcgcacgtacgtgccttgtcgtgaggcgctgcacccgcagcgcgcccgtgctgcataggtacgcgcagacatgcttgctcccgtccccgtcgtcgcggctctctctgtagggtaggccagggtggccccgcgcgtcggcctactctagtggggggtcgctccacgggtgcatgtcccctatgcccctggcacccgagagcctcccacgtgtcaaccgctcctccactgtcgcagcgctctctcgtcctccagcgcctgtcgtgccttgaccagtcgctgtgaggaccaaggggcaacgacctcgtctcggcgttgcgctacggaccgaccgtttcgatatccccgcgatctcccgaagaaatgggttggggaacccgaaagcaatcgccacccgtcgcgccatgggcgcaaaccgaaggtggccgatcggttggcactttgggcgaacgggtgggctaagggtgcgcaagggtggccgggactggccccatcagttggataatactaaggtggcgaacttgccatacaaggcttgcaacgcgaaaagggccttttcccccattggaaggggcgtgtttaacccatcagccgactgagtttccatgaggggtgtatgggggggctacatagggatatagtaggggcgccttttttcaagagcacccaaaattacaaggcccacagcacccattcaggtccaaacgtgtcccattgggaggttgcacggcaacggggcttgaccccctttggtggtcaccttaccgaaggcgcgacctttaagccaaatcacaagcgccttacacagccgcacagagcgatccaagggttgtgcgcttctccgggatggcccccttcccgaaatgttagtcgaaccgggggtggccaccccacattgatttgatcgcaccacaaaatcgcacactataggaagtcgtgggatgctacggcacacacaagcttcggcgcctatttgtcatctttctacacttatcgacgacccgataaataacagagccatgataaacgatattctatcaggtactgaatttatgggatcctatgtagaaacgacgcagaaacatatagatggaccccacatgtgggggctcagataccagcaatagcatatcggtgtcaaatttcgcccattcgaacatgcgcgagcccaagggacggaacccaatcagagcgatatggtgacgagtctagcaccaaagagatcgatgatatagcgatatagttatctccaccaatattaggaatagtagaagacccaatacctatggcctccagcttagatcaacttagtagtgaagcacggagcaacctcggtagtaccaatacttctagcccgcatcatattagacaaacggacataagaccgagccatcagctagcgcgtgctagagctaattaataagctatgctaggcgacagaacacaatatacattagaccaacacagcagggagcagcttgtactactaagctcatgcacagcttacactctaatccacgaagccaaccgatgtaaacaccacat

SEQ ID NO: 677117 - DNA, 416 bp, Homo sapiens
cccttcccccaaagtgattgatattccccacccctgtttcaagtgttctcattgttcaattcacacctatgagtgagaacatgtggcatatggttttctgtccttgtgacagtttgctcagaatgatggtttctagcttcatccatgtccctacaaaggacatgaactcatcctttttatggctggatagtattccatggtgtatatgtgccacattttcttaatccagtctaacactgatggacatttgcgttggttccaagtctttactgtcgtgaataatgctgcagtaaacatacatatgcatgtgtctttagagcagcatgatttataatccttctcgtatatacccagtaatgggatgactgggtcaaatggtatttctagttccagatccttgagccattgccacactg

SEQ ID NO: 677118 - DNA, 915 bp, Homo sapiens
accgcgtggtgcgggcaatgtcgggtccgttcgggtaaacgctttcccccttcgtgttaccggcgcgcccgagtttcgtttactacttccctatggccgctttctcttctctccgtacaagtcttggtcgtccgattcttctgttgtggcggtaacctggccgccctatatttctggttggtgccagcaccacttattcagagtcttcttccttgtcgcggtgtcctccgggacacatttgtcctcgggtattttggcccctctcttccccccggcggggttgctaaagaatggtctcccccctctacttgaggtcgcctccgcgcacatactcccccacttgggaaacgttcctcgaccctccccggctgcttcccttgaggccacccacagcgggtctccccaggccgccctcaccccccgggaggcggtcccaccgtgcctagtacaccagaaactgcgggggaaaacatctctcccccacatggtgttgtcatgacgccccccccgtcgttctcatttcggatatcatgtggtactactcacaagatctactgttgtggtgggtgcagcacaaaaccacacggcgttatggcacgcggaattaagttgaattcccccgcgctttattcactaatacataattggccccccaaacatgagttctgccataaccactatgcccctttattaacaataacaatagtactcttcttcgcttacatccagcctaagttttgtcccccaaccccactatttttataaaacatctactgcggcgctcccccaaatgaacacaaaatatctatgtgccaccaaaacgcccaacggaataaatgcgcttcgcctccatatatctttctatgtgcccattgggattttccccaaacacaaaatcactccccacccacaaac

SEQ ID NO: 677119 - DNA, 901 bp, Homo sapiens
gctgtgtacagctgctcctgtgacctgagctcgggtgtatggggccgtaggaacctggatccggtggccccgataacggaacgcccccacagcagcccgtggatggatgtgagtggtctcccttgatcttgagaatggcatacctactcgatatgagccagtggctagaacattgcgtgtcggtgcctatgaggacagtgtacaatggcccgtgatccccacagatggccacattcgtgtgccctcaagagtgtgagagtccccaatggaggaggaggtggaggaggacatacacacaatcagcacagattcgtgagagctggcttcactgagagcgaactggcagagaataatgaagcatcacacaagtgatatgaccggcgtgactggacgtctgtgcacacattaccagatactgaccgagagagatcaacggataaccctggctgtctctcgaccgcacactgtacagaccagcgaccctaaacgcgcacatcactctgcgcacaatgggaaccccccaaactaggctttgcccataccagaccaacccagacacaacggatccttagatcgctgcccaagaaaccttaacagagggcactacagcattctgcatctacgatagccacatttgaccagtccggtttccaccaccggatgcatccttagaaggaccccagcagagaaacaactacctcggcgtgacccaaacgacgggacagggacaaacaaggacacacagcgctatggccattgaaacgactcggacactgagaccacgcacactcacttaacgccgcgtcacgacgaattgggcacacgtatacaacccgagagggatcgtaaacgccatattgagatacacagaagactacccgaaagcatacttacaggcaac

SEQ ID NO: 677120 - DNA, 543 bp, Homo sapiens
  misc_feature (15)..(15): n is a, c, g, or t
agttaaaagttaaanattgttcactctgagctgtgggctgggctctcagatctgcacggcagaattctcccttaaatattaggaacttcttcctgcttacaaatccccactgacacctttgggaactctctgtgcaggatggttcagaatccatcacccagactgctccctaagtgcaaagaggagggctgggtgatgtggcattcactgccctcttgtctctctgattcagaaactcatagcgacaaaagataacagcaccaagcaatgaaactaacattagtcaaatgtgggtgggaggcagctattgctttggataccaaattaagtggcttatcttcttgcacgacacacattttaccctcatagcattaaaacggagttttaaacatgcacggtggattttctcccaagcactgtgtcatcagtatgatgaatattacttagtgaggggcacacatctaagtcactttttgtattgttttgttttgttttgttttgttttggagacaaggtctcaaaaaaaaaaaagttggcggccgc

SEQ ID NO: 677121 - DNA, 553 bp, Homo sapiens
atgtgggagaaaggaaatacccattccaacccactgtagtatcctgtcccaccaaaggagaggaaaaaaactgaaaagcgcttgtgaagttaacagttcagaagcacaggctcactaaaagactaagaacctaatcataggactgcaaaacactttccctctcccacatcttaataccaaattactaaagacctatttaccataattccttttttacccaggtacatcatgtccagctatcaagaaaaaaaattacaaggcatcctaaaaggcaaaagcagtttgaagagaccaagtaaaactaagagagtaagcaccaaaaccagactcagatatggtggggatactggacttaccatatgaagagattaaagcaactatgactaatacactaagggctctaatggataaagtagatagcatgcaagaatagatgggcaatataagcagagagatggaaattcgaagagagaatcaaaaagaaatgctagcgataaaacaaatttaaaaacccacttgtacagaactgaagaatagtagactggacacagct

SEQ ID NO: 677122 - DNA, 508 bp, Homo sapiens
ggacctttcatgtcccccctaagtgcccggacccttccggagggggcctccccgcctgtgtatataagtttcccggtatttctctgctacagggagccttttccttttgggggtgtggtttttgttttgacctttcctgtcacctttacagggctgccgtccaatgtaggtggcgtgtatgagtgaaaccgggcctgggtctttgggaatggagggcaggggtccttttcccttggggtcccagggggttttgcctgtttacccaggcctttcttgggagcccctcgcccaaaaattcagtttggccaacttggggggttgtgtccccccagcccgcccttcttttgggttgcccagctcccctttttccctcctgccccggttagaaaaccgagtttgggggccctttttcccttcaggcccctgtcctttttaacaggtgcccttcaattgtattcccaccctcctgcccccgtctttttttaaagaaggaccctcgggcttgtta

SEQ ID NO: 677123 - DNA, 333 bp, Homo sapiens
ggattggggtgatgcagctatagcatatgcaggtcggatcacatatcggatatggacaactctagaacaagttatcacagaaactgcaaagaagatatcaactcctagctttacatcctactataaaggaggataagaacagaaaatgaataggcgagaagctggtcttattttaggtataagcccatctgttggcaaggctaagattagaacagctcataggagagtcatgattttgaatcacccaaataaaggtggatctccttacgtagcagacaaaataaatgaagcaccagacttgctaaaaacaaccaccaaacattgatgcttaag

SEQ ID NO: 677124 - DNA, 234 bp, Homo sapiens
ccagtacggatgtggcctcagtctctgttggaggctggcagttccaccatcaagtacaccacgcaactccatcctccagcaggaagagctattatcactgaaagtgcgtctagctagctctcgagtcccacagtcctctaggcccctctctgcgctgcaaagccctcttcctcaggtttgccttttcactctcctggtcctccagttctccccagtctgttcccaggttagatg

SEQ ID NO: 677125 - DNA, 437 bp, Homo sapiens
atagtaagtaggatagtactactcttactgagtgtgattccatgagatgagagcacaatggtacattaactggattctgcccagaagtcctaggaaatcgccactgttcatccgtaaaccctgcctcctaaatcactgaatctgtactctgtatatctattagacttatgtcatctcccgaaatgtcagatatccaatagtcagcgaataagggaaacttttatctactggaaaggaaaacaactcgatttagaacaatgtattcatgtgtatctaatactgaaatggagaaaagagttaatgttaaagaaaaaaaaaagacactatagacatggacatggaaaagagatgtaatgttaataaaaacctaatattacctgagtaacacctcctgatgagaagtgctatattaaatataaacccattatgtggtttaa

SEQ ID NO: 677126 - DNA, 343 bp, Homo sapiens
ggcgttgatgcgtgcgtgctgctctatgatggatcccttcgattgtggactcagagggttcgggaagctggcagtgaaccttcctcggtaagaggacaggagacgacacatgcaccataaatgggtcatgggacggaatgccatgaccagcactagttaacttcgaaaacaccttctgccaccgaggcaagagggaatcccctgcctctccaagggctggcgttctcctccatgagatgctgacgggataaaaggcagagcacatgtgtgcagagaccccatgacacagaaacacatcagctcgcttggggcagcagcctgtgcccagggagatggtgagaga

SEQ ID NO: 677127 - DNA, 184 bp, Homo sapiens
gacagagcaggaagaagcgtgcaattgcgcatcagcgtgcaagacaccggcataggcatgatccaaccaggatgtgagcgcccatgttccaggcattcagccaggccgacaactcgctgtcagcgccagccctggcggtaccaggtttgggcctggtgatttccaagcggttgatcgagcagat

SEQ ID NO: 677128 - DNA, 112 bp, Homo sapiens
tctccaccttcccatcagattagttagatatagagttttgacacacaggttctctttggccccaccagagcagttagtatacatgagttgtcgattggttcattacaccaac

SEQ ID NO: 677129 - DNA, 143 bp, Homo sapiens
tcgggaggtggacggttgctagtgcgccaagatctcttcactgtactccagccctgggcgagagagcaaggctcagtctccaaaaataggcaaacacacaatttgtgccggtacctttgatagggggcgtaaacagcttccgg

SEQ ID NO: 677130 - DNA, 189 bp, Homo sapiens
ggccgactctagaaggatccccaccagagaagagtacgagatactacaaggagaagagacgagactcattcactttacgggggaaggcgcttcgtgaagctagccgttatttctcttgtcctttcgtacagggaggactttgaagtagattgaataccgacctggattactccggtctgaactcatatc

SEQ ID NO: 677131 - DNA, 846 bp, Homo sapiens
  misc_feature (276)..(276): n is a, c, g, or t
  misc_feature (569)..(569): n is a, c, g, or t
ggagaattgcctgaacccaggaggcagaggttgcagtgagctaaggtcacgccagtggcatatgcctgggcgacagagcaagactctgtctcaaaaaaaaagaaaaaaaaaaaggaccaaaaacctttccctttttcttccggtttcccttacagaagacacaggaaaagcttttgggcctctagaatcctttggtcaagggtaaatcctaagggtgacaaggagtttgcggcaggaagaagggaggagccataagggaagagaagccagtttgtnggctttggggcatagaacagggacaaaattctaggcattgaaacgggtgtggataaatactggaaatttttttgttcttacccattctggaaacgtcagcttctggcatacggtggtttccagccggaggtagggcaaaggtgagatggagaaaatagccatcagctcaggaagggtctaagtaaagggatgggttggaacaaaacgaaaaagcacccaaacaacacaacacgacacaacaacaactgtgtgggccgcgacggaccacaaaagaagtctctacaacacccgcngggggggcgcgcacccacgaggatggcaacaggggccacagtgtcacagaaagaatcgggcgagatacagtgggtgtttccccccaaaaaaaggcgcggggaccgggggtgccggaacaaccaaggggtcgcggtaacggggttcgaccgcggccgctgcatctctgccggcgcgccggcgaccaccgaccaacacggggaagagaagagaagacgacgacacgacggcagagaagacacgaggaggtacgaacggggacacgaacagtggcaagaa

SEQ ID NO: 677132 - DNA, 433 bp, Homo sapiens
tagcacggtggtgcatgctgtagtcctagctactcgggagctgaggcaagaggatagcctgagcccaggggagttggggctgaagcctgggtgacagaggaagaccttgccttcaaaaaaacaaaaaaaagaaaagaaattctttatattacaaagaattcccatataccttccacagtttcccaaatgttaatattttcccacatttgctttatccttgtctcttgatattacatatgctggttatatttttctgaaccatttaggagaaatttgcatacatgatgactgtttcctcctaaatactccagttcttattttctaaaaataaggacattctcttacacaaccacagaacaattatcaaaagcttggaaactaacattgatacaatactttaatctacatacctcattcagatttcaccgtgctt

SEQ ID NO: 677133 - DNA, 679 bp, Homo sapiens
aataagcttcttaaaacagtcctttcttacacctgcccaggccagaccctcggtcttggcctttttcaggagctaggatatctgcgcctggtgaaaatgaaacgaattcctgatttaggaattcagtttttcctcctcactccagctaagcactcacttttttatttttttttttttattttgtggaaaacagagagagactccgcgccactgctgtgtgctcccccgcgggcgtggagaggtgccgggggagaggcaacatctctgcggcctcacgtgtgagaagactccccaccctctccgcgggtttcaagcagcagattttatctgtgtgcaccctacaagccctctcctgaaagaaatgatggaggatatctagcggagatatgtgccccaacaatggaccacacaaaataatatttattatatttttatttattgtgagaaaaaacaagagagatgatgggagcaacgtgtgagtcatcccccaggcggggaggagaaggagaagagaagagggggagtatatcaatgcgcgcagacaccagcgcgtgacacacgaacacacgacgaaatcacgagtggagtataacaaaccaacaaatttaatcacgcgaagacaaaaaaagaacacaccacggaaaaaaaaaacgagcgagaaaaataaaaagacacacgc

SEQ ID NO: 677134 - DNA, 858 bp, Homo sapiens
aacctttcagaccctctgtgtgggctgggctggtcagaatcaggtgtacctccccgacaccttctttttcagtgatgttttctcttctccctgcctttcctctgcctcctcccctgccagccctagcgtgactacccagagacaaaaaaaaaaaaaaaaaaaaagggggggtggggcccagggggcttcacggccgtgtaattcccaggcacttttggggaggcggccaacgggcggggcagatagactttgagggtcagggagttcgggagaccaggcctgggccaacatggggaaaaaccccattctctacttaaaaattacaaaaatttacccggggcattggggggcggggcacctgtaattcccacgctactgggagaggctgaggcagcaaagagccggtttaaaccccaggaggcagagatctggcaatggagtctgagaatcgtgcctatggcactcccagttggggcaccaagatgtgaactttctatctcaaaaaaccagaaacaaacaaaagggcagctggggttggtccactggtaggggcagcttttggagcctgccacattgggccgggtaaattttccccttcccagtcgggatttggtcggctctttctttccccctcaccccggtataccttctttcacctcccattctctttcacttgtgtaggctcagtctctcccacgcacctttaatgggcgggccgtggggggctcctcttaccacgctccttcagaacgccggtccatcaggccgggcctcagtggcccagccattttgttgttccccgtggatttgttcccccagaacggggcgacaaagatgggcttttcccccaggttccgg

SEQ ID NO: 677135 - DNA, 679 bp, Homo sapiens
ggactccattattaggtaaaatagtcatcaattacatgccatagtccgcagatgctaggtgatatattgatttcatttcagtccttcatgttaattgcatagttgactggagttataagatgtaaatattttgaagttggcttttggagaaggagaggggaactgtacaagggtgggagtgagggagggggttgggttatatgtagcctcaaggtgtctcaccaatgcgcgcatggcgaatgcagtagcgcatgaagatctcactgcggaaagaatgcgtggaccttacgggggggcaccagcggctctacccacgggttggcgagcctttcggcaatactgggggagaaacggggggtcaaaagaggatttgggcccgtcgggagacggaaagagtcccattatgcaggtggagagacactgccgagttcagaacgtgcaccaaggggcgaaggggattgaggctggagttggtccattggggaataggggctaatcaataaagaagtgtgtctgaatgctagcaaggtaatctcttttgggaaaagagttagggaaagcttcctatggggcacgccaaatagggaatgatccagagaagggaattgtaggtgagaaatatcaggtactaggaaggctgggggactggtcccattgtaatgggagatccaaaatacat

SEQ ID NO: 677136 - DNA, 814 bp, Homo sapiens
  misc_feature (655)..(655): n is a, c, g, or t
agctccgctgcaggtatatacccgagacatgaggcgtacgcccattgtgaggcgcgttgcagaaagctagcacggcccgtcgccatgagcgcctgctctatggttcctctcattatcaagtaatcttcgactaggcccttgtgtagagctcagcatgccttactcactagtggctatcagacgtaattcatcatcagcctagtcttgcggaaatcgaggatacgaattgtgtatgcgatctgttcatatcacaagaggaatagttggcccaaactatattccaggaaagcgctagtcacgttgcgctaacatatctttcactctgagtggacatgagaataattgtcaagttggattagcaagtccacgtttgcacacttccacttccatgccactataacgtactcatgaaaactgcgggttgataacagtcggtaggatccttataatcgacaccaggtgcgtcatgctcgaggcatgagaataggtgttgctagtttcctcgtgcaacagcttaactacggattttgactcggtcacggtaaagcttgccagcgttgccacgtgatcaagattgttgcagttacgagctgccacttggtaactccgtgtcagtctagcactgttatacagagaagaatggtgacagtacatnaggccttagttctattgatcttgacgtacgaagaggatgcatgctggagagtctatgtccccgtccttggtaaagcagcggagatatagcgtggtccttgtcgctgtaccttaaggtggaactgaatgaatacctggtcctatcagagtgttagttgct

SEQ ID NO: 677137 - DNA, 219 bp, Homo sapiens
  misc_feature (3)..(3): n is a, c, g, or t
  misc_feature (19)..(19): n is a, c, g, or t
  misc_feature (30)..(30): n is a, c, g, or t
  misc_feature (70)..(70): n is a, c, g, or t
canttcagccgtgggcgancagaatgagantccagtctcaaaaagaaacttgtatcatggctagcaaagnggaatttggttttatgctaaaataaaatcctagagccaggtgtggaggcgagtgcctataatcccagctactcagaggctgaggcaggaggatttgttgagaccaggagttcgagaccagcctgggcaacataataagacctcatctca

SEQ ID NO: 677138 - DNA, 626 bp, Homo sapiens
  misc_feature (610)..(610): n is a, c, g, or t
ttatcggtgtgtctattgtgtttgatgttcttatgtactcattttattcatgatccacattttaacgatactaacgcacggtctatttggtttcctgttgctggtattttgctgttagttataatgtcaatctgatcatggttggaaataacgccttatgtgaagcatataatgtactcatggtccaactcttcgcattgttccatgggcgtacctcatgcggaaatgaatttatcatgattattttcattggtaatatatgatgcctatagttatttgctttccattgtgatgtttagttcggaagtgggtatggcaattcagtctaatcggataaactaagatgtatatcattgggcttccctggagctcctaacacaaggattaaaaagaaggcccagctggggctatccggcaagcaagcccgagactgctacagatgaaggagcagaggttctgaccgagaggctgagcccagcacggggtctgggccacttcagggagccgcggattttatgttcagaaagtgatcctggtttctaggctcctgcatctgcagaactgcgatcagagcgtgggaggaggtgggggtgacttaaatcaggggtantaactcggggtacatt

SEQ ID NO: 677139 - DNA, 111 bp, Homo sapiens
gtgggttgggtcgtacttgcggacctcggcgaagaggaccccttttattttttttttctttccaaaatgggcagcctccagatcgcgcacaagtgtttatctctgttaccg

SEQ ID NO: 677140 - DNA, 434 bp, Homo sapiens
cccaatgcgagcagggagactatagaggatgccccggcacgagcacagcgctcgaattacaggcatgagccaccgtgcccggcccagcctaattctattctttcttctctttgcaggcttttttctttttatcgttttacaaccacgtgcgggctggattccatttcaaacctctgcatctcagttgaggtgacagaaagactgccttgtgttcactggaactctgtgccactatgagaggctgttctcaaaccccagcatggaataagctgcctccacaatttgctatacctctataaggttccctgttccttagtagcttctcactcttgcagacaaactttagtataaaggtgggcttcccctctgcaccatttagttcccaggcttaggaggtgggtcaagaaacactgctgccgttacatgagcatgtg

SEQ ID NO: 677141 - DNA, 435 bp, Homo sapiens
  misc_feature (5)..(5): n is a, c, g, or t
ccccncacgttcaagcaattctcctgcctcagcctcctgagtagctgggattacaggcgtgtgccatcacgcctggctagtttttgtatttttagtagagatggggtttctccatgttggccaggctggtcttgaactcctgatctcaggtgatccacctgccttggcctcccaaattgttgggattacaggcgtgagccactgtgcctggcctgtgaatattcttatccatacttgttcacatttgtatttatttagggtagatgcctagaagtggaatattaactcaagcaaagattacatgtatttttaattgttgcctagttgctgtgaggtctgtggaagacaatttataccctgacaagcaatgtattagaatatatttccccccaataaagatggcattatctaactttatctttccaagtttatgtt

SEQ ID NO: 677142 - DNA, 284 bp, Homo sapiens
gtagagattacctgtactcctgagccggactaacagttgctaacgataagcctacaccagtatctctcatcgcgttagcacatcactgtgacgcatgcatgtgttgcgtgcccacactcttaggcactgtgtcgacaccacgctcactcacgctacagagcccaactgtctgagtcgctagacgacactctcgatgctgacgttcgtcttcgcttcgtttatgtgtcgcgcgcctcactgcactctgctctagcacgctccgtctgtcgttccgcttatcgtcg

SEQ ID NO: 677143 - DNA, 478 bp, Homo sapiens
  misc_feature (395)..(395): n is a, c, g, or t
caacgatggtcctcagcttactgcaactccgcctcccgggttcaagcaatcctctgcctcagcctccagagtagctgggattacaggcacccaccaccatgcccggctagcttttttttttttttcccaaaaggggatgtttatttggtaataaaaaataataaggggaaggaaaatatgtacttggggggggtgccggctggggtgaccaagaccatgagagtgtccaagaaataaggggccaagtcaagaagctctcatagagattaattaagggggagaaatatgagaccattagtggtaaagaacaaatcaatacccggcagtgtgctttggggaaaaccaaataacttctccaatttccggagtacacagagggtaccggcctggaaatntaaaggtctagggaaagggggagatgatcaagagtgggggtggcctagtcacaccaaatgtgtatttattacatccggctcct

SEQ ID NO: 677144 - DNA, 315 bp, Homo sapiens
gttcgctctatgagatccccgggataacataacttggttccatcacgctgctcactgtcttcgtggtagaagaggtccatcgactcaagaacagccagtccaagattttcagccgtcccaatggctacaagatagatcatatgttgctgctgacaggaaccccattgcagaagtaatctgtaggagctcttccatctactgagcttcctgacccgagagagatttaacaacttgaggggactcctgcaggaggttgctgacatattcaaagaggtccagatcaagaaactgcatgagatgctggagccacacatg

SEQ ID NO: 677145 - DNA, 150 bp, Homo sapiens
tggtgttcttgaggatccccactgttgttcatacctgcactgttgttcataccaacccaagtcaatagaagccggcgtaaagagtgttttagatcacccccgatacagcgaccaggtatgaacaacagtgcaagtatgaacaacagtgca

SEQ ID NO: 677146 - DNA, 117 bp, Homo sapiens
tcttgaggatccccgtctgccacgaaaggcacgcttcttgaagcccactccatggatgctgcttgttgaatgttgaatcgtgatattcatcgtggttaccactatcctgggctgagc

SEQ ID NO: 677147 - DNA, 373 bp, Homo sapiens
gtattcacatcagagcaagagatgagtctgcagaagatcgcatttaccgtcacttggagcctgccctggcttccagctggaacttaaccggatgcgtaacttcgatctagaccgccgtgccctgtgccacccacaagatgcacctttacctgggtgctgccaagggctgaaggaaggcgtggaagtgatggaccataggtgcttcatccgcgccatcatcaggcactctgacctgatcacaaaggaagcctccttcgactacctgcagaacgtgcgtgagcggctgctcctggcggccatgcgcgagctcggaggcatgcgaaggaggctacctttgtgactcaggtcagagtgcctcatgatagcgcgtata

SEQ ID NO: 677148 - DNA, 225 bp, Homo sapiens
caccttcagtacgtctgctccgaccgtgtgtgtaacaccagctgtccttagcgatagtaacagtaggacctacctagagagccaagggtgcttgctggcagagtccctgtccccagcccggctatgcctggcctgtccttgccttgtgcagctgactatgccccctctagtcccctgcttccccaagttctgctgtgcggccttgaacatctcctccaggctccc

SEQ ID NO: 677149 - DNA, 838 bp, Homo sapiens
agcggacgagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaaggcggcgggaaaacttgccaagggggctccttggagcgtcctccccgggggaaggattccaaagctctgaaacgagcgaagaaggctttggagctaagaggtggttggccaaagaccttttctttctcaggccccttccaagttacgtcctgtaattccactggcgcagctccggggaacaaggtgcacggaacctgcaggccgcggaggttctccagacagaaccactctcggcatcgcttgtctttgtggcacattttacatttggttacatttagtaacaccttttcgaaaactgatcgtcatttctctcacctctcatcttggcgaacgggagatgactttttcgacactgaaatgggacttaattattcatacttcaagaccattatgaagcaccttcgttttggaaggactgtggactgattattgaatgacagggcttacttgaattatcctcttataacttagtgcacatacaagcgccttccattctttatccaagaggtaatcataggcttcgtggtattggccattcatggggattaatgacattaattgggagtagaaataaaaactgctgggaatgtccacagaaatgag

SEQ ID NO: 677150 - DNA, 412 bp, Homo sapiens
cagagtgtacacgtgattgagacgctgaccaagtactagacctcagtgccaaccgaagtgaacagcatcaacatcaaccagggacagaatcacgtttgcaggaagccccggaaggaatgcaccattgacttcacaaccggatcggagctgctcatcaccaaggaccaagaacgggcacctggctgtggtcgccaccacggctgaaattctaggtgataaaggcgcacactgaaccctacacaaagcccaatgctttgcttttctcctcctccccttcccagttaccaacgactcgaacttccagaccgggacccagggacaccccgaagcccacctgccatcctcccacctcctgcccatccctctcttgagggcgcagcaggggccaggagcctacccaggagtgggccag

SEQ ID NO: 677151 - DNA, 194 bp, Homo sapiens
agcagcaattcggcttgcagtgggtccagtgtcttcgcaatgtgtgattgggtggggggccatccatatagtcactccaggtttatggagggttcttctactattaggattatcgcttcgaagcgaaggctactcaaatcatgaaaataattaatattagtggtgttagagaaatgaatgagcctacagatgct

SEQ ID NO: 677152 - DNA, 470 bp, Homo sapiens
ggtcgactactactactaaattcgcggccgcgtcgactgcataacgaggaggacttaaggactgatgtttgaatctcactgggaaggagaaataaaacagacactgtgagtagatgggggtggcagaatggatttattgagaaagtggagagtgaacaaatagaaaaaggagggatcatattgggggggatggaaagagagacaactggaattgggggggggcattgccaggacaagctagcaaccgaatgtaggggaaattcccagggtgaccttagctaagactcctagcaatggcagatatggatcctgaactggccatctcctgtaaccaggcaagagcagacacatctgaagcaaagcagaacaatgaagatcaaaacaaagatgtggaaaaggaaatccagaagaaagagatcacctgggaagaaggtcgacgcggccgcgaatttagtagtagtaggcgccgc

SEQ ID NO: 677153 - DNA, 886 bp, Homo sapiens
ctcggtgagatccgccactatatgtggtcttcgcggcatattgggctcaatctcacgagatgtgtggtgtacagattctggtgctgtgttcctcggtgcctgctccgaaattgttgcgccactggagtttggtgccaccgggtttgtctcctcacagccgctttctgggccctctaatgggaccccccgcctcttttacgcggctttcccgagcccggtgtgaaccccccttttgccgcaccggtatagtccggtcttgccggccttcgaaccaaggtggctccccacggacatctaccgcaggtggtcagaaattggtgcaaccgccaggctgtttcatccaccccagattcgcgccctggagcggcaagcttgttatgcaaaaccaacagggggcgggccttttcccccgcaccagccaaggaacagtacccaccggcgggttattaatgaacagctgactcaacagatcgctctgtgtttgcatcgcacgacccagctacactccccgatattgttctgttcgccaagaatgttcatggcgcccctgcaacaacagagaggtctgctcggttataaggacgtagattatatgggcgccggctctggccccccctaggcgcaggagaactcagcccaaaacagcctggctttcatcacaaccccaagtagggggcccacacatgtgacccggaggtgtgggaaaatcacggggccacaacaccgtctcctcatgaggaatcgaagagaacggagggggctgaggaaaaaaacaagacgaccgcgggggtcagaaacagtttcccgacaaggggagattagacaaaccccttttctctgccaaaaaggggtccagtatccaacccaatatgccccccaacaaaca

SEQ ID NO: 677154 - DNA, 177 bp, Homo sapiens
  misc_feature (124)..(124): n is a, c, g, or t
ttcgagctcgccacccctaaaaataagttctacatttctttaatgatgttaggtcatagttagattcattatctgaaagataaaaaagaaagtaagtgaatatgttaaatagtttagacacagnggcccatagaaaaatggtcgtttttcacgtttttcgaaaattcgcgatttttg

SEQ ID NO: 677155 - DNA, 328 bp, Homo sapiens
ccggcaaacagcgtgcggtatttgctcaacccgggagggtgcgggacaggtccggtcgggaagctaggcgacgaagccgcgcgagcagaagtcccacacctcttcggcggtgatggggtgggtggtcgcgtcgtcgggaccgccgctggattgcgcgatgaacatgaccgtttgcatggtcatcgcggccacccgcttcgggttgatggtggcgcgcagcttgccggcctcgccggccgcctccatcagctccgtcagcaacgcgagcaagggcgcatgcgcgaccttgacctcagcggggtgtgtcaccagcaaacgcggtgcgaag

SEQ ID NO: 677156 - DNA, 841 bp, Homo sapiens
gacagggggaaatgtgcccatttcctgtcgcgatgctttaccacaatgtctgcccccattggcgccccttagaacagttttggacccccttcgagtcctttgctcctagctaactgttccgaaaatgctgtcccgcaaaaacactgttgttgctcttaggcagcgggcggtgttactacattttcactcgacgcaaggataaaattaaggtcctcctcgccgcccccaaatagttgacgagtcgcctagtactccgctctgcatacaagaccaaccctgcggtaaagtaaatgcgtgtactcccatgccattgttaaccaatcggggcccaacacacaagtgttgttcttgcgctatctattagtagcgcgctataataatccgcccatggagaagtaaaggctaggttcttgctacagagtgggcgcgaccaacatactcatgcttctgtgggccctacgcccctcgcccagaaattcaaccgattacactggaattagcccagtacgcaactgtctcgccctcgatgccagcccacccctttgtgactcccccactcacctgcatcagttgtatgacatcctcaggagggccccgcggctcgtcgtgcccatcatgagccccatggcttcctattgaaacaaatcgcgggtacttcccccccgcctcttcgtattgttccctgcttctaagctccatcgacatcgacttccgatgccccgacggctggcattcatattgttatgtgtcaagtggaaacacgcaggcccgcccttgacataaaaattaaaaaaaaaatcccaaaacaaaaccaaacacccaaaacccaacccccacaaaa

SEQ ID NO: 677157 - DNA, 994 bp, Homo sapiens
  misc_feature (994)..(994): n is a, c, g, or t
gagtgccctgagtgctgatgcagagagtgaggacagtaagactcaagaggctggagattgtcaaacttcagtatcccacttggctcttgattcttggtgaatccatccctggggctcctagagggtagatctgtttagatcatgaaactaagttcaccatccttttcctctgatccccggctgcttactaagtctaacccagagatatcacagtccggaggaatatttgagtgcaatgacatggcattgatttacagctgtggcatgctgctctgcaagtaaaattatatactagctctagagagagcctagaagttagacacaccagttgagtattgtaccgactattaaactgagagccactgaagtacggttggctctgacactgtttttgattccttcaagtacagtgttcaaaggacgcgggagatgtgtcctgtgcaaagtggcatgacctggcaggactgtgagtacaaggatgctgcataagcggtcacatggagaatgctctggctaactcgtggggatacaggagcatgttacgattatactccgaaggctacccagaactgcagattcagctccagccgggggcctgtggtgacagcccaagtacgatgtctcggtgttgtgatcctagttatagagtagaagccaggaactgggagccattttgtgacttgcagttatgtttttagcaacatcctcatcattctccctttaggctgatttgggtaaacgggccccagacggggtggcggggtttaactcagcaagtccaatcggtggggccccaattgttcccggagtttggtgtatccggcggagcctgatgggaccgcggagtaacaccactactgctacttcgaagtgttccccagcggtcccgacggtggacaccaccacattggccgacacaataacacactaggatgctccgagtacacagataacgcaggattcgcattaaatatagtgcacgacaatctgatgn

SEQ ID NO: 677158 - DNA, 817 bp, Homo sapiens
gcagacagatcacttgaggccaggagttgagaccagcctgagtgacacagtgaaaccactttcttaactaaaaatacaagaaaaaaaaaaaagctacacctaattttttggagactcaaaaagagtcctcaaaaagaaaaaaattaaagcagccttaaatacgggataaatatttgggtggtgggtatataatttttaatatataatggctttttatgtataattatttttatgtatggattcagtttccccatatttggttgaggattttaatatctgtgtccatgagagatactggattggtacttgcctgtgtgagggtcctgtgtccggatttgggaataatggttatgctgacctcggcctcccaatgtgctgaagattacaggcattgagccaaagcgcccaagccttctttatatatttgggataatagtgtgacttatcacaatgtgttgtcagatttgatcaggatgctttgactctgttcaatcaagttaggcagactgatttcatgacagtattggaaccttccttatccattgaccgtggatattctctccatctggtaggctactacctagagggcctgtcatcagagttaattagtttcccttatattagatcgtgtacataattggttaatccctaagttattcacactcgggcttctgttacatttaaataaatttcttcgattttcaatccaattggtcttgcggtattaggaaaccgtgctgttgtatttaactgtaggcggtaccggataacgggtaagccggacttgtatgttaaacccccaattcacagatgtggc

SEQ ID NO: 677159 - DNA, 102 bp, Homo sapiens
gtatatgcgtctcattttattgtgtgttcttaatgtgggttcgatgcaagggttttcttggtttggttttggtttatgttttggtttggagacagcatatca

SEQ ID NO: 677160 - DNA, 278 bp, Homo sapiens
atcagaggaacacatgcctgcccaccagcatttgttttcaatctataggtatttatcatgaataataattaagctgttatgaaactgagtcatgagatttcagacattttcactttgacattcatactctggcagagataccaaccctaaagacagacaatgctgttaagtatgacctgtgtattttaaacatacaaggaaaaatcgattttaatactgaaaaaaaatttggttattggatttatttcttgcaataaatatatggaatacccactaaa

SEQ ID NO: 677161 - DNA, 109 bp, Homo sapiens
ggctcggacctaggttatcttattaaaatagtcaaacaaaaaatatctgtacattataataccctgtgccggcaaaggtgcaatgaaatgtgcatttacttattttttg

SEQ ID NO: 677162 - DNA, 155 bp, Homo sapiens
ggctctatagaggatctatttgggaatgacaatgataagctgggcacagtggctatacctgtaatcccggcactttgggaggcgaaggcgggcggatcactttaggtcagagttcaagaccagcctggccaacttgcggaaccacttctctacgg

SEQ ID NO: 677163 - DNA, 272 bp, Homo sapiens
gaaacaaatttccaattaatttttatgtcagagtccccttaagtagtttcacttttgagcccccgaagtgacctatttaaaaattttcctgtgaggtgaaaaccaaaaaatcaagtttgggaaaagggggtattaacttatcgatttagctttaaaacaaacccagttgtatttccccacaagggttttttttaattttggggcaaagaattagttattttgttaggattccttggaaaattacatgtgaaaaaaactgggttaaaatgtga

SEQ ID NO: 677164 - DNA, 529 bp, Homo sapiens
ctataatcagccgtaccgtctgagcagctgggaacagggggtatcgcaaaatcatcgggaagggaaaggttgctttgttactcatgccctatgcctggtgtgattaacggcttgtacaagttacgtttcacttttaattcattgtgcttgaggctttaattaaatttgggggatcccgttcttagagcagctcgtactgactgaaggtgcatgcgcttgaatgatgtcacggcagttcgttgaacacacggcggatgttcgtcagtgtccacagcgcagtgtgaaatgagggtagcagtagtgacgcccatttccactggcagtgctagatcctcagaaactcatctcgaatgtagtacgttgtgccgggtcacgcgtgggtcctctccgaggctcgtgagttgcatcctcaggagtagtgcagcgagcgagatactggaaagtagtcctcaaatcttcgatatcccagctatggactttctcagcgagcagatcttgcgtgtagaggcacaggatcagagagatggtg

SEQ ID NO: 677165 - DNA, 575 bp, Homo sapiens
  misc_feature (57)..(57): n is a, c, g, or t
  misc_feature (143)..(143): n is a, c, g, or t
  misc_feature (185)..(185): n is a, c, g, or t
  misc_feature (400)..(400): n is a, c, g, or t
  misc_feature (422)..(422): n is a, c, g, or t
  misc_feature (442)..(442): n is a, c, g, or t
  misc_feature (450)..(451): n is a, c, g, or t
  misc_feature (470)..(470): n is a, c, g, or t
  misc_feature (472)..(472): n is a, c, g, or t
  misc_feature (474)..(474): n is a, c, g, or t
  misc_feature (487)..(487): n is a, c, g, or t
  misc_feature (508)..(508): n is a, c, g, or t
  misc_feature (518)..(518): n is a, c, g, or t
tataaggtaaataaataaaaaaaaacttttccatattttttaggaattattaggatntggaaataaaactgccctaatcaaggtaatcaataacattctacctttttaagttttaaaaaagaagtttcatatccacatgagangatttatattatgcatatacaaaagtattttgtatgtgagcntgctacaccaagaggctacagtgacatgtgtgacaatcatttccttgaaactctgctaaaatatgcatttgaccaaacaataggccttctgcagctaggacaagcaatcacatattatacagaatgcttagaaccaagattcagatcttaatgagacttattgaaaagttctctgccccataatgaggcacccctttaaaaatatggtctgagtngagacataaaaggtgtacattngggctgttgtggtaaaatanccaaaaanngaaaaattatggttcgtgngngnggtctattctttnaaaaaacatacatacaaacantcaaactatnaacacctttacacattcacaacatctgcactaatgcataaaacttcaaaacctagaa

SEQ ID NO: 677166 - DNA, 268 bp, Homo sapiens
ttcccccctttttgggccccgggattttttcccccccccctttaaccccggggccccgggggggtttccccttttgttcttttcccccccccaaggcccttatttaccctggggggggggcggggggggggggcccctttcccccctggaggtccgggggttttccccctcccctttttggggtttttttttttttttttaaaaaaggcttttttccccggtttttttttttttttttccccaaaatggggccctggcccccggggga

SEQ ID NO: 677167 - DNA, 522 bp, Homo sapiens
  misc_feature (155)..(155): n is a, c, g, or t
  misc_feature (180)..(180): n is a, c, g, or t
aggttgactatagtcaatggggccaatggagccaagtgtatggaaaccaccccagtatggccagtatatggcaaatgggtggcaagtccccccttttggagtatacgggcccccatggaatccacaaggttttggggtagatccatccccttttnctgcttggatgggtggatttggggntcaccctccccaaggacaagctcctccccctgtaatacctcctcctaaccaagccggatttggtttggcaagttccccaccccagtgagccggggctttaaaaaaaaattgttattcatgatagggttcgatttcctgtgccccttttaaaacattgaagttgcctccgggaaaatgaaaattttttttttaaaaattgaaatgtttgggccctttagcccaaatttgctttggtgaaggacccgttttttttagttttccctttttaagtttttgttcatgatggatttgaccctgttttttttttttggcccaaaacttaaataaggtcctttaagccca

SEQ ID NO: 677168 - DNA, 878 bp, Homo sapiens
gcttgcgagtggagtgtccgctgctgcccgggtctgcaccatgatcgtcccggcttgcatcgacatcagtgaagaagatgcaggctgctgacgcttcgatgcttatctgaaatctaaaggagctgaggatccaaaagagaactcggaagcgtgggcttcatggtggatgtcactccagattattgaacgcctgtgatggtgttgtctcgcaaggaggtatgatacccgatgttggccataagtgtcgatgaacaggtggtggtatccgctactcttgatcctggagccatacatagcaagaagctttgatggaaagcctatgtgaatagctgttccaaatttcggcgaaggtgaacgcccggctctgagactgcagttgttaatgcgaccctttgccacgggatggataagaatactcctgtagtgatacacggtgtatttgcagtcttattgacagtggcagcatcttgtggggtcattccgagtacatcccaaactgagctggatcaacgttaagaagagatggattctgagtggaatctcaccatctgtttaaaaaagctatagcctttaagagtactttagtgggggcactgtgccctcgtcgactgcagtgatgcggcttcacaggccagtgtgtggcctgctctgtaatttgacccggcggtcgttgcttcccaggctcgagtgcatgccccaggggtttggccgggcttggaacccccgaatgcttgctttgtgatcccttcttttttttgaccgcccgttttgtgagcacctatgttaatctttagcctttggaggcgccggcgcctgtgggtctccaaagagagacctttgtcttgcgggtgccaatgccggactctttggggggcaaa

SEQ ID NO: 677169 - DNA, 231 bp, Homo sapiens
tcggagcactgtccgagatatcgcatcacttatctacaacagttctcgcatcacttatctacatcgcatcacttatctacatcgcatcacttatctacatcgcatcacttatctacatcgcatcacttatctacatcgcatcacttatatacatcgcatcactatctacatcgcatcacttatctacaactgttctcggagcactgtccgagatcgcatcacttatctaca

SEQ ID NO: 677170 - DNA, 639 bp, Homo sapiens
gcactacctatgcttctagaaagcccctcacctcaggacccagaaggaccagctggggggcagggggagagggggtaatggaggccaagcctgaagcttatctggaaattcttccctggggttcccaggatcccctgtctactccactgacctggaatgagctgggtaccagggcatccactgtggtggcaatgcctgatgtggtgaggtggccactgtggccccattcctccctccatgtgcatggaaggcgcgtcggatttcgaggtctaggtgattggtgctcgtgggtggagcactctgagggaccatcgtctgcccttgctgctccgggtcgggattgatgctctctctttgcctcccagtccctgtgatatcatttggggagaaacattgcaatgttggggcgtggggggtggcttgattacaactagcgcacgttcccccacggaaagcattgagcgtgtttggcgccttccctaaacgtgatcgccctcgtaatagagtcacgcgggtgaaagggacacgttgagacttcgacgacgaagaatggtcaggccccaggagagaggacactctggggacagggacccttcaaaggagttgttcttgcgcgaacgtggtgcgtcgggacgtaca

SEQ ID NO: 677171 - DNA, 567 bp, Homo sapiens
gcagtggttgctggtggtcgatctaagaggtcccccttgggagaggtggtggcagattctgggggggcagtgcaacccacgtccacagtcatcttggtagccaccttcaagttacaggtagccacatgacatttctgagcaaggaaagggaagaaaatgggcggatgaaacttctaataaaatcacggtgtcctggagcttggggtatcttttccttcttccggctgggatggcaaacctgccatcgggaggcaccggggccgctttcagggccataagtactcaaattaacagctaaggaggggggagccaaaagccaaaggcagaaagatctgtgaacccaggggaaggtaggacaaggtctgaagaatttgggtggtcactggggagaggagggcgaggggcatcgagggggtagagactaagggatgctgcgcagcaccctagagggctatgaatctgggggtaactggcctgaggatcactggtagggggggctaagggggctgaccagtggtaaaagctccggtgagcggggttcccttgatgggtgtcggaggtagagag

SEQ ID NO: 677172 - DNA, 417 bp, Homo sapiens
  misc_feature (65)..(65): n is a, c, g, or t
  misc_feature (88)..(88): n is a, c, g, or t
  misc_feature (201)..(201): n is a, c, g, or t
ctcaaatgccattcatctgacaaatattaatatttatggagcagcctctacgtgccaggcactgngctaggttcttgggacgtatcantgaacaagtgtggctgatgcctgtaatcccagcactttgggaggctgaggcaggaagatctcttaagctcaggctccttgagaccagcctgggtaacatagtgaaaccctgtntttccaaaaatcaaacaattagcctggcatgttggtgcctgtgggtcctagctacttgggaggatgaggtgagaggattgttttgagccctgggaggcaaaggttgtagtgagctgagatcgtgctactgcactttcagtctgggtgatagagtgagaccctgtctaaaaaaacaaatggtgtcctcccttcatccattcactcttctaacccatt

SEQ ID NO: 677173 - DNA, 304 bp, Homo sapiens
ccctggacttaaggctgcatgtgtgctataaagactgcaccacttggctcatgcctgtaatccccacactttggaaggccaaggcgggcagatcacctgaggtgagtgatgttcgatgatcagcctggccaatacggtgaataccccatctctactaaaaatataacaattactcaggcatggtggtgcatacactgttttcccagtctactcggtgatcgctgacggcaggacgatatcgcctgtaaccccagtgaggcagagcgtttcagatgagtccgaagatcatgtccagctgacactc

SEQ ID NO: 677174 - DNA, 287 bp, Homo sapiens
tgtgggtagcaagcaacctagggatcagttttgcaggtggtaaagccatttaccaatgatagttgtaggctaagaagggcagatttattagtagaaattcgtgaaaatatgttgcagtgggcagctcagcagagaaggggctacctgcaaagaggcaagggctggaggaaagttttatagggtcctgctgaagggtgctacgtgctgaaatgaggtcattgtgcccgcaggttgtttgtgattagctgtctctaacaattgttcatacaataattgttcattattgt

SEQ ID NO: 677175 - DNA, 679 bp, Homo sapiens
  misc_feature (14)..(14): n is a, c, g, or t
  misc_feature (32)..(32): n is a, c, g, or t
  misc_feature (45)..(45): n is a, c, g, or t
  misc_feature (87)..(87): n is a, c, g, or t
  misc_feature (92)..(92): n is a, c, g, or t
  misc_feature (171)..(171): n is a, c, g, or t
  misc_feature (354)..(354): n is a, c, g, or t
  misc_feature (590)..(590): n is a, c, g, or t
agcggagctgagtngctggtagtgcccgtggntgcttggttcganggtggccgtgtagtatgactccgcggagttcatctccctggntattncccgtcctaacgtcgctgcgcctttcagtcaggatgtctgcccgtggcccggctatcggcatcgacctgggcaccaccntattcgtgcgtcggggtctatccaacatggcaacggtggagatcatcgccaagcgaccatggacaatacgcaccaccgcgccagctacgtggccttcacgggacaccagagcgcctcatcggcgacgccggcgaagaaccaggtggccatgaatccccgatactagacactcatcattcgacngccaagaggctgagtggacggaaattcgaggatgccacagtgcagtcggatatgaaacactggccgtcccgggatgagtgagcgagggaggcaagcccaaagtgcaagtagagtacaagggggagaccaagatcttcttcccagaaggagatatcctccatggtcctcacgaagatgaaggagatcgcggaagcctacctggggggcaaggtgcacagcgcggtcataacggtccnggcctatttcaacgactcgcagcgccaggccaccaaggacgcaggcaccatcacggggctcaatgtgctgcgcatcatcaacgagccca

SEQ ID NO: 677176 - DNA, 392 bp, Homo sapiens
  misc_feature (371)..(371): n is a, c, g, or t
  misc_feature (388)..(388): n is a, c, g, or t
gagaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaagggaaaaatgccaactccatccttaaatctcaagggaaatctggattgtccaaataggattctgttaaatatgtnaacatattaataggggnaact

SEQ ID NO: 677177 - DNA, 389 bp, Homo sapiens
tgtgaatccaatatggatttaaaagaaggtttctatgagcaaatatatcatcccgaattcaacccattaatgtagaaaggaagtttcagaacaaatctcattttcttaaagtgtcaatacctattgatatggtttggatctgtgtccccaccaaatcgcatggccaattgtagtcccacatgtgtcaggtggggcctggtgggaggggtttaatacaagggggtggatttttcaagaatggtttagcaccgtccccttggagttgttcttgaaataatgagggcctgggagatgtggttatttaaaagtgcgcaacacctccggtcctccccaccttgctcctcatgctcctgccatgtgagacaccttgctctccttttgtctcacca

SEQ ID NO: 677178 - DNA, 115 bp, Homo sapiens
cccgtcacggtactcaaggcacacctacaccccttatccccatactagttattatcgaaaccatcagcctcccaagtagctggtattacaggcatccaccaccacgcctggataa

SEQ ID NO: 677179 - DNA, 881 bp, Homo sapiens
gatggctgtggggtcaagtacatccccagtcgtgacctctggacaagtgggggccctgactcatgagggcttccaatgtgctgcccccctcgttaatactcaccaagtaaattctacgttcgctgtacaaaatgaaaaaacacaaatgacaaaaatacaacagaggtttgtgtgtggcgggcctggggccattagcaagcagtctcacaaagaacacctcggtggggagggcaggggggacatagcaggttagcgcaagatcggagatactgggggttcaccgagagagggaccggaggtgtgcggaaaacgcgacgggggtggctagtgcctccccaaagaggtaaaaaaaaaacgtcggctggggagaaaccaggaggccgctttctagcagaacaagaccgcgaccgaacatggagtgcgccaacggaggcggcgcacgaacgcggaggagccaacctggcacagagcaggagcgtccactgggccgacagcgtccagtatacaaaaagttgtgccctcgccacgcgtggagggttagacaagacgaccattagccgccgaacttcgaacgcactcgacagcaggtcgtagtcgcggccacgaacgacacaatcgacgcactcgcaacaacgcaaacacacccatcaacggagcactgcatcagcaagcagtccagtccagcattccagacgcacacacaatgcaccgcacccgcgccccctcgcagcgccacgcacctcagacacgtaccacacaccacactccattcaaaccacgccacagctgagtgcccatccatcgcaacattcaaggcgtccaccatcaatggacagcatgcgaaaccgtaacagagacgaagacgaccaaaccgacaacgc

SEQ ID NO: 677180 - DNA, 159 bp, Homo sapiens
  misc_feature (97)..(97): n is a, c, g, or t
  misc_feature (99)..(99): n is a, c, g, or t
  misc_feature (122)..(122): n is a, c, g, or t
  misc_feature (134)..(134): n is a, c, g, or t
ggggatgaaagagggatttttaaatggcagaaaagtgttcctctggctgctgcccgggcagggcgggttgtgacttggaaaaagaaagggaaggtangnaagccttgaacttaaggacaagncagcaaaatgancctttgcagttttttggaacccaag

SEQ ID NO: 677181 - DNA, 103 bp, Homo sapiens
agagtgaaattccatctcaaaaaaaaaaaaggatccttttttttaatttttccaagggttcctaaatggttagaatattaaatactaataaagcggtttggaa

SEQ ID NO: 677182 - DNA, 137 bp, Homo sapiens
gacagagtaacagttaagttagagggtggcaggtcttttgtaatttcatggtcattttctcaatgcagtaatcattaatattatttaaataagtcacgacattaaccaccatagattataattttccaattatataa

SEQ ID NO: 677183 - DNA, 514 bp, Homo sapiens
tgtccgtgggtatccactgtaggacgttttccagacggtaaactttttgaggcttttcatgttgaacgtgttcttttttctttctgagacagagtcttgctctgttgcccagactggagcacagtggcgtaagctcagctcactgcaacctccgcctcgcgggtacaagcgattctcctgcctcagcctcccaagtagctggcattacaggcgtgcgccaccatgcccagctaatttttgaatgtttagcagtgacggggcttcaccacgttggcctagatgggctcaatccgttgacctcatgatccgctcgccccagcctcccaaagtgctgggattacaggggtgagccaccacacccagcccagtcagtgtatttatttaaggcatgttggaactggttctcatttggttctggggttgacagtcgtgaattagaatattattggtaacctcaagaggattctttccagatgcaattagaattcttaccactgagtaccatgaaaacatg

SEQ ID NO: 677184 - DNA, 276 bp, Homo sapiens
ctctatagtatttgagctagggatggggtttcactgtagtaggccaggatggtcttgatctcctgaccttgggatctgccagcctccgagctcccaaagagtagtatttattttaataggcgtgtatcactctctggaaattagcttctttcttctttttccttgtgatcatccattttcccgaaccagaatagaagtttctgagggccgaacttctgtctctctggccctcactatgtgtctctggcgcataacccagtggccacttgctttgcg

SEQ ID NO: 677185 - DNA, 243 bp, Homo sapiens
actcgatgtacaacacagcgaaacgtagccgacacgtattggtttaaacttcacgaaagagatcggcgggcgatcgcgcggttcaaggcagacgagtcgacgtggcgcatttgtccgcctgcgccatgttctgatagaagcgctggcgatcctgcttaaaccaaagcctgcggacgggcagaccctttttcagtgaaatcggcctcgatcagccgccctttgctggggtagaacaattacctc

SEQ ID NO: 677186 - DNA, 468 bp, Homo sapiens
acagcactaggggaatggggaaactggagaaaagggctcttatcccaaaaggaccagatccattggaacagatagaggtaaggaggcaaagagagaggaacagtacaagtgtaaaattgggagaaatagtttttaaagggggtcatttatttggcacttttaccaatttgttttgaaacagagtctcagtctgtcgcccaggctggagtgcagtgctgtgatcacaactcattgcagcttctaaggtcctgagctcaagtaatcctcctgcttctgccgagtagctaggactatagggtgcctggctaatttttattttttttgtcaaaatggaggtttgctatgttgcccaggctggtcttgtactcctggactcaagtccttctgcttcagcctcccaaagtgcaaagtgctgggattacaggtgtgaaccacctaacctggcctctagtttgtttgtttgacaca

SEQ ID NO: 677187 - DNA, 216 bp, Homo sapiens
ctcctgagcatgaacaaggttaatgatgatgcaaagcttaagatgtctcataagtacgttcctgacacgcgagggcaccactgttatttccacagctagcgtgctaacaggaaccatggcgcgtgtgagctcactgtgccagagtgcttgccgccttgtcgcgtcttgcaacaacctcgctccacatcctcagcaatgagaaccccatggtgaaac

SEQ ID NO: 677188 - DNA, 126 bp, Homo sapiens
tagcaggatctgtaagatctcaaatcagctctcacctgttactgtctagcactgctacttccaaatgagggaacaacctttcttttcttatcctgtgtacctacatccctggtatagggatgctgt

SEQ ID NO: 677189 - DNA, 158 bp, Homo sapiens
cccccccccgcgccgccgctcgctctctcaacgggcagacgcccgccctctttggttcgcccgaggctcccaacccccaagggggaaagaggggggtaaagtaaagagaggggctctcttacccactgtgttcgtaacaaaaaagagagattcccccc

SEQ ID NO: 677190 - DNA, 126 bp, Homo sapiens
caaactactttttcaaccctaaataggacccatgtaatttttcaaaagtgattgaacagtttgcccccccttagtttgttggttttatgtaaaacattggctcaaaataaagtcccccctgtttta

SEQ ID NO: 677191 - DNA, 954 bp, Homo sapiens
ggcatttatgaggcaccaactgtgtgcggaaaccaggtcacgtgccaggcaccatcctggggagacgcagtctggggtttcacccccttcccagagacgatgcccacacacactctcccacagtttccaggggactgaggacacaggcctagcaccgatgccaggaactgtctctggtttagggatacaagctagggtgctgcctgcacctcactttcccattggctcttctttttaaaaaacttttttcttgagatagggtctcgctcctcacccaggctggagtccagtggcgcaatcttggctcactggaaccttcgagctcaggcagtcctcctgcctcagcctcccgagtggctgggattgcaggcgcttgctaccgtgcccggctaatgttgtgtttttagtagagatggggtttcaccatgttgcccaggctggtctcgagctcctgacctcaagtgatctgcccgccgcggcctctgaaagtgctgggatgataggcgtggcactgctcccggcctcccgtggattttgagggtacagctcggttggtccgtgagcggtgggggaagccggagggggcagctgtgcccatggtgcccccacccaggcgacagagcactggttactccaacaccaagcccagccaggtgagaggagaccaggcggctgcccctctgatggacgacgggctcattagcgctgtgggctggcaggcgctaggatcgggtgtcaagcaggggaagcctggccgccgggacgaggtggcctggtctgggcggcatggggcgagcagatgaagggcacagtaggccaaatcccgtggtgggtgcagctagccacgctacacggcagaaccagcggcagaacgtcaggagagcaagcaacacaccccagacgggacagggagacctcacgcagaagacacggcggacttagaagggaagacta

SEQ ID NO: 677192 - DNA, 311 bp, Homo sapiens
attcgcggccgcgtcgacggcgtggtggctcacacctgtaaccccagcactttgggaggccaaggtgggtgcatcatgaggtcaagagattgagaccatcctggccaacatggtgaaatcccatctctactaaaaatacaaaaattagctgggcatggtggcatgcacctgtagcccagctctcgggaggtggacagaatcacttgaactggggaggcaaggtgcagtggccgagatcggtcactgactccgtctaagaacagaggaaacttgctcaaaaagaaaaaaaaaataagtcgacgcggcgcgaa

SEQ ID NO: 677193 - DNA, 375 bp, Homo sapiens
ctgaggggaaaatcgttggggatcatacacaagatcacatttatctaattatcttctggcttaaaataggcgagaagcaacagcggctgccacatttttttctctctctcacaaaactggaattcttctcgtggaaaagaaagagtgggcaccaattaagtattaacaaaatacagatgaactgtttactaccttcaataatctttatatgccattgataagcaaaagactactgggatactgtgggactgtaacccatagagtttcttagatgctattggagagataaaaggattggcaccgaggattcaagagaacaatggagtcaacactgaatgggaatcaaataatctgtgaagtcctgactgccactcc

SEQ ID NO: 677194 - DNA, 909 bp, Homo sapiens
cgatactaagtgtattactgtgtctccctgtcttaggatatctgtagatggatggcgatttcttaaatctgaaatgatctttacactgtcattctcagcatactgattatggagaaacacttgttgatttggttatacttgacttaactttatggcaatgtgaattaatggcactgctaagtaggaagatgtgtaattttattggtggctattcacatttgaattttttccgtgtataggcaatattatatgacaccttttacagatcttacgtgtagctttttccatataaataaaatgctttttctactattgtcttgattacttaaaaaaataaaaatataagtaaggatcaaaatctaaaatttgcatgaaaattacatccaaatgtgtgaaaatcagatctatttgttgccattagtcaccattagttatataaatttatggtttaggttagtatctctttactaaatgtgtcagtctataagataatatatgtgtgatcccttgctgtagaggagaattagagtaattggggtagtctggattatatctaaatggattatcgttacaagtactgaaatgagtataaggcagtaatcacccatccaaaaagaaggtcttatagacctgcgcagtcacctaagaataagttcatttaaaatgccccacctgatgtaattgacattacatttcttaaccactcttaaaatatgaattctaaaatgtatttactgcctcaccatttgaaaacctttttttctcactatgcgaagttcaacggaggtcaaaattatgcccctgggtttaatgtgcccgtaacggtgttaaaagggtactctcgctcagaacatacacgttgtcagggaaacactctcggtgcgtgcccggggtttaaacgggccgttg

SEQ ID NO: 677195 - DNA, 102 bp, Homo sapiens
acttatagctagtattcccgtaggagcatccatggctcaatgacttagatgctgtgcgattctcgactcaatgaaaaagggcccgtgtggaaccgaggagta

SEQ ID NO: 677196 - DNA, 341 bp, Homo sapiens
cataacataggagaacatgtcaaaacatagggagaaccaacataagtagtcttcaaaagacactagtgtcttggtatattcacatagccacctttgtgagatgcagcacattaatacatctgtcatatagcacgttaaaatggccaactttttaggtgcttgtggtactgtattctcgccacaatgatgtgactttccaaaattgtccagtgggaagggtgtaacgtggcaatgtggtttagtatggaacttactttgcactgtatcgggcggttgaattttgcttttattggactgtggacttgggactaaggcgaataaaacttaagctcacttaaaga

SEQ ID NO: 677197 - DNA, 828 bp, Homo sapiens
  misc_feature (48)..(48): n is a, c, g, or t
  misc_feature (110)..(110): n is a, c, g, or t
  misc_feature (115)..(115): n is a, c, g, or t
  misc_feature (117)..(117): n is a, c, g, or t
  misc_feature (124)..(124): n is a, c, g, or t
  misc_feature (135)..(135): n is a, c, g, or t
  misc_feature (140)..(140): n is a, c, g, or t
  misc_feature (156)..(156): n is a, c, g, or t
  misc_feature (160)..(160): n is a, c, g, or t
  misc_feature (163)..(163): n is a, c, g, or t
  misc_feature (200)..(200): n is a, c, g, or t
  misc_feature (213)..(213): n is a, c, g, or t
  misc_feature (216)..(217): n is a, c, g, or t
  misc_feature (231)..(231): n is a, c, g, or t
  misc_feature (235)..(235): n is a, c, g, or t
  misc_feature (240)..(240): n is a, c, g, or t
  misc_feature (245)..(245): n is a, c, g, or t
  misc_feature (256)..(256): n is a, c, g, or t
  misc_feature (258)..(258): n is a, c, g, or t
  misc_feature (260)..(260): n is a, c, g, or t
  misc_feature (279)..(279): n is a, c, g, or t
  misc_feature (284)..(284): n is a, c, g, or t
  misc_feature (299)..(299): n is a, c, g, or t
  misc_feature (301)..(302): n is a, c, g, or t
  misc_feature (311)..(311): n is a, c, g, or t
  misc_feature (317)..(317): n is a, c, g, or t
  misc_feature (321)..(321): n is a, c, g, or t
  misc_feature (354)..(354): n is a, c, g, or t
  misc_feature (358)..(358): n is a, c, g, or t
  misc_feature (360)..(360): n is a, c, g, or t
  misc_feature (389)..(389): n is a, c, g, or t
  misc_feature (391)..(391): n is a, c, g, or t
  misc_feature (411)..(411): n is a, c, g, or t
  misc_feature (418)..(418): n is a, c, g, or t
  misc_feature (429)..(429): n is a, c, g, or t
  misc_feature (431)..(432): n is a, c, g, or t
  misc_feature (448)..(448): n is a, c, g, or t
  misc_feature (450)..(450): n is a, c, g, or t
  misc_feature (482)..(482): n is a, c, g, or t
  misc_feature (504)..(504): n is a, c, g, or t
  misc_feature (563)..(563): n is a, c, g, or t
  misc_feature (573)..(574): n is a, c, g, or t
  misc_feature (604)..(604): n is a, c, g, or t
  misc_feature (608)..(608): n is a, c, g, or t
  misc_feature (619)..(619): n is a, c, g, or t
  misc_feature (629)..(629): n is a, c, g, or t
  misc_feature (682)..(682): n is a, c, g, or t
  misc_feature (684)..(684): n is a, c, g, or t
  misc_feature (707)..(707): n is a, c, g, or t
  misc_feature (717)..(717): n is a, c, g, or t
  misc_feature (817)..(817): n is a, c, g, or t
attgctaacaactccaaccctctatattgtgtttcttttgctcctggngtcctcttgcagctttaattcttgacactcaggcggcacaccagacattaaatccccacccnccgangnattagtnaaccttttgcnggtcnttcttttccgaatgcnaatnganaaattcttaagccctcttattcgtttcatgatgatcnttagataaaaaanttnngcctaacttgcatnttgnaaatnaatgngggggggggcncngnagggggttgcggatgatanatatngcttattcacttatntnngacaaagtncaattngggngactctcaatatcgttgcggtccattgtgtacnttcngngctgacccttgtgtcagtagctgtttgtnancttctttcgcttcctctgtnaagtgtncttttggggantnnacatcttaagtgtttntnaaagagcccttgttattgttgttgtcaaagtnggggagcccttcccctttcttncatagcttcgctcctggcctggtgatcttatcccgggaaatatgtaccttgtgaccatncaagtgagtnntatccatctcaaagccacccagttactcanctantgagattgtcncatttgtgtncaaatcatctcctctcctttcaaatattgggtgcttgacaactttgattcggnancgtaaatctccaggctccccatncacgtgaggntcaccttctccaataaaggggtactccatgccgtctctcaccccaggctctatttctacttccagcgttcgttcttcattcactagtttgacattagggnattcgtcgcag

SEQ ID NO: 677198 - DNA, 280 bp, Homo sapiens
gcctacgccagagccacagcaactcgggatccaagctgtgtctgcaacctacaccatagctcatggcaacaccatgtccttaacccaatgaaggaggccagggatcaaacttgcattgtcatggatcctagtcgggttcttaacctactgagccatgacaggaattcctgcagagaattttgaaggtctcagtgagaaatctggggccagtgacatgacatattatacacaaatcacccattttcaaaggcttaaaatctagtaaagtagtccttatatg

SEQ ID NO: 677199 - DNA, 334 bp, Homo sapiens
  misc_feature (277)..(277): n is a, c, g, or t
ggcttgtgcagcaatggccagatcagggctcgagatcttcgcgggaggaggaaggaggagctgctgaaacagctggacgagctgaaggtggagctgtcccagctgcgcgtcggcaaagtgacaagcggtccggcctccaagctctctaagatccgagtcgtccggaaatcattgccgtgttctcacagttattaacagactcagaagaaacctcaggaattctacaaggcaagagtacagccctggactgcggctaagagacagtgcatgcgcgcgntcacaggacgagagacttagacagagcagcacgaaggagcgcttacccctgcgagta

SEQ ID NO: 677200 - DNA, 458 bp, Homo sapiens
gagccggtcctgtgtgagctgctgagatgccatgaagtccacccttgtcgtatcaacagttgggtgccagccagtgatgtactggtaaatgcttaacaaccagctcttctgagaaaaaaaaaagtcagaccggtagcattggctgatttccatgctgcaaatactcccacaagggctgatttcatgctatcaatgtggtatcactgatggcagagttgagcagaagtacaggaacataccattatatgtatattcagtatttccaccatacatacagaatggacaaaataacttcaagagtgtagataagacctataatcccagcacttcaggaggccaaggtgggtgggtcacctgaggtcaggagttcaagaccaaccttgccaacatggccagcatggccaacattgccaggcaaattagccaggtgtggtggtgcatgccggtaatcccagcta

SEQ ID NO: 677201 - DNA, 163 bp, Homo sapiens
taccagctcgcaggggctgccggcagcccctcaccctgcagctggcacgccgtcttcccagcccaccatccccatcgtgggcctcgttgctggcctggctgtcctggctgtcctagctgtcctcggagctatggtggctgttggggtcaccgcagctcgacat

SEQ ID NO: 677202 - DNA, 808 bp, Homo sapiens
gcactgcccagttccgtgtcccgatgcccagcgccagcgcagccgaagagtcaggagaagccggggagatcatggagcggggaagattatgctaaagagagatatggaatatctctcagtgatacaatcacaagaaaaaccagatcgagtttgggtccgggtaaagagacttgacaatacaaaaagctgatgaagttgtgtgggtacgtgcaagagttcaatacaagcagagctaaaggggaaaacagtgcttcttagtcctacgtcagcaagcagttaaagtgtccaggctctttgtggggggggggagaaccatgcaaagcaaagcaagatggtttaaattgtgtgccaacatcaaacaaaagagagcatggtggatgtagaaggtgttgtgagaaacggtgactcagaaatattggaagctgtacacagcaagacgttgagtcacatgtcagaagatctatgtgatcagtggggtgaacccctgtcgtgccctgaagtgaatgatgctgtcggctgaggcagaaggagaaagaggaagggaagagctagtgttaaccagggatacaagatttagaccaccagaagtcattggatccttagggacattcaattagtcaggcagtctccggtctccaaggtgtggatcgtggaatctcttccggagaaagtttaattaaacacaggttgtgtggaatccaaaatctaaattttttaggtggcggggaaggggggccatgtttatgggcctatttaaaaaaatgctctctgggtgtgccaaggtttttcaagggcttgtgcggttgac

SEQ ID NO: 677203 - DNA, 1222 bp, Homo sapiens
  misc_feature (126)..(126): n is a, c, g, or t
gatggatagaccctgtcatgttctggggcggcaagccagtgccgagttctcgttgtatcgtaattagccttcgcatcgagaaccggtgccatcgcagtgagcctacgtatccagagtggtgcaggnatacagggaagcctgttatcatctgtagtggtgctccgggatgctgtgaccgcgccgcattggggaactgttcgaatggtcaatgatcctgtagaggcggtaggacgacagtcgctttagtcacttgtcttggggtaagggccttggccaatgcgcaatgatcttagcgagggaaactggagcaggggagtagacacattcagactcagcggaatggggagttgctatcaacagatactgtgcgacatgctcccactacatatggaagggccctctcctgagggccccatttcgcaacactatatcacgtagacggggaggccagagcgtcgttgagttcaggactggcgcatggggaactgctgaccccaactgagtcctgtgcatgaatacactactacttagggtgccactgaagaatgtcgcatgcggtttatgcggggtagtgaccatggaagagggagcacatgggatgtctggcggtatacagctcgtcgctgccaaaatggagtgaaccaaaggcctggcataaggtccacgtcttggagaaataagccaactgtgggatgaggtggtcaaatcaaagggaaggcctgccttggcgcggagaccgtgcaccagtcattgggcaccaacaaacattggtcgctggtctcccactgctgcattctactcgaatgttgcttagcagggcctcccagctcatacaggagcccgtcacggaaaaggagcggggactgaaagcttcgtcaggactcttggcggccttgagagatcgtttcatagacaaaggcagtcaggcggttcttccaattgggccatttccccagaagggttcctgtgccgaacttacccccctggtcgtaatcaaaagacgcttcattagcacgcaggggactgtacaggccgtgttaagctttgaagccaactaaggaggcgagggaaatggcaccccacggtggagcctccttcgcgccaaaatttctcttctaggattttccccgacgaacgggctcggaccttgtcttttcacacagccaaggtattacacgctgtttatgtgacactggggcccgccaaacagcgaatgtggcct

SEQ ID NO: 677204 - DNA, 305 bp, Homo sapiens
  misc_feature (16)..(16): n is a, c, g, or t
  misc_feature (24)..(24): n is a, c, g, or t
  misc_feature (52)..(52): n is a, c, g, or t
  misc_feature (54)..(54): n is a, c, g, or t
  misc_feature (67)..(67): n is a, c, g, or t
  misc_feature (72)..(72): n is a, c, g, or t
  misc_feature (74)..(74): n is a, c, g, or t
  misc_feature (96)..(96): n is a, c, g, or t
  misc_feature (98)..(98): n is a, c, g, or t
  misc_feature (160)..(160): n is a, c, g, or t
  misc_feature (238)..(238): n is a, c, g, or t
cataggggctgttgantgtgggancgagagctagcagacgcactttgtgctntngctctcctgctgnaggangnggtggtggtgtacttgatggtngncactgccgcctccaacagagctgaggccacccccaatggctctgccactgctggaactgaanccacctaccaacgccaagaccactagccataggagtaagactgcttcactccacccaggcctaagccactgccgacancactggcaccgccatagccactggagacggtggactgcaccacagagatgttgcctttcggagaaga

SEQ ID NO: 677205 - DNA, 1340 bp, Homo sapiens
aaaaagaaacagaagaggcaggctgagttattggagaagctgcctgcaggagatacgaagaattggcatgcgagaagctgaacaggaaaataatagaagaaaacatcacctctagctgcaccgttccgaatgaccagtgatgtgcgaatactgcccagaggtgaaactaaaaacgaacaggattagcaggacggcggctgacggcacgaaagactgacacaggcgacaaatgcgcgacacgctcgacggcacccacggaacgacgacaccacgacacgaccgcctgacgacacacgacacaacaccactcgacaaaagactcgcaacgactcgcactgtacgatacagcggaaccttagccagaaaacgataaagaaacaccataaacgttgcgcgataccgcaacctccagcctacagaccagccaagcttgcgccccatacttctgacggacattggcccccaacctccatccaacttcggaagcccacgccacacccctgcccaccccaccccacacccaccccacctgcacctccagaacccaacccacctagcccccccaacccttccccctgccaccccccactactccacctcctctgacaatcaaccccccaccattcgcaccaccaaactcccaccacaacaacacttctaacccgaagcacctcccctcacctggaccacaactcaccccatcgggtcgaccctaccgccccacaccatgcgcccccgaccacctcagacacacgtcccccgagccggaccccaacaggaccccacgacgaaagaacccccacaacaccgaccactcccgacgccctccatgcacagcaccatcgacaaacaccccaccgactcgaccaccgcccgcgcacaacctggcggccaccaccccagcagcaccgaccccaaccgcagcgctctccctgcaacccacgcgcaacgagaacgaccgccacgcccccacacccccccccccccccacacgcacaagacccccaacaccgaacaacagaggcccgaccacacgccacaccaggcccccccctccgcccaacacaccaccccaacacacgcaccgggaggacaacccctctcacactggcgagccggggggacacagcgacgcgcagcaaaacccccgacgcgacatcggcgccaccaaacacccacaagacaggcaccacaacagcagccgcgccgccgacgggcaaacaagggcacacgacgagcagcgaccacaccgacacgccacacacgcgccccgaaccaccccagccaccccgccgcgcaccgcgcgccccccaccacacggtcccaacgcaccacccgcg

SEQ ID NO: 677206 - DNA, 572 bp, Homo sapiens
ttttccggagggggccggggcgcgtatggaatagcgaatccatattagcacattgtgcaaacgagcacgagttcggtgggagatcccttccaatatgttctaacaataggagggggtttggccataagaggagggttcattcgctgatttcccctattttcggggtaccccctagaccaaacctacgccaaaatccatttcatttttatatttatggggggaaatttaatttttttcccccaacattttttgggcctatccggaatgccccgaggttattggggataccccgagggaaaccccccatgaaacatccttttattggtggggtcattcttttttttaacagcgggaaaattaaaaattttcatgatttgaaaagcctttgctttgaagggaaaagtcttaatagtaaaagaaccccccataaaactgggggtggttaaagggaggcccccccccctcccccacatttgaagaaccgggaaaaataaaatttagacaaaaaaggaaggaattgacccccccaaagggggttttaagccacccccagggcctccatgattttttca

SEQ ID NO: 677207 - DNA, 324 bp, Homo sapiens
  misc_feature (242)..(242): n is a, c, g, or t
  misc_feature (285)..(285): n is a, c, g, or t
  misc_feature (304)..(304): n is a, c, g, or t
taagtacttcaagtagcataattaatattagaaaatgactttcatttggtgaagaaatgtagtcagagcatgtggattcactaaaattgtcattgctccccagccgttacatagaacgcgggcatagaatgagcattcagccatgtgcgtgggtactccaaggaacagcactcgaggtcgtgatccctggtgcagagcacgagtgtagtcatgtgatgttgtgtagagagtgggatttcatnacatgttgcccagtgctgattctgagaactcctgtgcctcaangcaatcctccctgcctcangccttcctgagctagagatc

SEQ ID NO: 677208 - DNA, 1073 bp, Homo sapiens
  misc_feature (49)..(49): n is a, c, g, or t
  misc_feature (75)..(75): n is a, c, g, or t
  misc_feature (117)..(117): n is a, c, g, or t
  misc_feature (119)..(119): n is a, c, g, or t
  misc_feature (122)..(122): n is a, c, g, or t
cgcggcagcggcaggaccgccgtggcgcctagagtagcgacccgggggnagcgcggggcgacgctggctgcaggnacccggtgacagcgtgagagggtactaggttttgccaagttncnatnatgcgtgcagtcataagctcagtcagtatcttggctcaggcaggcagttggcacacagtctgcattatgacatgtaccaatttggtctcaaggacatttttgtcagcacaaaatcacgatcctcacgcatcagcacagcattccttcatcagcaaagcaaagttagcacagtcagcatgcaacaaccagtgtcatgcttgcacaatctttggcataactagcacggcaacaggcagcacatttaccagcacatgcagggcatttcatacactgcacacaacatggcacaaggcattttaggcattcagtttaattccgatcacagcgaccagtccaccatttccacagcatttacacagagctgagagcaaccagattcttcgagttaaagacactgatgatgtaccaatgacttacttgtaggtaataacgtgtgactaggaagatgcacgagttgtagggaaggaaccaggtcaaaatatagacaagaccatgggcacacacatggtgcctacttaccgactctttcttgcaacatccgacacataccctggtcaactgacgctcttactgacctacatgcggcgagttccgagacacaatccagtgctgggaaggctacgcaaagaggtataatgtccgcctgctttcaatatactaaaagcattgttattatgagcaggtctcgaaacatgtgaccagattcacagtgtcagatccaagttcgataaactaccaacatctaaatggacataccgatgggggaccacacacgaaggggcacgcgatgcccacacacgaagaccactcaacaacacacgaccaagaaacaaacaaacaaacgagacagatgcacgccacccgcggacccaagcaggccaagccacacccaagcgacaaacaggaagcacccagcccgcagagcgagagccgagaaaagccacaccaaga

SEQ ID NO: 677209 - DNA, 167 bp, Homo sapiens
acctgggccgtataggggaacagcgtacgctctaccggcaatatgaagtgtatacttcttaccgtacatagtctttaaagaaacatcggctgtagctgaatcgcttctcttgtaagccttaccattagctccgaagtagtaccaccactgagtgggctcgttctctt

SEQ ID NO: 677210 - DNA, 297 bp, Homo sapiens
agtcacgagatcccggaatgtgtggtgttatgctatggtatgtacaaagctaggcatagcacatgcagttggtgttgttagtcggtatgtcatcaatacaggcgaagaacattggttggctgttaggtggattctcagatatcattgaggctcttcaaaagtgcgtttatgctttggaagtgatactcctatttttaaggctttacagattcggatatggctggtgatgttgattctatcaaatccatatcatagtttttaagtacctttgcaagcggtacataacaccacacaatt

SEQ ID NO: 677211 - DNA, 520 bp, Homo sapiens
  misc_feature (302)..(302): n is a, c, g, or t
gacaggggccgagagcggggcgtggagacgcgcctagagggagagccagcgatgggacgggcccagactgagaggcggaaaaggggagctcaatggcggctgctacaagtgcggggaggactacgggggggctgtgaacccccgcgggggggggtggctaaggacaacgcctgaggaacaccgcggggaaagcccaacagcgacaaggggtgcccctcctcggccgggggagggcgcgcgagtaacggccaactcttgcgaccatggtaacacgggcccaccacgggagagaggccccaatnacagaggggcgtgcagagacaaagtctccagccatatatcagagcggggacacagcactcgcactcggatatataaagcgtccaggttgtttcgcgacagaattgagacatgatgtgatgtaatagacgtgcgtggatcgtgtgtcagcctcacaggtttgtgtgggttgcgtttgacaagataagccccccgccccaccaatagtcagagaaaatac

SEQ ID NO: 677212 - DNA, 450 bp, Homo sapiens
  misc_feature (79)..(79): n is a, c, g, or t
cgactctctcgctcttgatcttcatcttctatatcactttgagaagctatttgtcataagattgcattggtgcttctgnttccgagcaggcgttagtgatctgcactttctgtggtggaactgagcttctgaaccaattcttctattggtaattcagcatgccataatggaggctcaaagttcagttcgggagagttaagcagctgctctaaagactgtgtatatgtgctggcggaagacacagactccgtatcagttgtctccatgccttctccctcttcccgggttacagtgtgcatgtctagaagcgggaggtctgtgtttctcctttctcgaaggttcttcaaagattgttgagaggaacctgggcttcttgtggtcgggttcattcttaagcttggaagaagctgtgcttccatccttggaaatagcttgctgtacttgggggac

SEQ ID NO: 677213 - DNA, 264 bp, Homo sapiens
tagagttatcccctcataggcttcgcaggacatgcctgccttctgccacaccaaggcctgtcggggtcaagctggaaaggccagcagccttccagctggcttctcccaacactcttggggaccaaatatatttaatggttcagggacttgttcccaatgttctgacagccagagcgtttgaggggccagccggtccctcccaggcgatcttgtgctctactctaccgactgggccctgagggtggtttacctgcgaacctatga

SEQ ID NO: 677214 - DNA, 318 bp, Homo sapiens
  misc_feature (123)..(123): n is a, c, g, or t
aagggcctaccacctataacgcctgttcctccacacgctggaatgatggcgtttctttcccaatccagtctggtcacggctgcctgggctgtgcggaaaatggtttctgggatcgcgggcggnttcccgctggcgggcgtcaccgggcgcgcggaagtaatggatgccgtcgttccaggcggtctgggcggcacctatgcgggtaacccgattgcctgcgtggctgcgctggaagtgttgaaggtgtttgagcaggaaaatctgctgcaaaaagccaacgatctggggcagaagttgaaagacggattcctggcgata

SEQ ID NO: 677215 - DNA, 323 bp, Homo sapiens
ctcccagaagaggtatacttgttgagctctatgtgtctgttttttagtagttctcattttagtagttcccaggctctttgctttgtttttttttgagataaggtctcatcctaacgcccaggctggaggagttcgagaccagcctggccaacatggtgaaaccccatctctactaaaaatacaaaaattggccaggggcagtagctcacgcctgtaatcccagcactttgggaggccaaggcaggcggatcacttgaggtcaggagttcgagaccagcctggccaacatggcaaaatcccgtcctcactaaaaatacaaaaaa

SEQ ID NO: 677216 - DNA, 211 bp, Homo sapiens
gtctagcctcgccatgtggttggcattcattcacgtgaatccctgtggtgtaaaataaggcacaacaaggacaaaagtttgaggccgaggtgggcggatcatttgaggtcaggagttcaagaccagcctggccaacatggtgaaaccccatctctaccaaaaacagaaaaaaattagtcgggtgtggtggtgcacaccgtgtaatcccagc

SEQ ID NO: 677217 - DNA, 422 bp, Homo sapiens
agttagagtctccatgcccggctgattttaaattttaaaagtaagccttgtatagcctgggcaacatggtgagccccttccacaaaaatgaataaataaataaaattaaccaggtgtggtgatgtgtgcctgtagttccagcgactggggaggctgaggtgggaggatcccttgagcccaggaggtcaaggctgcagtaagctgtgatcatgccactgtcctccagtctgggtgacaaagcaagaccctatctcttaaaaaaaaaaaaaaaaaacccaggtgtggtggcccatggcctgttatcacagcactttgggaggccgagatgagagggttgcttgaggccaggaggttgaggctgcaatgaactgtgattgtgccagtgcactccagcctgggtgatagagcaagtactctgtctc

SEQ ID NO: 677218 - DNA, 245 bp, Homo sapiens
ctttcgccagccgctgggaacctacgccctgaaaaaagtggacaagacacgatccgtagcatccaggaggtgccggccccggtcctcagctccctcagtgtgccccgtggtgtccgggactccaggcacccgtccctggaccatgccaggcacgtggagaggcgcagctgctcgtgtcctgcccctgccacatcagtatgcttattcttttcaataaaaaggcacggtcagagctggaggctgct

SEQ ID NO: 677219 - DNA, 830 bp, Homo sapiens
cgtgtacgcgctgtgtcgtcgatggaggctaagggatttgggtactggctgcaggtaggagaatgagctgtgacataagagtagccatcaagagaaatggtccttacaggatccccagagtgaaaaacatgctctacgtgtaaactcgaaagagttattagaagacttgagcatgataacgattgtgaaagtgtttgagacttctaggctcccagtggaagccaatgaacagacgatgtgggctctcttacggaactgaacagatgttgtacatcgcttcaggagtacatggagacagacttgggctaaatgtgctggagcagggcccatttagcgtggaagagcatgccaggcttttcatgtatcagctgctacgggggctcaagtatattcactctgcaaagtgtactgcacagagatctcaaagcgcagctaatcttgtcacttaatacggaaggacctgggatgcctgaagaatacggtgactgtggggtcttgcacggaatcatggattccatcatttgattcccgagtaaggggtcaatgcgtttcgtgaagggaattggataaactaagaatgggctacaggattgtcgcgacgtgcttttatacgtattcgtcgctaagtacatttcatacgttaaaggccactttgcaccatgttgggggcctggcatggggcttggccattctatttggcttggacaagatgggctggaagctgaggttacagaaaacccccttttgtgaggggcagaaggtgggccaccaattggaaaccctttggaaaaccccggaattggcaaggactggaagttccatgaagccaa

SEQ ID NO: 677220 - DNA, 164 bp, Homo sapiens
acgtactgtcgcatatacatacacagaaggaatattcactcagaccttaaaacaggaaggaaattctgatacatgactgcaacatagataaaccctgaggactatgctaagatgaaataagccagtcacaaacataaaatactagtattcatttccacttaaat

SEQ ID NO: 677221 - DNA, 291 bp, Homo sapiens
actgatcagtcgactcggtaccctatgactatgcgcctgagcgcgaaaacataacgagtgacggacacatgatagagcttcttattggcgcggcggtggcggcgggcgtgggccgttacatcatcaaaggatattccgccaccggtgtcttgatggtgggcgggttactgctgcttggcatcagcgccctgatggggaaaacgctgttgccgtccggcgccgcgtctaccggcgggcgcgcgaccgatattatcgaatacgtcaagatcttgctgatgagccgcggcggcg

SEQ ID NO: 677222 - DNA, 314 bp, Homo sapiens
tcatcagctcggccccagtttacacagtgtataaatcattagccaatggaactttaaggagtccttatcatataaggtaatacaagtattaatattgtaaaactagatgtgtagacttgatcttataggggacaggaccaccaaccaatacatgcagattttgtgtgtgtggacggaaggtactttagacattcaattttcgctatatagaaacagaatgaatcaatgaccttgtttctatttatactttattattgcaagaggtacgtcaaagattacaatttgattcttctagagtcgctgtagtaactagg

SEQ ID NO: 677223 - DNA, 125 bp, Homo sapiens
  misc_feature (65)..(65): n is a, c, g, or t
cccaattatccctgctatacgtgctacactgaggcctcagtactagagatgaaactgaacgtgtntgatgttatgataacggatagagatattgatttgtgcaggtataagaatttccatgtaat

SEQ ID NO: 677224 - DNA, 748 bp, Homo sapiens
tctctcgcgctcgcatagctccctcccgcgcgctgttatatcccacggcgcgggcgaggagatatttggtcgcccttcgctcgcgctagataaaaatatatatagtatgataacatctctgcgtgagtagctgttcgcatctcgcgttgttgagtagaagagaggaagcaccgcgctgcgcgcgctgagatgtaaggcgcggcgtgctgctattttgttttttttgtgcgcgcgctcctcgctctactatatccgatagagggtgctttcgtgtgggagatatactatttagctcatcgcgagagatagacagacgaaaataagagagcagctcacacacagagatagaagagagagaggaggtgctcacctccataataaatatttgttgtgggtttgtttgttggttcacacaaaacatctatattggcccctctgtcctctcggctggtgatctctatgtagagacaatatatttccgccgagcactggtgtgggtgctttcttctctcgcttgtgggtgttagcaggaggtgtcccgcgcgtcgacggggtatattcttcttcttcgcagaggttttgatcggaggggtctctctcttttgtgttctttttccccggccgtggagtcatctctgtctttcgacgcggggccacctccgcggcggggagggggggacccccccccccgtttttattatttctggggggggcccccccaaaaaaaaaaaaaaggttgtgtgaaata

SEQ ID NO: 677225 - DNA, 223 bp, Homo sapiens
agatggatggctccatcggtccactaggatgatacaaaaataagcccggaatgatggcgcatgcctgaaagtcccagccacgttgggggctgaggcacgagaatcacttaatacccgagaggcagaggctgcagtgagccgacatcacaggactgcaatccagccggggcgatcagtgcgagactgcctcaaaataaatagatgaataagaaagaaagggcca

SEQ ID NO: 677226 - DNA, 159 bp, Homo sapiens
tgagctggtccagcaggctgggcccagataagatgtagattgctcgaagtgcggaccgatccttagccagagaactctctggagcattaaatgagatcctggggtactgccagtcagtgtgctgtaatgttgatggccgccatcctcatgacatcatcg

SEQ ID NO: 677227 - DNA, 374 bp, Homo sapiens
ccccctttttttggacccccccccggttttctaaaaattattctgaaataaaagaaaatttctttagccttccccccacacaggggaaaaaaaaaaagcttttttttgttcatgaatggacgccttaatggaatataggagtcatgtgtgtatgtgtagctttaagggcaatttccagaaatgcattagatgaatgacatttttaaaagcgatcccccaattgattctacaggctattatgtctcatgttgattcatgatccaggaagttttatgtatttaaaaaattgctatcgtgttatatttttccaatttttggagaagaaaatagctgtttaggctctctagccccaataaatgtaagcaggaaatcca

SEQ ID NO: 677228 - DNA, 377 bp, Homo sapiens
  misc_feature (368)..(368): n is a, c, g, or t
ggctgaactagaggttcccaacattctatatgccacagctcataatctgaaaaagaaatcaagaaagtaatcccatttataatagctacaaatataaaagatacctaggaataaacttaaccaaagaagtgaaagatctctacaataaaaactataaaacactgatgcaagaaactgaaaatacaacaaaatggaaagatattccatgttcatggattgggagaatcaatattgttaaaatgtccagacttcccaaagcggtctacagattcaatgcaatctctatgaaataccaataatactctttacagaaatagaataaattatcctaaagtttatactgaaccacaaaaaacctcccgtaggcnatcaagctt

SEQ ID NO: 677229 - DNA, 809 bp, Homo sapiens
  misc_feature (344)..(344): n is a, c, g, or t
  misc_feature (354)..(354): n is a, c, g, or t
catggtggcacatgcttccagtcccacctacatgggaggctgagccaggagaattgcttgaacctaggaggtagaggttgcaatgagccaaggtcatgccactgcactccagcctggctgacagtgagactctgtctcaaaaaaaaaaagaaaagggtggggcacgggggcctcaaggccttataattcccaggcactttggggagggccaagggcagggcgggattcaagagggccagggaaactcggagacctatcctaagttaacattgggtgaaaccccaatctcttaggtacacgagtccaaaaacattagcggggacagtggggggggagcacctggntgtgtcccangtaacttgtggagagcgctgaggcacacaagaatgtggggtgtgacacccgaggtagcgcagagtcttggcgagggaagccggaaattcaggtgccattggtgagcttcaaatcaagcctgtggcgccaaaccagttaagcccatggacactccgggtccctcacaaacctttaccttcaagtacatctacatgtcactgttcagaagaggacttggccttgctctccaaacagtaggacacacagattctctcaggcatttcaacgcccatctgatttctctcgcgggaaaacaaaccgagggtttcctgggggccccactgcctataataacgggggagcattcacgcaccaaagatctcgttttgcatccaatggggcgccataaaaggtgggggacaaacacattaaggccttccacaagggggtatacgccaaagattattcgggagtgg

SEQ ID NO: 677230 - DNA, 93 bp, Homo sapiens
ctagaagattcagcaaagtacttttgtgctcttggggaactccccaattccttcctacgctactgggggtttctgtacaccgataaactcact

SEQ ID NO: 677231 - DNA, 706 bp, Homo sapiens
ggccatttcaagggaggtggtaatttctcatagtgtgatttcatggtatgtaaagggtttagataaggagctacaagatccctgaggcattttggacctctcttttccctttggctcactctatttggggggactccaccacagatagagggtctgcctttgcctggatgaccattccaggaatgcccttgctcgaggggtcaattcaaacctaatgtaaaggagaactcacttgtaacttgggatgtggtgtttgtgacaaagttgaatccaaaattgggttcgcaaccagtagagtgtgtctgtgcacacaggtttattgagtgttaaagtgaaaatagacttgccaccctgatgggcaataatgaattaacccttttgtcttaggcttcgggtaacaccaagaaacagtccttgacagaaactgtcaattgccaaagaggacttaaattggttcactggcagtacaagaaatagaaaggaatcctggccattccctcacccctaagggaaatgacagacagctatctcttctctagggcttcagaatcccactgaagagctgcttcagccagggacctttgagttccacgggtaaggaagcagagcatttacggaagcacggagaaaaaaggaaggagaaattccagtaaagtacccatgcaagccaacaagaagccggccaggtgttagaaccctagtattg

SEQ ID NO: 677232 - DNA, 812 bp, Homo sapiens
gccgacctttttgtttgtctttttttaacaaacacctaaggttgattaataaattagtacactggaaggcattttgctgatatcggtccttcacgcactacccacgaaaccccgacccacacaaaaagggaagttccacggccacccttgggcatgtggcaaccgtggcaacggggaggcagtctagccaaggggtacgacttggggtaaaagtggtgagcccaatagagtgttgccacaaactaatatttctacggaccacgagagggtgtcgtataaccaacgatgtgtgatcgaagacgcaactatgcgtatgacatctctacacaagcgattagactccggcgtgcgacagaagagagcggtacatctccgccctccaccgatgagcgcgaccccagacagacgcagtcccgtttgcgaaggccaaacggccattcagagttggggggcacccctttaagtgtggggacgtttcgacctgccgtccggatctcttatcttaacacccacaacacccctacaacagggtggacccaaagtttaccattatcagcgaccacaagcactcgcgggcccacacccaccgcccgtcctccatgtgggtgcacgccccaccacaacaacatgcccccacactcccagcataatgttgggggaaacacaaccaaggggggagacagcgcccacacaccccggtgggcgcacccacaacccgtccactggggagcaccaattcacaccagtcggcgtgacacccctgcttgatgtacacccccacccataagaacagcgccacccagtggaggtcc

SEQ ID NO: 677233 - DNA, 188 bp, Homo sapiens
  misc_feature (8)..(8): n is a, c, g, or t
  misc_feature (53)..(53): n is a, c, g, or t
gggccatngtgtcggatctggtggagcggaccactcccctcacattcacaggnccatggactcactttgtaacaaactcctatcaacactgagcaataaaaaaaacggtgggttttttttttttttttttttttttttttttatttttttttttttttttttatttttttttttttttttttattata

SEQ ID NO: 677234 - DNA, 216 bp, Homo sapiens
cggcccatcgttctttattttgcgtatttaaaactattagatcgtgtgattatatttgacaggtcttaattgacgcgctgttcagccctttgagttcggttgagttttgggttggagaattttcttccacaagggattgtcttggatttttctgtttctccctcaatatccacctcatggaagtagatattcactaggtgatattttctaggctct

SEQ ID NO: 677235 - DNA, 996 bp, Homo sapiens
gtgcgcgtggcctcttgtgaagtgttcctcacacgagtgtacatgctgtccactataggagcgaaggctgatgactgtacatccgatggataaacctcgtccgtggcgtaagagatggccctcgtacaaattaattgaactctcacttatcccgactccttcatacgagggtccgagttggtatcgctgcctgaatccagttcgagagatcgagagctctcgggaagccatggagtgcgtatcttgcgagaggtacgtcctgtgaggctagcttgctcgcttgtgtgatcgcgggtgtccaataacgaatttgaaatatcaatgcctgagactaatttttagtttgaagactgggtactactgaaggtataagacggtcgtcttagctgagtgtgactaggagctttgctctacggcataacgaagcatactaattctatgtaatgtcaccatgggctttttcttttctttcagatgagaagcgccacttatctttatgtcccacgatatcatttcgatgggtgcatccttggacatacgtaggtggacactcaaagaccttgagcataggtacaggtgaagcattcacatcgccctgggatcctaagagaaattagccctggtgcagccgaaggacccttggacattggcccgtgcggactatgttgcctccaaaggaggagttgattccagggaagacggcgttgtctcgcattgactctggaggtcctgttaaggggctcactcgtacattcatggtgaatggtcgagtggcacatcctttttccttactaccctagcagaacagtcgcacgtcgaaaggaatgaaggccaaggaataaggaatacagccaaagagaaatcaaacgatctagtaaaccactggtcctgaagatagtctccaacttggcatgtgaggacagaattcctgttcgcttacttttcgcatttaagcccctgtattggtggtaggttaaccttcgaggtttacaccta

SEQ ID NO: 677236 - DNA, 82 bp, Homo sapiens
ggatttgctggtgcagtacaactaggcttaatagggacatgagctccaagtacttgaaagtgaaagagaaaactggaaaaaa

SEQ ID NO: 677237 - DNA, 160 bp, Homo sapiens
  misc_feature (119)..(119): n is a, c, g, or t
  misc_feature (130)..(130): n is a, c, g, or t
  misc_feature (135)..(135): n is a, c, g, or t
  misc_feature (147)..(147): n is a, c, g, or t
ctcacccacagagcatggggtaatggtgtgtagacacaggccctctgcagaagcgtggggtggggacactgacagcccctatctggtccccaggaacattctaccattttttgccactngtgttcagctnccttntttttccccaanaattcccaaggat

SEQ ID NO: 677238 - DNA, 207 bp, Homo sapiens
atgattgcaactctccgcaccaatccccgccgcaaaaaaagcttaaagtgatatatttttaaagagtcagtaatataccgaccagatctttctagcattcaggtataggcgtttatgggggccagcgaacttgtatatatcagtgttctagaacatgtaattcttaaactctaagtaataaatacttccaatggtaggagaccgtcg

SEQ ID NO: 677239 - DNA, 401 bp, Homo sapiens
  misc_feature (11)..(11): n is a, c, g, or t
  misc_feature (36)..(36): n is a, c, g, or t
  misc_feature (58)..(58): n is a, c, g, or t
ggcctaaatanataatagcctgaatatttaattaangagcctttccttatgccccggnccctatcctaaagagccttaaccctactgtatcattgcatttaatcagcatgatactaggaaaaaaagcactgtgagtattatcttcatggtgtaaagaaatgaggctaaaaacataaaatattttgctcaggtcatgcagctattaattgatgaagttaaaatctgaacccaggtttcaattttttttttcaagacaggatcttgctctgtcacccaggatggagtatagtgacatgaacacagctcactgtagccttgacctcccaagctgaagtgatcctgccacctcagtctgctaggtagctgggactacaggcatgtaccaccatgcccagcttaat

SEQ ID NO: 677240 - DNA, 111 bp, Homo sapiens
agagcgctctagaggatccgtgagaggaggcgggctatagataccttcttgagctcgtcgtacaggacagcacgaagggcccccatgcccgaggacgttggacacgcaccc

SEQ ID NO: 677241 - DNA, 555 bp, Homo sapiens
ggggctgaataatattccattcattatatgaatatgccacattttaaaaaattctttatcagttggtggacatttgggttcttttctactttttggttattatatatagtgcttctgtgaccattcatgtacaaatttttgtgtggatatatgttttcagttacattggatataatatttaggaatagaatcactgggttatatggtatcttaactctatatttaaccctatacaagactgttttacaaagtggctgcactattttaaattcccaccggccacttgtgaggttgtaatttctccacattgttaccaacacttgttattgtctatctttaaaaaaaaattagctatcttagggggtgtgaagtggtatcttgttacagttttgatttttattttcctaatgactaaggatgtacattgagcatcttttcatatatgagctattatttttatagaattgaaagattggaattaagacaatagaatccataacctggataaacactattgctttcattagggaaaattcatcattaaagttcttcaaa

SEQ ID NO: 677242 - DNA, 137 bp, Homo sapiens
  misc_feature (6)..(6): n is a, c, g, or t
  misc_feature (119)..(119): n is a, c, g, or t
gatggncctcaaggatgctaagaacaagcgggaagggctggaggatgcccggcagaagggcaagcaggacctggccgggttgctgaaggagtaccaggagctgatgaacgtcaagctgngcctggatgtggagatcg

SEQ ID NO: 677243 - DNA, 202 bp, Homo sapiens
tggagcgatatcgttattaaaggaagtagaacagctacgaatggaatgctacagattactgagcagccataacacgatggttctaggtctcatagtggacgaggcagaggtcgtcaggaccctaatcacacctccagcttatggtacaaattctaagacagtctaacccctcatgaaatagaatctgacgggtaaagacaac

SEQ ID NO: 677244 - DNA, 432 bp, Homo sapiens
tcaatcaagcaggaattgcacaattgactcaatgctatgtgttctcaaggagctccttcagtctaggcttgcctccggactgccctcctgcccctaaggcaccgggacacacagatgagcctcccacaggcagctcctggagctccccaggtggcctctcatggtcacctacagctatgagctgtaaggcccggagcctgagccaccagactcacctggctcgccccaccctccctgctagcaccaaggcgtgtacagcatcttaagcttggaacaagcagactggaattttcctctgctacctcttgtgtacagaatcttgtttataaatttcaaaaggaagtagctaaactagggaagactctggattctaaatttggttcatgtgtggtggagttcttagcttctaagagtataaaataaatttttcaa

SEQ ID NO: 677245 - DNA, 824 bp, Homo sapiens
agcggagtatctgtgggtacccggagcacggagatctcgtccggctatacgtgtcagctcggtggtctgcaggcatccctccggttcctcctcctcagagcggacggagaccccaagtggactagaagttcgaccatcgttgcatatctctgcgagacgtagtcgcatgtcgctaggggaaggagtcttctgagcatcttcgcgggggaactccactatctgtatagatggtctgatcgtactctctacgcttcatacacaggtcttcgtgtacaagatggctgactgtggcactcaggttggatgtccttcacacatgagttctcatatgagtgctcgctagaaggtctccagggaacagatgacctaagacatcagtctatactaggggcaaggagttgtttcacaaggcgtgttagaggccactaatccaataaacacatatatggcgctctgccgatgggtgtaggctaacagaacatccgtgcaactgtctacgaggaacaacgaggacagagtgtgcacagatctgcatgatgcgagcagttggatggcatagcagcaaaatgagaatcttcatgttgggatgctgaacgccaattctggggtgtgtcccattgccgtctagcaaagcttggtgccgagttagacgaagtggggtcccgccatgattaccggcaaccattcggttggacttgggccttgtgcacactcctgaagtcgatcgcgtgcacatgtgcccaggggttgcgaatgtcatcgaatggggggttctcaatgtctgggaacgagctaggtcatgcaggagttcatggatcttccca

SEQ ID NO: 677246 - DNA, 790 bp, Homo sapiens
caagaatctgaaagtctaagataggaaaaaaaagtgggggggcattataaatctataaaatgtacttctattggcatgcctaatacgtctttatatgtatgtatgtgttgtgtacacgatgttttagtgctaaaaatatgtaaaagagctctacttggcttaaagaaaaataaaagtgcttaaatcagatactaaaaaagaaaaggctagtcaaatgctttttcaaatttatgtaacttaagtaaaatctttaataaataaagtagctttaaaattattggtaaagtagtattagaaatgtcttaagaattgccagcatacatttttgtttgcattatattaatcaaacagttttatacttatccctgccaaataccagaaggtgtcaaaatttcggcataggggttataaaactataaacccagcccaaaacagaatgatctttgcttgtgtaatttttaataaataagacattgatatgggtttaatgaaaacagctgcatcttgaatttagtaagattaccataacttctaatcctgtggctttaggcagtttagtccacagacaattaaggaggtttgtttgggaaaaggactgttatcgtcattgtttcgaagctgaactttaaactaggttcctcccaaagttcattcggctatgcccaggaatgaacaaggacagttggaaagttaagagcaaggtggagtcagttaggtcaacatccgttttccactgtcctcagttgttaattttgcatgggaagtttcataactttttaatcatgactat

SEQ ID NO: 677247 - DNA, 244 bp, Homo sapiens
cacgagcgccccaaggggtattcagcaatgcccacgggtttctgctggacacgagtctgaagcctcctctgtgcggacagacattgtgtgacaacacagaggccattgccagctacaatcagctctcaaggctccgccagcccagggaggtgcgctaccgcgtgagcaacctgtatgaagatgatcataggaccccgacggcgacgcgcgagcgggtggacttctagcaccatcagctggctga

SEQ ID NO: 677248 - DNA, 1131 bp, Homo sapiens
gatccccatggcggctgggagcctgtgcacgtagtccgggacaataactggcagtggtctgcgaggactctcactctggtgtctgcagtacagcggggctcagagtctcgggatgcgtctcacgcaccagcagccaacattccagtatataggtgcacaatccaacacgacacgtccgctgaacctttcgtaccgacaacagtttcctgtgcggccaaggatcccacgacatttgaggggttagaaagagtggagttctgtgatggattaagaagatgccaagacgtcgcatatgccataacctaatgtgaatgagatactgagggaagcatgctgggcgaaagtacttctcagtaggctacgcagcactcatggttgcgtgcagatggagtgagcatttgcctggatgccgaaatattaagtggcccacgcagtcccatgatagccctgaggaatgttttaccccacaggcataggggtcagtgcagtgccagcccagcagatataaagaggtgcgcacatgtaagtacagtgccgaaatgcgacgcggatacggtgaggagcgaaatgtgctggtgagcctggggtggcagtggcatgtagcttggacaggaagcagaagggagctgtattcctggatggggccggaagcgaaggtgaaccattttgagacatggacaatcgagcagatttggacatgtcgaccccattgttgaggtggggcttctaatgaggcaagggattctaagaagacccttacttttaccgcccaggggcccttatccgcaatgaaccaaaccggactagagtttccctcaccctagccatttaacgcaaggcgccccagttccggggactgtctgtgggggcgacacgtgacaacttgtgttgacagacagatgggcccagagttgggatgggttaaaaaagaggtatggcaggagaaacccaacccttgaaaccagggggaacgacccacgggaacaggagaaaggggtgtcaccgggacgagagacaaaagcacgacagcccacggggggaaacggaaacggggcgacacgaaagggcggtggcccctgagacctgagggaggacaactgggatagaaagttgcgaacggagccggagcgc

SEQ ID NO: 677249 - DNA, 109 bp, Homo sapiens
cccacaacaagtgtgatttatagcatcctgggcatgcacacagtagacttggggctctgcaccaggcgtttcttcttgtgttacctcttctcctcttctggcagagggc

SEQ ID NO: 677250 - DNA, 460 bp, Homo sapiens
ggtaactcagcaaagtagagaaagctaatgtttaattgccagtcaataagaatgtcgataaaaaccaagatgatattctcattagaacccaagagagcctaaggactagaggtgctggtgagctttgaaaggcaagacaagaggtggggtggatatgaagatgatgaacttagatttagacttccagattccctcactcacctgcatactcaggtagcatctcctccccgaacctagcaggcaatagaggtttatcttcctgagcaacgaatccggagagactctggactttgggttatcagagacagttgagtagggaagtgaggaaaagaggcaaaacaaagggtgagctaaaagtctctctactgaatggtgagacactcagcccgaatctcctggctcaagtgatcctcccacctcagtctcccaagtagctaggaccacaggcacacaccaccac

SEQ ID NO: 677251 - DNA, 548 bp, Homo sapiens
gcgagtttctggcaaccctgggaaaacgcgtgggccagccacgttaacactcctttcggtgtggaacgcagggaaatccattgccggcgctgcggcggtcatcagggccatgtgttcgatgacggcccggcacccaccggcctgcgctattgcatgaacggcgcagccatgacgttcaccgcggcttaattcgatgtcttcttataagggaataccccatgtggcttttggttctcgcgtatctgggcggcgtgctgacgattgtcagcccgtgcatctgccggttctgccttttgtcttcgctcgcaccgggcagccgtttttgcgcagtggcttgccgctgctgctggggatggcgatgacgttcgccctggtcgcctcgctcgcggcggtgggcggcggttgggtggtgcaagtcaatcagtacggtcgctggctcgcgttgctgtttgttgcgctattcgggctgaccttgctgctgcccagtctgtccgaacgcctgacccggccactggtggcggcgggcagtcacctgtcggaagccgccg

SEQ ID NO: 677252 - DNA, 389 bp, Homo sapiens
cagagacatctacaagctgagcatagcttactaggcagcatgggctcagctatcaaactcgagcacacatcataatgacagtgtagcattcacctgtgcagcaatcagcgtgagtatcttcacgtacgagacgatatactcggtacctcaagtatggcatttatccagttggtctaatccatatggaatgaccatgtcaccatgtatagtcatgcaaggatccaagctgtgtctataaagcagcgtgtgcccattaagcctgctcgcctccgccagcactagtgagcacgtgtagccacggttgatggtcgtgccctacacctcaatccgaacgtgagaatatgaaaggtgacgaacccgcccgacgagctctcttccccgcgtgcgac

SEQ ID NO: 677253 - DNA, 455 bp, Homo sapiens
gcacagagcagggagcagcacagagcagggagcagcacagagccaaggaacagcacagagcaggggaacaacacagagcagggagcggcacagagcagggaacggcacagagcagaggaacggcacagagcagaggaccggcacagagcaggaaacggcacagagcttgggagcggcacagagcttgggagcggcacagagctgggagcggcacagagcagggaatagcacagagctgggagccaagagcccggatcacgcccttcttgctggcccttactggccactggcacttactgctgactgctcgggtcatgtgcccgggctttcggaacaagaagagctgccagttctgactcgtccccgtgtcctgcacacagctggcaatcaatgctcactgcatggctggaaaccgagttccagaacctgctgtgtcttaacaggtcgcccaggtt

SEQ ID NO: 677254 - DNA, 1063 bp, Homo sapiens
cgcggcggtggctgccgggaccctagcagtgtttcacgtcatgtgagcgggggcggcggcaatcgatgggatgagaccggcggtcggagtgtggtcctgcattcaagaccaactatgctgtgcgagcagcaaaatggagcctttctacaagggcggaaaagcacagctggacctagacgtggccacagcaacgctcttctgcgttctgtggcgaccagaggtcaacattctggcaagtggcctcgaggggccgtgtgcttgcgtgagtctggagcatggaggaccaggaggacatcgactgcgctttgacctcatgccctgacaacgaggtgctggtgactaggcagtcgggcattgctgctggctctgtgggaccggtgcagtgagggcatgcgtttcccggctgtcgaatggcgagtaacacgaatcgggaccccgttggggccgccattgggtcttcgaacctcctaggcttcctatctacttgctatggcccacagggtgggcttgtgatcgtggggcctgtgcgctgtctgaggacagtcgctgcggctactagcgggacgacaccagttgccggagggctcgacaccggctgttctgatggcaccctaggtgagaccttccacaccgggagccctacgactgacctgtctgcctcttgcgtccctcgtgcccacgggattgccgcccatccgtcgtgtggacacgtgctcgggagccggtcatgccgtgggcttgtgcttgagcgtgtccactaacagcgcccgtctccctcacttggggcttcaggtcggccgacgggcacaccatgcgtcaagcttcccggcaccggtgaaccaaagcatactgttattcaatctgggggaaccttttcagagaagactggccaaggggtgcagaggaagggaaccggtggccctggcggatatggaaaaagcgctgtgaaggcatggctgctgcttgtcgcgcaagaggcaaggccaggttgggccccagtgtgggtgttagtagttccccaaaggggtctgttcgctttctgaacagaccaggcggaaccaag

SEQ ID NO: 677255 - DNA, 141 bp, Homo sapiens
  misc_feature (1)..(1): n is a, c, g, or t
ntcccgatggttcaacggaactttactaaattctccagatagagctcgcgctgcagctcagcccatgggagagcagcgttgtaacagactcctgacgcccacacagttcgttcctggccagaagtaaaagcacagctgcct

SEQ ID NO: 677256 - DNA, 199 bp, Homo sapiens
cttgctcctcgaccggggcgaaggggtgcatctgcgagaaagccggccaggtcatagcctccatctcggcagcggcattgagtgtcatcgtgcacgaaccgagcgggatcatgccgcggtccaggccataatcgcggtccgccaaacgcttgagatagcgcatcatggtggtttcggtgtggtagctagaaaagaccgg

SEQ ID NO: 677257 - DNA, 211 bp, Homo sapiens
  misc_feature (58)..(58): n is a, c, g, or t
  misc_feature (64)..(64): n is a, c, g, or t
  misc_feature (147)..(147): n is a, c, g, or t
catggtagcccaccctgtaatcccaacaccttggaaaggctaacggtgggcgcaacanttagcntttgaagcccccaatgggacgtttgtgcagaacagcctaggcaacatggagaaaactcccgtctctacgaaaaatacaaaaanttaattcttgggggctcgcttggcgtggtgttggccaccaccccttttatttgggcttccccaa

SEQ ID NO: 677258 - DNA, 213 bp, Homo sapiens
tgactctgattagtggtgcactagttgtatgtatatcagatctcatggagacgttgtaagaagaattagttacttttattgatattgcttctaagtgaacttaacctaaaggtatatcagtaacagcggcaatacccttcatttcctcttcaaaagggccaggaaagttgccaagtaggccaggcaatttttcatccaccacctgcacaactg

SEQ ID NO: 677259 - DNA, 215 bp, Homo sapiens
agatacgcgtgtatacatatagggtgtgacatatatacactgtgtatctatattatatatgaagcgcctaaattggtagatactctatcacggggcggagggtcctagcgggagtgtacgcaaatgcgcgtatccgtactaatctgtcttgaagctagcgttagggcggcaatagcacctccgacgcttggtgggacgagtgacctcatagggtt

SEQ ID NO: 677260 - DNA, 342 bp, Homo sapiens
gaaggtagaggtctttttgtttaagcgcgcgaaccggatctaatcgcacgaaccgtttgtgcaaacggtagttccgttcgggccttggcacacgccgttggtgcaaacggtagtaccgccgggtccctggcatacgccattggtacacacggtagtgccgccggggccttcgcacgtgccgttggtgcaaacggtggtgccgcccgggcccacgcaggtgccgttcgtgcacgagccggggccggcgaagccgccttccgagccgccgtagggatcgttgggatccgaggggccttcgttcccgttgtcgccgccgtcgctggggggattcacgtagtcgta

SEQ ID NO: 677261 - DNA, 537 bp, Homo sapiens
cacccaaccgttgaaaagaacccctttaaaccaattcgggggtgggaccaggggggtataaaccattccttgacccctttattcccagctacaaaatttgataaagggaaagtctggcaatgcggccctgaaaaaggggacccttcccggggttaagggccaagtagtttccttccatgtacgaaaatgtgatgagtgcacacacagccccggttgtgtggggcagcccttgaggcatcatttgccaggacacccaaagaatatgcccgtcaccgcggagacttggaagagggagaaacccattgggtcttcattgtctaaaccccttgctcataacaagtgatgtggagtccccgtgaccagtgggccctcattcccattggcagaacaatccttgttcttgttgggacggatttaaaggatcagcaaaccatttgtccatgatatccttacctttaagtagtaaattgcaaatactgcgtgatttccatccatattgttttaatggattgttgaagggaatccatgttacaaacc

SEQ ID NO: 677262 - DNA, 279 bp, Homo sapiens
cacgaggggtattgttcgtccagcatcattacaggttcacagtgtgctggttacaagttctgactcaagtgtgattattcaggagggagtaccttcaccaacctcaagtagtgtaatcacccaggcaccatcctctaagaggccaattgtccctgtaccagggccatttcctcttctgttacatcttcctaagggttactccaagcctgttgctattcctgcatcaattacaagttctgatgtgaatgttccagatgcattccgactcgtttgaccagt

SEQ ID NO: 677263 - DNA, 506 bp, Homo sapiens
ccaaccttcaaaccgcctgtgccatatttcgggaggctgcaaggagggctccaagctcgaagaaccatcatcatcaaggggtatgtgcctcccacaggcaagagctttgctatcaacttcaaggtgggctcctcaggggacatagctttgcacattaatccccgcatgggcaacggtaccgtggtccggaacagccttttgaatggctcgtggggatccgaggaaaaaaagatcccccccaacccatttggttccggacagttttttgatctgtccattcgctgtggcttggatcgcttcaaggtttacgccaatggccagcccctttttgactttgcccatcgcctttcggccttccaaagggtggacccattggaaatccagggtgatgtccccttgtcctatgtccagatttaatttatttctggggccataactcatgggaaaacaaaattatcccctaggactcctttttaagcccctaataaaatgtttgagggggtcca

SEQ ID NO: 677264 - DNA, 743 bp, Homo sapiens
tggacaaaatgggggcaggaggcaggggcgttggtgggaagcgcagttcgaaaagcgatgccgattctgggttcccgggggtcggcggcccatcttcggtggacccagcgctgaggcggcggcggagaggcccaagaaaataaaaagcggggcgtggcggcggctggcgtcaggacccgctggggcttggaggtttgcccagttcccgtggaaaacggtgcggctacaggagcgcacagagcgggggctggtggctcagaggccccaatgtgaaaacactctctctccggggacagggggccccagaggcaaacaggggcgtgacaaagagagagacaccaaggtccagaaaagaagttcagcgtgcttctcaagaaaccccctttgcgggttgtgaccctcaatccgtcgagaacacttccaagagtcccgtgcccccaagagacgtccttcgcccaccgaggtcccccaagcgccaaaaagtctcaggcggaaggagcagtctatgggagaagctgggccaagcaagggcaagtctgccccgggatggtgcggcagggcccaggcccgggttcctcaacctttctgcaacatgggccaagccccgggcccaggaacaccgtaaaagggccttctaaacctgtgggcctcagaaacccttggaaggccgttgttggccagataatttcctgggcgacccgaaaaggttgaatgcagaacctgcacaacgccagcccccggtg

SEQ ID NO: 677265 - DNA, 144 bp, Homo sapiens
gccggctcaacgtgttgatcttactcttctgcttcatctgggactttttctattagttattccccaattctatctttaatctctacatcggccatcaaaaacaaaaaggaaaaaaaaatttaagccccaattgagggccctttc

SEQ ID NO: 677266 - DNA, 444 bp, Homo sapiens
ggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtccatgatgtgtgttgtatt

SEQ ID NO: 677267 - DNA, 81 bp, Homo sapiens
accgggccggaatgtacaaagccctgatgcggggtgttaggaattacctggaattgtcaataaacaaatgctgctgtccga

SEQ ID NO: 677268 - DNA, 209 bp, Homo sapiens
caggaaaaggacgctagaaccaaaatgtgtttagccacagttatacatgaatacaaactgacaagcttcactattttatgaatgaactgtatactcccagctatatacttttcgtatgagcaactagatcattcacttttacgaagcttactcctcaacttatgactcttttaagaaatggtaactttggagcatatagccttttttaa

SEQ ID NO: 677269 - DNA, 361 bp, Homo sapiens
  misc_feature (307)..(307): n is a, c, g, or t
  misc_feature (322)..(322): n is a, c, g, or t
  misc_feature (358)..(359): n is a, c, g, or t
cgggcaacatgtcaaaactcccatctcccacaaaaaacacaaaaaattagcctaggtgtggtggtgcaggcctgtagtccccagctactcaggagactgagtcgggaggatggcttgagccccaggaggtggaggttgcagtgagctgcgattacacccactgcactccagcccaggcaacagagccagaacctgtctcaaaaaaattaaaaaaaccaaatcagcaaaaaggtcttagatagccaggcatggtcgcctgtagtcccagctactcacagggttgaggtgggaggatcacttgaacccnggagttagagaccancctgggcaacatagcaagccctgtttctgaatatannaa

SEQ ID NO: 677270 - DNA, 145 bp, Homo sapiens
cggacgttaaccgaacaggctactgaaattgtcttgctcgtttgcttgtttcccctcagtcattcctgttgcgacctgagctccacaaccacaggacactgcaggtcagacatgaagacagagcctttgtcctggacctgttcgg

SEQ ID NO: 677271 - DNA, 136 bp, Homo sapiens
attctcctctcttctgtgctgtagtgtgctatgcgatcatgggtgtcgcaactaagttcggcatcatatggtgactcccgggactgttggacccaccaggttgcctaaggcaggaggaggaatactgccgggtacc

SEQ ID NO: 677272 - DNA, 113 bp, Homo sapiens
tctatagatctcgaggttgtggaggctgaggagctgggcgggcagggagagggtcttggggacagccctcctgggtaatctacattgtgttccccctaccctgccacacacct

SEQ ID NO: 677273 - DNA, 902 bp, Homo sapiens
tctaatcagaatcttgatgcgcatgcagtttaacaaggtcagaagagatagagttgctaaacccagtgtgatacctcagattggagcgggaattcaccaggtatgcttgtagcacagcaaagtatagttgtgttgaacatagaactttatagtcattttcgggtttcatcctctatgtgagtcagctacaacaagtggtctcattttaacaacagtagaacttcctcgcttttctactgtaatcttcccactgactttactgcacaggtatgaaatactagtgtatggatctcagtaacctttttatttcctagatgattgaaatataggtatttactccatttaaacccaggtgataagatgatgtaaatactcagggagggtaataacttgttacttattgctcgtagggggtgtaaagtgccatgatgaataatcttcaattcatgattctagagtaagtttaattggaaaaagggggctcacacatggggtggttgaccattgattctttatattaaaaacgatgaacatgtttgtggactgatacattaaatctactgaatatgaattgtgatgatattctcactgcaaaatagccgtttgaaactaggaagaccacggtccagtcccccattttgtcagtaggccaaccagggaaataagttatgatcccgggtgcaggaactggcaagcgaatgcatggtgtggaaccatattgaacgggaggtgacgtggtgcggtaccacctaggaggggggaacagtgccgagtgcgacggagagtgtacacggccactggtaaggaaactaaaagaaagtgagggggaacgtgaaaatgagacgctagagtgatattacaagctctcttctccttcacataattttaggaataggggggga

SEQ ID NO: 677274 - DNA, 338 bp, Homo sapiens
tgggccgcaagaagggagccaagttgactcttgggggagaagggatttttcacaaaaaaggatttaaaaaaattccgaagaaatttgttgaaaggaaaaagaattccaaaatcagctgttttttgggggagcagttccagcagggcaagctttttgcgtgcatcgcttcaaggccgggacaattttgccgggcagatggttttgttttagagggcaaagggttggggtttttttttaggaaaatcaaggcccgcaaaggcaaataaatccttgttttgtgttcacccatgtaataaaggtgtttattgttttgttccccccaaaaaaatgacaaaaaa

SEQ ID NO: 677275 - DNA, 857 bp, Homo sapiens
cacagtggctcacacctgtaatccccatactttggaagtctgaggcgggcagatcgcctcaggtcaggagttcgagaccagcctggccaacatggtgaaaccgtctctactaaaaatacaaaaattaactgagcgcggtggctttcatgcgcgtccgtgtgaagagaccaccaaacaggctttgtgtgagcaataaagctgtttatttcacctgggtgcaggtgggctgagtccgaaaagagtcagcgaagggagataggggtggggctgttttatagtatttgggaaggcaatggaaaattacagtcaaagggcgggcaggagtggggggtcgcaaggtgctcagtgggggtgcttctgagccaggagaagaaaatttgcagggttaatcactcagttaaggtggggcaggaacaaatcacaatggtggaatgtcatcagttaaggcggggcagggccttttcacttttgtgattcttcagttacttcaggccatctgggtgtatatgtgcaaggcacaggggatgcgatggcttggcttgggctcagaggcctgacagtggcacacgcctgtaatccccagctacttgggagcctgaggcaggagaatcgatgaacccaggaggcggaggttgcagtgagccgaggtcgcacattgcactcagcctgggcgacagagtagggtccggctcctaaaaaaagaaacaaaaaaaaacacaactggggggcgccggcccaaaaagttaaaccattggggggcgggcccagagaagaactggccacacgggccagaaccggagcgaaggtggttccaaaaacccggcgcgggcacaacggggccggacaaaccaaaaggg

SEQ ID NO: 677276 - DNA, 245 bp, Homo sapiens
ggtggaactgagctccgctcctgaatctccaaaggagcccatgctgcccggcttccctgagtcattttttccagcatcctgtcagatcccttcatgtacttatttcccccttgtgttaactattacgataataattttttaggaattgaaatgtcactctttttatattcaactcacattacgtatatttagggatataaaaatttatagagattgtataaactctcatcttgtggtgtgatata

SEQ ID NO: 677277 - DNA, 493 bp, Homo sapiens
  misc_feature (183)..(183): n is a, c, g, or t
  misc_feature (191)..(192): n is a, c, g, or t
  misc_feature (203)..(203): n is a, c, g, or t
  misc_feature (218)..(218): n is a, c, g, or t
  misc_feature (220)..(221): n is a, c, g, or t
  misc_feature (233)..(233): n is a, c, g, or t
  misc_feature (245)..(245): n is a, c, g, or t
  misc_feature (275)..(275): n is a, c, g, or t
  misc_feature (279)..(279): n is a, c, g, or t
  misc_feature (283)..(283): n is a, c, g, or t
  misc_feature (291)..(291): n is a, c, g, or t
  misc_feature (301)..(302): n is a, c, g, or t
  misc_feature (308)..(308): n is a, c, g, or t
  misc_feature (322)..(322): n is a, c, g, or t
  misc_feature (334)..(334): n is a, c, g, or t
  misc_feature (339)..(340): n is a, c, g, or t
  misc_feature (347)..(347): n is a, c, g, or t
  misc_feature (351)..(352): n is a, c, g, or t
  misc_feature (361)..(361): n is a, c, g, or t
agaaggcaaagacgcagaaagaaaattccctgctttcaaagaaacgatggacaggagaagcaagcaggcgaatcgtaatgaggcgtgcgccgccaatatgcactgtacattccacaagcattgccttcttattttacttcttttagctgtttaactttgtaagatgcaaaaggttgatcaagnttaaatgnntgtgctccccnttcacatcaaagaantnntgacaacgaggncgccctgccttncccatctgtctatctatctggctggcaggnaagnaaanaactgccngttggtgaannaaaaantggggtggaaaaantggggtgggacncccanngaaatcnagannaaaaccaantggcccaaggtgtcctgcaggctgtaatgcagtttaatcagagtgccatttttttttttgttcaaatgattttaattattggaatgcccaatttttttaatatgcaaataaaaagtttaaaaacttaaaaaa

SEQ ID NO: 677278 - DNA, 117 bp, Homo sapiens
tgtggtgttactgtctgtgacacatgtaagcgtattacggactgcttctccctggatccacatgagctttccccctcttagttgtttttctaaaagatacaacacccacctagccac

SEQ ID NO: 677279 - DNA, 227 bp, Homo sapiens
ggtagatacgctatcacctccactaccatttgcgttcaactgtggagagagatggacctataaaaacatctgctttacagtgtgggatgtgtgatgcgacaggacaacattcgatcccctctggagacattacttccaaaacacccaatgggttgatatttgtggtcgacagcaatgatcgggagcgagtaaatgatggcccgggaagagctgatgagaatgctggc

SEQ ID NO: 677280 - DNA, 363 bp, Homo sapiens
ggcgcagctcacacagtaatgatatgacaggtggcggagctcacacagtaatgactgggggcggggctcacactagtaatgctttggcaggggtgggagttcatgctagtattctttggcctggggcggggctcgaactgtaatactctgtcaggggggggggctcacacagtaatgctctggcagggggcggagctcacacagtaatgctctggcagggggcggagctcacacagtaatgctctgccagggggcggagctcacacagtaatgctctggaagggggcggagctcacagagaaatgctctggcaggtggcggagctcacacagtaatgctctgagaagggggcggagctcacag

SEQ ID NO: 677281 - DNA, 195 bp, Homo sapiens
  misc_feature (153)..(153): n is a, c, g, or t
cataagtcttcccgggcggcaaggagtacctgatgcgggccacttcggcctgctagtgtggaggcgaagacaaggagggcaagcccccgatcagtgtcaatgttcgagatcctcttacttcactactctccgtgcatccagtgtgcgctactnctgaagatcattagacgaagatgtgggtaccacggccctgcc

SEQ ID NO: 677282 - DNA, 188 bp, Homo sapiens
tgggggggccggggggggccctttttttttaacccgggggcccccccccggcgggggggaaaaaaggcttttaaaaaaaggggggggggggaaaaaaaaaaaccccccctttttttttgggccccccccccctaaaaaaaaaccattttttttttttttgtggccccccgccccccccccccaaatta

SEQ ID NO: 677283 - DNA, 574 bp, Homo sapiens
aggtcgacggagactctcaaagtatgggccagatctttagcatggaccatactttgagagatatgcttcaaacagaaaatgcccacccctcctcctttacccagcataaactctatggttaattcttaaaataatgccttacagtctccattaactcccttgcccttctcttgctttgtcatgctcgcttggcaaaacctcatctctgactaaatgcagttctttgccttctctgttcctgcaccaaaaatgatcaggagaaagcatattaccaggctgaactgtcactttaaattcatgaccagtaacttcatggaggcccttaacgtttcctgatggtcatactacaatttttggagtccacttaactcccctgctttcctaggccactactttatactttctctcttctgtaacttccaaagcatccctctcagttctcatgctcagctgatggttatttttctgcctcggcgagagtctccgtcgaactagttcgacggagactctcaatcccaggttttcaaagaaaaacctatctaaggaatacttaccaaaatcagataagaaaatt

SEQ ID NO: 677284 - DNA, 1747 bp, Homo sapiens
  misc_feature (1302)..(1302): n is a, c, g, or t
agatcagccttagtcaatatactttgcggatcttaagtgatacagattaagcaatccagggtcctgtccatacaagatgggagagagttattaccaggatgtatatatgaccgaaactaagggtggacgtgatgacagttagtaggtaggctatccagtcggaacgttgtagccctagacaggtgatacgcgccaagagagtcgggatctctgagaattccaaggtcatgtggcgtggatgcagtatgaccctaggacattgatatatcgtgtcgtaataccatgtacgtacaaacacgaagctgactgatcattccagatggtgtcttagtcattcttcactgaagagtcagtgcgactcgcaggctcaagatggtcagttgtgagcatcattattggcatgcgagtccgatgctcacggctaagtgttgtgtcatgccaataactaggtacaacgaaagtgtacgcctgcgaaaagacttagggaattttagcgtgcagtctccacgcggtgacaatgaatgccacatgtatgtgagagtatcgtaaaccatgtgtctatgtctgagggactaagtgtggcacgaaactagtattgatgcacggtgttcgacttagagacacatcatgcatcagaaggcggagacctaaacacatgcacgcgatggctgtgggtctacggctatgcgcccacgaaatagggggtcacactggtgcgccggcggtgtccatactagataatctcttgtgaggatatccatattgtttgcccgccgagatgtacgaaagggacaaatcctctaatatgtacggggccacttttcccaataggccgctaagtcaagatgttaactaaccatttgccaggctcggttgccacaatgggcgtcctctggatctagatactcgggctaagctcaagagggtcaccggacaactaaaatagagccatagggcatggttaccaatgaggtctagggcgagattgcctatttgtttatcccccccggaacagctatgccttccaaccttattctttcttttaaactcacggcgtaacctgagtaaaggccggttggccttatatagtcaaccaggtcggcaggcgggcattggaaggcccttctatcctaggtacaccttaggagtcagggaggcacatatcggggagccgctttttatcgttacccaagcgccaaagacttcaccctcgggcggacgaacacaaaaggccctgcgtgagcggtcacaccgtggcgtcgtttaccacacttgtaggccacagggcacacagagagttancgaaacagaccccccacggacggctatcccccaccaaaaagccaaccagggtaggcagagacgccctctggcgaggcgcacaacacagggcctagggcccgggacaacacagagagaccgacgcagtcagaccgcgaccagctgaccaggtgacttgggttccccccctgaagttgtaccccaagagtcgacaccaccccctccgctgcaacggaagaccaccaggcgaggacgaaccgcatgaatacatacatacgccaatcctaccgacgagacgcatcagcccagtgtggcctagagggactcaagaacgcggcacacagatcgcccgtcacgaaaagagaccagaaatcgctccacaccactggacgagtcagaacacgaaccaccgcacacagccgagaagccctaccagcggcagcaccagcagaccacacaaacgaag

SEQ ID NO: 677285 - DNA, 140 bp, Homo sapiens
acatcagagtacagtaggtaccacataaatcacggggaaaaaacggataaaacagtaatataaaagcatttacaaagtcccagcacattggcacgccatggggataaggggaccctcaagatgtccagccctggcagggc

SEQ ID NO: 677286 - DNA, 322 bp, Homo sapiens
taaattggggacccccaaggtggtaaaaatgtttgttttacctgacagttataccacaggtaaactgtcaattgtgaaaaaagtgaatcaataactgtgtattggtttaaaaaattaaattaatcctgtgaaaaaagtggctttttttttctaaaggaagttatagtctttggacccactaattttggatgcggccatcttccatttggggtgcacctggtttccaccaagcaggcctgttaactctccatgactaacactggtgtaagtcgctcaaaaagggaataaaatggcttttctcactataagaaaaaaaaaaaag

SEQ ID NO: 677287 - DNA, 1772 bp, Homo sapiens
  misc_feature (1)..(1): n is a, c, g, or t
nctgtcgcagtcgtgctgctatttttacctctcgctgttctcttctcgcctgctgtggttcgtctgttgagtggctggcgtcggctctgcgttctgtgtgggtatcgtcgctgctgctgcgtctgtgtgttggctctgcgtcatgacagtcgtcgtctgtcgtggtcatctcatacagtgagtcacagcaatacggggatcgcctttgtgtggtgttgatggagggcgtcctctattgtttccacagcagctatagttgctccctgctgtgtagctggtttgggtgtgtgatatttgcctcctcgtcttcctgtttggcttttgtctcttcccttctacgctcacttgtgtgttgtgttgatgcgtccacgagtctggccaccaacccactccctttgggcttttttgcgtacatacaccttctctgggtcgttggaggtggtggcctcttgcctatggtcggctctctctgtgacatacccggctcctaagcggatctttatttctcttgtgaggctgtgtgctagttctcgggcgctttgaatgcccagcagtgtgtcttgttgtggaagtggggtgcccccttctttgggggggttattttgttgagataatggtgggctcagccgtttggtttggtctgctcccgggggggtagcccccctaagagccgtgcttgtcggcgctagggagatggtcaaaggggtttgggtgttggtaagatgctcccacgcgtgttttgtattgggggggctccttcccactgcatagcccagcgttccaattattgtgttgtgtgtgtttgggtagtgaattcgcctccgttgtgtctcacaacctatttggcgctgttggttgggtgccaccacctacaatgttggtggagattcctcctccctctgtatggtggattgatactaatgggttccaatcctccaacattttttgggagaggtccaccactttcgtagcgcgtcgcttgtggtctgtccacccacttgttttgggaaggctctcccctcgtggaaaagggttgttatacagtgcccctctgcctctctggggcgcgttcggatttgtcttcttttcccacgcgcccactgattttgtgatcggtatgctcgtgtttcctcgtgcctcgtctgtgataggttgtgtcgctcggtgggccacccacgcgccctccctctaatagtgcacacacttttatggggcacttcttgtgtcttcgacactgtcgtctcccacactctgtgccactgttataggctttgaaaacgccctctcgcccacaacggtcccacacagagtgttcacaggctatagtgcgccccacaacagagagagatgtcacagtggcctcacaggaaaaccactctataaaccacggtgtgggcaccacagcacttctgcacgctgcacttcttgcacctggcacaccctcgagagttgtggcacaacactgtgtcttgcacaagagtgcccactcttggagattgttttatagtggagactataacaccctctggtggcactttctatgaggtggcacaataatttatattgttcgccgcgttataaaagagaagtgagccacgtggttagctctagtgtccttctctttgagtgtaaggttaattatgagttagctcttggtgcacctcgtttcacctaactccacgcactgggaacccacagatgaaattccactttgtaaggtagtgagaccaaattgatgatcccttaagttaaccataaaagtgtcccattga

SEQ ID NO: 677288 - DNA, 517 bp, Homo sapiens
ggagagagaactagtctcgagttctatttatatttttcttgtaaaaacggggggtggggctcctgctgtgctaaggctggtcttgaactcctaggctcaggtaatccttccgcctctgtctcccaaattgctggaattacaggcatgattcaccatgcctggccagaacaatttgtgttggaaaattaccctgagccatttcctgaagctcacctacacctggccatccccacagtgggagaatatcttcacgtgtatctaccggctaggagaaaaatctggggggcagaaatcaccttattccaaaagcaagcaatttacgacgacagtaagtacggatgttctcgcagcggacgatcgtcaccgccataagcggacattgctcctaataacacaaagtagaccgacttcggaacacacaccaaaggcgagaggaacactccacccctcctagaactccccagcgaaatcactacaggccctcatgtgagaccaaaatctacaccctcgcgacaaa

SEQ ID NO: 677289 - DNA, 697 bp, Homo sapiens
  misc_feature (265)..(265): n is a, c, g, or t
  misc_feature (395)..(395): n is a, c, g, or t
  misc_feature (514)..(515): n is a, c, g, or t
  misc_feature (607)..(607): n is a, c, g, or t
  misc_feature (610)..(610): n is a, c, g, or t
  misc_feature (616)..(616): n is a, c, g, or t
  misc_feature (634)..(635): n is a, c, g, or t
  misc_feature (685)..(685): n is a, c, g, or t
gcctcctactcgtcatggtacccattctagtcgcaatggcattcctaatgcttacggagcgagaaaatactaggctatatacatactacgcaaaggccccaacgttgtaggcccctacgggctagtacaagccttcgctgacgcctattaatacgtctttcaacaaagagcccctaaataccctggcatcatctaccatcaccctctatgtcactcgccccgaactttatctctctagcatcgcttcttctactatgaacgcccngctttaccgatagccaattcgcccttgtgtctagagcgtcatagccataggtcctccataattgtattcatagacgcaacctcgtatgcctgatgcgcgttatacatcgaatgcactctgatcatgggtngatgcatccaaatctcataagctacgccactgatgcggctgcacttggcgaagtcagtgagcccgagaacgacatctgcactattgagagtcagccgctgagccgatcagtgtctacgnntatcaacgaattactgaagtaatggctggcatccttgtatagcctcatccaacgcgcttaatcaaactaacgaacagatggagacagcctcnttngattancgtcgctgcccgatcganntgatcccttggggccccatacatcatcgcatctgtagtcatcgcgaactnacttaaaagcag

SEQ ID NO: 677290 - DNA, 1182 bp, Homo sapiens
  misc_feature (49)..(49): n is a, c, g, or t
  misc_feature (81)..(81): n is a, c, g, or t
  misc_feature (83)..(83): n is a, c, g, or t
  misc_feature (89)..(89): n is a, c, g, or t
  misc_feature (107)..(108): n is a, c, g, or t
  misc_feature (178)..(179): n is a, c, g, or t
  misc_feature (181)..(181): n is a, c, g, or t
  misc_feature (184)..(184): n is a, c, g, or t
  misc_feature (205)..(205): n is a, c, g, or t
  misc_feature (211)..(211): n is a, c, g, or t
  misc_feature (232)..(232): n is a, c, g, or t
  misc_feature (249)..(249): n is a, c, g, or t
  misc_feature (312)..(312): n is a, c, g, or t
  misc_feature (324)..(324): n is a, c, g, or t
  misc_feature (389)..(389): n is a, c, g, or t
  misc_feature (412)..(412): n is a, c, g, or t
  misc_feature (451)..(451): n is a, c, g, or t
  misc_feature (487)..(487): n is a, c, g, or t
  misc_feature (513)..(513): n is a, c, g, or t
  misc_feature (593)..(593): n is a, c, g, or t
  misc_feature (657)..(657): n is a, c, g, or t
gatgccatctgtgagcacgctgtgggcaggtgggagcttgattctcagnactgggggatctgttgtgtacgtgaagagagntnaggtgntgggagatatagaggggnnctgcctggcccccagctgtgtgtacagagaggtcaagcccaggagaactgccccgtgcagactggtgggnncnctngtagagatggaggaggaggcnattggnttggcgctaggcatacaagtnggggttgtgggtgagcnagtgcacttggcctctggattgtgggaattaaggaagttactcatcctcttgaagatgctganacaggagagaanggggatgtatccatgggggcagggcataacttgtcccatttctaaaggcctcttctcttgctgtntcataccaggccgccccagcctntgagcccctggaactgctgcttcttaaccccagtaagcnactgccacacttctaaccctctccaccccatagtgnccggctgcttttccctaagcctaggncctcttgcggtcccatctaactaacacacaaaatgtacccagtattctaggtagtgccctattttacaattgtaaaactnaggcacgagcaaagtgaagacactggctcatattcctgcagcctggaggccgggtgctcagtgnctgacacgtgtccaccccagtgcacccactctgctttgactgagcagaactggtgagcagaactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttacacatgaacaggagatacatcaaaggcctcaagttcaaccttcaacggagaacttctgagaggcaaggaaattcaccagagcttccagcacctccatgcagcaacctcaagtcagatacaagcgatgagctggaagctgagatatgggaaatgccatgtttgtcaaaagagcaactcaggtctgctggacaaggtacacggagggatgccaaagaggctgtatggtccgaggcctttgcacatg

SEQ ID NO: 677291 - DNA, 343 bp, Homo sapiens
  misc_feature (326)..(326): n is a, c, g, or t
  misc_feature (328)..(328): n is a, c, g, or t
gctggagtatgtttacgttcttgtcatctgttcccttaagcaattcctaattctaatatgtttttgtatcttacagatagaagtatgtgaagaaaaagcttcagctgttcttccccctacctgtatacagcttcttgacagcagtaactggaaagaaaggctggcttgtatggaagagttccagaaggtagtgcatagggaagaattgagtgtgaaagaaaattagattatatggaagcagcgaaattgatgaatgaaggatttgtcctaattgctgtgttttataaccggtgaacacgttttatggcattaaagatgaggtgggncnttttaaaaaaaaaaa

SEQ ID NO: 677292 - DNA, 482 bp, Homo sapiens
tagctcggtaccgacgctctctctgtgcgggtggatgagggtcagactgtgtggagggcttactggggttaatgaagcagcagtccgagtgtgcctcagacggcggtggtgcgtgctgatgatgacacagtcaaggtagaaaggcctatgagaaatgggagaaagtcatggccctgtcccccatgaatacatccgcttgctctcctgtttgcagcatcttcgagaggatgagtcatttcgttagttcccacaatccagaggccaagtgcaactggtcacccacaacccctacttgtatgcctagcgccatcccaattgcctcctcctccatctctaccagcgtcccctccagtctgcacggggcagtcctcctgggcttgacctctctgtacccacagctgggggccaggcagcccccctctatccctcccagcacctcatccctctccacgtacacaacagatcccccacagagagagcgt

SEQ ID NO: 677293 - DNA, 100 bp, Homo sapiens
gatgagtggtgaaaccccagaagcagctgctctccgggagcttgaagaagaaactgggctacgaaggggacatagccggatttgttctccagcggtctgt

SEQ ID NO: 677294 - DNA, 431 bp, Homo sapiens
  misc_feature (266)..(266): n is a, c, g, or t
ggcgccactgcactccagcctgggagacagagcgagactccgtcccaaaaaaaaaaaaaaaaaaaaaaaaaaaaattttgtggggcgcggcttgggccttggaaaaagttttttaaaaccatttcggttgggcgcgcgcgggggccccaagagaagggtacgtgtgagaactgtgggcacaatagcggtggttcccaataggagagagacccgggagacaggagactaagcggggttgggagttctcttccacaaattaaaaaaanagcgccgcggggggggaaaacgcgagagggttttctgggaacacaattctccgagagatggggagttcgcggaagggctcatatacggggggatcttatattcaagggggaggttccaaggagagactgtggaattttcaattttaggccccggggtgtgtggat

SEQ ID NO: 677295 - DNA, 1027 bp, Homo sapiens
  misc_feature (1027)..(1027): n is a, c, g, or t
gcccactccagcttactagcagacaagcttagccaagaccattgtacccaatataaagtatagggcgatagaaatggaaaccatggggcaagtagatatagtagccgcaagggcaagagatgaaagaattataaccgaagcatcaatatagcaaggactgaacccctataccgttcgtgcataatgaattaacgtagaaataactttgcaaggagagccaaagctaagacccccgaaaccagacgagctacctaagaacagctaaaagagcacacccgtgctatgtagcaaaatagtgggagagatgtataggtagaggcgacaaacctaccgagcctggtgataggctggttgtccaagagtagaatcttaggttcaactttaaattgggcccacagaaccctctaaagtcccctggtacaatttaactggttagtccaaagaggagacaggtcttgggacactaggaagaaagactgtgtagagagagtagaaaaatttaagacccatagtaggcctaaaagcaggcagccaattaagaaagcgttcaagctcaaagacgcagtagctagaaagatgcgaaagatatgatgaagtcctcagagccaattggaccaatctatcacctatagaagaactaaggttagtataagtaaccatgagaacgttctcctccaattagactggttcggatgaaacactggactggccttaacaggccaagtatctagagtcaacaacaagtcatagtacctcatgtgtaacccaacagggtaggccataggaaggtgtcacaggtacaggaacggaaattaaccggggtaccagactacctcagatacagataagggccgctgcaaagccaggtaaagggcgaccaacgggaagagaaaaacggccaaaagcgcgtgaggtcaaagggaggctataaaagaaaacggaaaggtaacagaaacgggaataggacaccggctagtaggcgggtaccagatacacacctgcgcgcacacatatcatcattgacgan

SEQ ID NO: 677296 - DNA, 850 bp, Homo sapiens
cgcagtggctcacgcctgtaatcccaacactgtgggaggccgaggcgggtggatcacctgaggccaggagttcgagaccagcctcgccaacagagtgaaatcccgttctactaaaaatacaaaattagccgggtgtggtggtgcatgcctgtaatcccagctacttaggaggctgaggcaggagaatcacttgaaccctggaggtggaggttgcagtgagccgagatcgtgccactgcactccagcctgggcgacaagggccagacttcgtccccccccaaaaaaaaaagggctggactcaggggctcatgcctgtaatcccagcacttcgggaggccgagatgggcgaaatgcttgaatccaggagtcgagaccagcctgggcaacaaggtgaaacctatctcaaataaaataattttttacaaaattttaaataaataaataaaacaataaaaactagcaaaaccagaggaaatacttataaattcaaagtaagcctccccgggccaggcacactgggctcttgcttgcagtccagcactttaggaggctgaggcagaaggatagcttgaacccaggagtgcaaaaccaagccctgggcaaaactagggaaacccgtcttcctacagccagtttaaacacaaaagaaatctcgccgtggtggcgagaggcctggtacccccgtgctggacgcgggggaggaaatttgaccggaggggaggtcatgactgatggctagcgaccatgggaaagcaagtccctggaaaaaaaaaaaatggcgcccccaatataccgggccgcataaaagaggcagcccgcaggtcaccacggcaccacagggtgcaacgcg

SEQ ID NO: 677297 - DNA, 145 bp, Homo sapiens
gaggagaaagcagaccctgttcccatcctctgttttttcccttgctaccaattcaggcccacgctcatgcacattctctgagaattatgtacataagtacctgatctctcctggatgtaagctgggtgggcttagcaggcagagg

SEQ ID NO: 677298 - DNA, 145 bp, Homo sapiens
ggggcaaggagcttgcgcgggcccgcgctcgggcgggcgaactgctcgcacaggtggggctcgagaactgcgcggaccgccgcccccatcagctctcgggtgggcagcgtcagcgcgtcaacatcgcccgggcgctcatgaacag

SEQ ID NO: 677299 - DNA, 254 bp, Homo sapiens
agacacaggctcaagatggagagatagaaaaaaaagtttttttaattttctttttttgagacagcatctcactctgttgtccagccagagtgcagtggcaccatcgcagctcaccgcaaggctcaacatcacaggctcaagtgatcctcccacctcagcctcccaaatagctcagactacaggcatacgctactgcgccctgctaattttttgtattttttttgtagagatgaggttttgccatcttgagcctg

SEQ ID NO: 677300 - DNA, 832 bp, Homo sapiens
gagcgggactgcagccagccccctggggcgccagctttggaggcccccgacagctgctcgcgggagccgcctcccgacacccgagcgccgcggcgcggtcgccgctcccggcgcccggctcctggctcgctcgggtcatagagaaggggattaaggaggatgaagaagaaggttgatgaaaaaagaaaagaatagagtcatacaagcacagaaaataaaaagaaaagaaaagggatgatgagaagagaaataattaaagataaagaaaaaagaaatagaaaattaacaagaacaagaagaaaaaaaagtacgaaaacaatacaatcagtaacagccaccagaaaacaaaaaataataaatagcgccacaaaacagcacgatccaaagaagaaaaagagaaacaaatacaaacacaagagacacaaaaggagaagaagaacgaatagagaggagagaataggacgaacgaaatgagagactagaagaacacagcaaggaacacgaagaacgaaaagaaaaaagaaagaacgggacaaaaaaacaacgaaacaagaaaaaacaaatagaaggaaagaaacagacaagaaaaagcgaacagacaagaacagaaacaacaaaaacagagacacacacaaagcacccccgacaatccgaacaaccagagatagagacaacagaaaagaaaagagcacaggagaaaaaaaaaagagaggaacaaaagaagaaacaacagaagaccaacaaggagaaacaagaaaggaggcaaaaaagggaaaaagagaaaagagacacaaaaaaccaaaaatgacacaccacaaaaaaacaggaagaa

SEQ ID NO: 677301 - DNA, 144 bp, Homo sapiens
gtggaatctacaggatccccattatggacttggactgtgagagcttctaccccattgtgtaggcctctggttgatgcctggcctctgctgtgggtgaatttctgtactggaagggagtggggctccttttacgtttctttaaca

SEQ ID NO: 677302 - DNA, 138 bp, Homo sapiens
accgccgatccttgcttcctgctctggaatcgtggcttgtagttcctgttttgttgtccgtttggatctcttctccttctgttccttcttctttcttaatttcttgcctaatttcttctcttttcctcctgtttgttt

SEQ ID NO: 677303 - DNA, 180 bp, Homo sapiens
gatcagcacgttgggaggctgaggcaagaggattgcttgagcccaggagtttgaggctacagtgagcagtgagctgggatagcccactgtattccgcctaggtgacagagcaaaactctgcgtcaaaagaaaaaccaaggctgggcacagtagctcatgcctgcagttccagctactcgg

SEQ ID NO: 677304 - DNA, 130 bp, Homo sapiens
cggctcggcaccccacacttgtatgaagggcacagtcagagcttgtcctgttaagtgcacatggtagtcgaaacaactgccccttttctgtggggaaattgccccaggccaccgtgctcttccagatatg

SEQ ID NO: 677305 - DNA, 102 bp, Homo sapiens
tcgtgcagaagatccacctcaattcaacatgcagatatcatttattttcttatatgctgattctgaggtgatcttcttcacgataggtgatcttctgcacga

SEQ ID NO: 677306 - DNA, 617 bp, Homo sapiens
  misc_feature (196)..(196): n is a, c, g, or t
  misc_feature (602)..(602): n is a, c, g, or t
tttacctcccccccccccccccccccctttggttgtaaaaaaaaaaaaaaaggggtgttaaaaaacaccgcgggggtgggggggccccccttttgtttgtccccccaccaagggggggggggcgcgcccctctctttttataaaaaaaaaagggggggggggggaggaacctccccctccccccctcggggggggnttttgattataaaaaaaaaaagcgctccccccccgggggggttgtctccccccccccacgaggggggtgttttttaaaaggggggttttttttttttttctcccccctttttttttcccccacaaaatttttttttttaatttaccccctcattccccccaaaaacccctttttccccccccaaggggggggtttaaaaaggttttttttttgggcaccttttaaaacggggggggaaacccccccaaattccccccttttttaaccccccgggttaaacttttttttgggagtttttttggcccctttcccaggaaaaccaccccggccccggaataaaaaccgctgggggttttagcaaaaaacccctcccttataaaaaaggtttggaagaggggtgggtatnctttcccctagtctg

SEQ ID NO: 677307 - DNA, 425 bp, Homo sapiens
ccggtaccgcagtcttctcccatcagcatctaaattctatgtcctgttaactttctcatgacacactgttttttttacctccacagtagcattaagacatgcatgcattcacttaaacagtcattgttaaatatattattccatcacactctacattctatgaggtgactacagtcaccactatattcccaatacctagcacagtgcctagtacaagatatacattcaatattttcttttttaaaaaaaacattttccccccgggcgcggtggctcgcgcctgtaatgccagcacttggggaggcctaggtgggagtatcacttgagcccaagagtttgtacaccaggctaggcaacatagtgtgaccccatctctacagaaaaagagaaaaaattgaacaaagaactgatgggagcaagatgcg

SEQ ID NO: 677308 - DNA, 957 bp, Homo sapiens
  misc_feature (3)..(4): n is a, c, g, or t
agnnctaatgattataaatcaagcagtccatcatacaagagacaacaacaaaatgaggtcgtcggcgctggaccccggagtgctgaatatagtgcctataatctgcgctccatcacgacaagtgcttgcacaaaggttgcatctgttcccaggatgcctgcccatcacaacaggggtccaactcctcctctggggtatcctaacgtgtcccgtggatttccttcaccccgtcgtggctgatatatgttcgcacgataaacatccaggctgtcgagcctacctagtatggaccccctataacccctgtggggggtaacccccgcgatttgaacgacagggttgtgaccccgaaaaacatgtggacaaaagttggtgccgcacccagttgttggtagcccccccgggtgggccggccccccattgctttgtcggcgtcacaatgggatgcaaccccaccggcgcatttcccattcaccgcggattattatcgcccctaagtccaaatggagtgggtgaattcctgtgtcgcgccccccacccccggggcaaccctcgtgttgactcaactcccggatgggtggagttcccccgccccatgtacgcgcccacgactctataactgtcggccgtctaatatgaggaaactgcccccaccccgcgcctgaatatataattaaggggaaaagccaaattatatgcgtcttaaggcacataatggtttgcggagggcgccaaaagagggtgctccagtcaaaattaatcggcgttttcctcatatcagggggaaataaaaccacttagtacacatgtgatgtgggttaaaggcggccccacaccttgagaaaaagataccattagacaccaccggatggtagatacacttgaaatgtttcacacggtgcgggcgaaaagatttttttccccagtgttataaaaaaataaaactcccacataaca

SEQ ID NO: 677309 - DNA, 106 bp, Homo sapiens
cgactcgtgaggatcccctgcctgctgtcgctacgaatggtttagggcacggaagatcaaggcacgttatagatcaaggcacggaagatcagggcacggaagatca

SEQ ID NO: 677310 - DNA, 124 bp, Homo sapiens
cttatttgctgttcttaaattccttcccctaccacttcctcttgggcttattattctcttgttgatcaatctctttcatgtgatactttacattgaatcatctcgactcctttatcccatcctt

SEQ ID NO: 677311 - DNA, 1172 bp, Homo sapiens
  misc_feature (97)..(97): n is a, c, g, or t
gaaatctgggtttagaagtgtgcaacctgaaggtttatagtccgtatatctctactcgaggagctgtccgagatacaatctcccataattgtatggntgacctacgtactcgtgaagtacaataacgaatgcagtattagtgagtactagatatggtatgggtgcgttgcagtttcatgtatatacaatatgaggtgttggcgtagtggtatgatgagtttgtgagtcactgtaatatttttacagtgaagaatgatgacaggttaagacatggaagctatgattttacacacttcacgtggtgaagcagtgaaagttactctagatattagcaggtagaacggggtaggtgaagaaggtactactagactgaatatgcggtacttaagcgtccgtcgggtaaagtacagtatgtaaagagtgagtgctgtacttttacgtatgactgcatgtatggctagcgtatgggagtgtacagttcgtttgcttgttgatctagtcagtagatgggttgaaggcctgtggaacaatgggccgatttgggaattataggacggaaaaggctcattcaatcgtgagaaacaacttcaggtactttacgacgctgacgactcagttatcggatctgttcgttagacatcgacatgtttggtgttaactggtttcaatagtcgattataagggatgccatggttaattgttggcccagaattcgatggatgcgttaagaggaggtaagccaagttatcgaaacttggtagatgtttcctcactttaattactttctaagtgggcttagaggacacctattaagaacagtggaatcctcagtttacggtgtcggaagagacaattacctgattctgttgaacataagagtggcaattgaattctccaacttctgacgccgcttgaactatgttcacctcagagacgtgtttctgtcttgccacagaacagataagcaacctattaccgtccgcggggcccctaagttaccgtggttgcaatggccccgcgttacacgattgctacacttgcgggaaagcggtatcaccctcgacgtgaaattgacgtacttatgcgaaaccccacttgggtgtcacaaactgtgttccataaatgaacattcattgtatcagggctgtcatctccacaaaatgtctatccga

SEQ ID NO: 677312 - DNA, 109 bp, Homo sapiens
atcagaggatcccccagaggcacaaggaggcagaggcaccaaggagggcgagaaggtttacatactggcgctgaagggctgaggtacgtgctctacggccggtgtgacg

SEQ ID NO: 677313 - DNA, 193 bp, Homo sapiens
  misc_feature (181)..(181): n is a, c, g, or t
ctgtacagatattactaatttgatgtcatcatcattcttaaagatctgagtttcactgtagtatatactatcttcagcatttccggtagcacaatttgatggtgacaaattttatcagttttcctttttctgaaaatattttcatgtaatgtttattcttagagaatacagaattctatgnctttttctttct

SEQ ID NO: 677314 - DNA, 672 bp, Homo sapiens
  misc_feature (89)..(89): n is a, c, g, or t
  misc_feature (386)..(386): n is a, c, g, or t
ggggtttcggggcgagcgtgggcgccgccggccggctgggtgctcggtccgactcagcggtggggagcgagccaggctcccgccaccgntgtgccgcaccactgcgtcgggctggtgcagccccgggccaggccgcgccggggcaggagcgcaggggttgtgttatgcacctaaaagccatatgtgaaggctccagaagaaaggagcaccccccggaagttcagcagggaaaaaggcagagaattcttatgaaccaccaaaaagggcgtgtacttgatgaaactgtgcaaaggttagaccaatataactatcaaggtgtgtctttccttcaggcctctctgcggtaaagcatcatctcggaaaagccatgtggggatccttttctnccaaatgttctgtgcagtaatgaggtgggaaagagtcctgtagagaggcagttggaattggtaaaaacaaaaaaatgaatgtgcacctattctttggcagggattccaaccagggggggaaagaaagaaagggaccactgtgaaatatttctgggctggtgggtggaacgtgggaaaattcccaagggacaaacactggctttcttggggattcccaacaggtgtaggtaccgggatagggatctatggacaattaaaatgtccctggatattgatgggaggagca

SEQ ID NO: 677315 - DNA, 164 bp, Homo sapiens
aagctaagctggagctgctctcatccctccaccaggagggacttcactgtacatctttgggccaagctgtctcaatgaatccgccatggaactgacctgttgtgatgttgtctgccaggattcccaatgctttcactcttatctaccctttggcccttatcgag

SEQ ID NO: 677316 - DNA, 566 bp, Homo sapiens
  misc_feature (94)..(94): n is a, c, g, or t
  misc_feature (358)..(358): n is a, c, g, or t
  misc_feature (365)..(365): n is a, c, g, or t
  misc_feature (395)..(395): n is a, c, g, or t
  misc_feature (418)..(418): n is a, c, g, or t
agaaaagtcattattcccttgtatttcagaatcatgttaatgaggtagcttaactgctattcagctgcaggctcaactgagtgaaaaaggacanctagtaatggtaaactgaaggaaagactagtggaatcttgagaaagaataagagaaaaaagagaaatgttattgttttgatattacagattaagctaaccacagtacctgattcttagcaggtgcacaataattatttagtcaataattaatggagcaaatatttattaagtaacattgtatgtctgtgctgtctattgaagaatatacaaaagaaacctgaggctgggtgtggtggctcacacctgtaatcccagcactttgngaggctngacagaaggagcacttgagcctaggagtangaagaccaacctgggcaacatanggaaaccctgtctctaccaaaaaaaaaattagccaggtgtagtggtgagcaggagggtcactctagcccaggaggttgaagctgcagtgagttgtgatcataccactgcactccagcctgggtaagaaagagagcaagatcttctctt

SEQ ID NO: 677317 - DNA, 239 bp, Homo sapiens
  misc_feature (71)..(71): n is a, c, g, or t
tctcttgaaatgtgtgtcatttctagaaaggattggtttgatctaaaaataattttaattggaaaaaaaanactaccagaagcagcatcagatgactagtagaagcaggaattaacatttcaaaagatagcaaaacaccccgaaattgtatggttagcaattatatgttaataccttatatattttcattcttttaggaaatttgattttgaataaaccaaagcagattacttcttaaa

SEQ ID NO: 677318 - DNA, 1150 bp, Homo sapiens
tgggtttaaatcggcaccagggagcgccatttaaattgagatgctgtatgtaagccagggttcagcaaaggttcagcctgtgacctggtgtgtgtgtgtgtgtgtgtgtgtgtgtgtgtgtgtgtgtgtgtgtgtgcgcgtgtccctgagtaaagagtggtttaaggcgtgtataggattaaaaaaaaaaaaaaacccaaaaaaaagtgtgggcccccaaaataaaagcccgcttacaaagatagtgtgggcgcccccgagaactgtcctcgccgggaaaccagagagtgtgtcttctgatgacacacgtcgtggctcttcacccccaggggtgggatgctgcaagggggaagatgaatcctcagtcgtcacgtgaacgccctccacccgccgggggtacaaagaaatttcgtgccatcagcctccatgatgtaaggtggggatcaaagggggtgtgcaccaacacagacagccatacttatcacgagggtgtacaccaccacaccaaaaaaattcaacgtatgaccccgggggatggtggggggttgcagagacccaaagtatcgattgggacgtgtcccaccagctgcgggggacgacagcagctgctgctgaaacaaataagaagtctagattgctaggcaacaaagttagggtggttctacccaacgaggaacgtctgggcaaatgcagaaaggtcatttaagcggcattactatccccctttcttattttatacacaaggggggggggaaaaaacaacctgtgtgaaaaaccaacgttttttattactattccaggagcagggggccccccaggcccaaaaaactataccattggcaggccagcggctgaacagggggggttttcaacctcggtaaacacaccacgcgtatgtcatactccacgctgaggggagacccacaccccttgtggataaagaccctgtggcgacaaagagtatctaagacacaacagtcagacacctcatcaagggaaacatccgcaggcgacgcggcaacatgcgcacccgaacaacatcatataggaacacacaaccggcaaacaacaagtggcgacagagccagacaaggcaacttattaggacaaccccaaaccagaagtatatgagagtaccaacaaagccacg

SEQ ID NO: 677319 - DNA, 91 bp, Homo sapiens
atcagtaacatgaagagccctcaaaaattggcgaatgtcatcagtgttttaaacagaataaagattccgaacactttgaatagaaaaaaaa

SEQ ID NO: 677320 - DNA, 126 bp, Homo sapiens
  misc_feature (117)..(117): n is a, c, g, or t
gctgtggtcacttgcctgcccaggcagctgtttgcagctgaagaacaactggtctcaggctgtcttgcctttattcctggttagggccaggtggtcctagacagcagtttccagtanaagctgaac

SEQ ID NO: 677321 - DNA, 297 bp, Homo sapiens
gaaaagcaaaggaaggcattcccctttttcatttttttccttgggggggcagcttttcccagtgatgttgagagcccccgcagcaatttggtccccagtggcccaatttcccccaaccccaaaggaaagcaaatccctgtgggggcagggttaatggcatccaaagtccattttgggggttgaggtggaaggaaatcccccgggccccccgccaaaatttatcagctttcagcccgggttttgttaaccagccagggggtattatttcaaaagcttcaataaaaaaagggtttgcca

SEQ ID NO: 677322 - DNA, 832 bp, Homo sapiens
  misc_feature (44)..(44): n is a, c, g, or t
  misc_feature (62)..(62): n is a, c, g, or t
  misc_feature (106)..(106): n is a, c, g, or t
  misc_feature (117)..(117): n is a, c, g, or t
  misc_feature (129)..(129): n is a, c, g, or t
  misc_feature (150)..(150): n is a, c, g, or t
  misc_feature (161)..(161): n is a, c, g, or t
  misc_feature (166)..(166): n is a, c, g, or t
  misc_feature (203)..(203): n is a, c, g, or t
  misc_feature (216)..(216): n is a, c, g, or t
  misc_feature (277)..(277): n is a, c, g, or t
  misc_feature (307)..(307): n is a, c, g, or t
  misc_feature (323)..(323): n is a, c, g, or t
  misc_feature (338)..(338): n is a, c, g, or t
  misc_feature (358)..(358): n is a, c, g, or t
  misc_feature (367)..(367): n is a, c, g, or t
  misc_feature (393)..(393): n is a, c, g, or t
  misc_feature (412)..(412): n is a, c, g, or t
tattatagactgttttcacgttatttttaaagaggaagaaaaanctggttggttaacgactncactcgattctcgagtggacacattttggtactacgccaaggtngagctggttcntcccacccctgntgagatccctagagctattcngagcctgaaanaaatngtcaatagtgctcagactggtagcttcaaacagctcncagttaaggaagntgtgctgaatggtttggtggccactgaggtgttgatgtggttttatgtcggagagattatnggcaagcggggcatcattggctatgatgtntgaagaccaatctttnacatctgattatatntgatttattatttgagtgtngttggaccntgtgtgatcagactgctatctgaatnaaataagatttgtcaaaantcagtgtttcgtccatcagaactgcatgagaggtcacaatttctcttggtattaatgcttgggttgcttgtaacaaccctaattacacgtctgtttagcccgaaattggaaaggatatatggtggctttattgacccggtccttgatattttggggatacctttttactccaaagggttggaattattatatctaaaccttaatttgccgaacactgagggctaagggcttgggaaaccttccctggcccaaggtgaaaaatatttattccttatgcatagggattaaatccatgcagataatctttaaaatacaattgaaacgtttctttgggtaaaaaccgaaaagctctatgcctactctgtggctatgaaaagtataacactcggtatcttagtttagcccaaataaaaagcctga

SEQ ID NO: 677323 - DNA, 877 bp, Homo sapiens
  misc_feature (151)..(151): n is a, c, g, or t
  misc_feature (162)..(162): n is a, c, g, or t
  misc_feature (174)..(174): n is a, c, g, or t
  misc_feature (195)..(195): n is a, c, g, or t
  misc_feature (206)..(206): n is a, c, g, or t
  misc_feature (211)..(211): n is a, c, g, or t
  misc_feature (248)..(248): n is a, c, g, or t
  misc_feature (261)..(261): n is a, c, g, or t
  misc_feature (322)..(322): n is a, c, g, or t
  misc_feature (352)..(352): n is a, c, g, or t
  misc_feature (368)..(368): n is a, c, g, or t
  misc_feature (383)..(383): n is a, c, g, or t
  misc_feature (403)..(403): n is a, c, g, or t
  misc_feature (412)..(412): n is a, c, g, or t
  misc_feature (438)..(438): n is a, c, g, or t
  misc_feature (457)..(457): n is a, c, g, or t
cggatcggggctgatggactctccattgccagaaccatgggccacgttgtccgtaaccttgtggagaagacccgcggtgctggtgaacgcggctgtgagttagtcgaagcctcgaatggggcacacttatggtgtaatctacgccaaggtngagctggttcntcccacccctgntgagatccctagagctattcngagcctgaaanaaatngtcaatagtgctcagactggtagcttcaaacagctcncagttaaggaagntgtgctgaatggtttggtggccactgaggtgttgatgtggttttatgtcggagagattatnggcaagcggggcatcattggctatgatgtntgaagaccaatctttnacatctgattatatntgatttattatttgagtgtngttggaccntgtgtgatcagactgctatctgaatnaaataagatttgtcaaaantcagtgtttcgtccatcagaactgcatgagaggtcacaatttctcttggtattaatgcttgggttgcttgtaacaaccctaattacacgtctgtttagcccgaaattggaaaggatatatggtggctttattgacccggtccttgatattttggggatacctttttactccaaagggttggaattattatatctaaaccttaatttgccgaacactgagggctaagggcttgggaaaccttccctggcccaaggtgaaaaatatttattccttatgcatagggattaaatccatgcagataatctttaaaatacaattgaaacgtttctttgggtaaaaaccgaaaagctctatgcctactctgtggctatgaaaagtataacactcggtatcttagtttagcccaaataaaaagcctga

SEQ ID NO: 677324 - DNA, 1279 bp, Homo sapiens
  misc_feature (279)..(279): n is a, c, g, or t
acctttctctgccgcaggctccgcctttactgcgtctccaacgggttgagcgtctgtcggatcacgacacgtctggggtgggggcccgggtgacgcctcccgccgtcttatagggctccggccgacgtggttatgtggtccccgctttttctgccattggcagggtatttggtggtgtctgtcattaactgcgtgtttgttcgggccccacctctcttagttcccggctgatcgcccttttggcgcccgacttatggtttattcgtgttacccgtaatnacacagcgcggaaacaatcggcgtacggactgtcttttcgtcggggcgtttctcgccaaatcagtgggagcccatttgcccttggtggattccagcgctgcttccgcatattccccctcggctcacgggggtctcgccttccttctcagggctacagcggcgggctaatctggtgatttggtcttattgtccgcactttttgttgtgcggggcgtactttcccttttgggcccgcgctctttcttcctggggcacaaattgtgttcttgtctctctggtgtaacacggcgccgtgtagtgtcgttattaggcaccctctttttacgtggtggggcacatgtgtttttgtggagggcatctctttcatgtggcgcagaaacgttgggccccttcgcacggtgggtcgctcctccttcgctttggggaccactcctgtcagtgggttcctcttgttcccatgcggctcactgcggattggtgcctttgggtgtttcccttgacgtggacaggaactgtctatgccccttttcccttcgtgcgtattttattgcccttctctcccctggcagctagaggcatggctgttctttttggacttgcgttttcgtgttggtgctcttgtctggaccagtcctttcatgacccttcctcgatctctttcttcggagtcctttatctataagtagctctcctagctcgccgcgcgacgcgcgcgtgatggttgcgagctgtggacgggcccgctggtatagtacacgacttacctgcagtcgatttgggatcttgcctaagtagcttttacagagcctcagattctgtgtgcatgtgtgtgtttgtgtatatatacatatctagggctagtacttatgtttcacacccgggagctgggagacataacctgtacagttgtctttctcttatttttcataagatagaaaatcgcgcacttgcgcgtcccccccccccacccccttttttaatacgtgcttagctgtgccgg

SEQ ID NO: 677325 - DNA, 1299 bp, Homo sapiens
  misc_feature (299)..(299): n is a, c, g, or t
tcacacttcaaaaggttttaatgggattaaattccccaaacacggacttttatagacaatttggcaaggactctgaattttggcagggctagtttgtgggactacgggtaaagacacaaaacaaaaagaaacaacacacacacacaccacacatttcattagcagaagcgtgcctcggcggcgctacaagggccctcttggagggaaggacagttcccaaagggcacgtgcccgggtgacatgggggggcgccctggcccctgtccttcagggcgagccaggctcacaggccaggggcnccgtgctccagggggggctccaacagagaccaggataatctcaatcatctcccaggccaagggaaaccccaggcccaaaagagggagggggagggcctacagaaaggcctctggtatttacccccgagcggggggagagtggggggcgtatacgcgagcgaaactccgcgagggggggcgaggggacacccgatactgcaagagtgtatcacccgggttaataaggcagaaaaacgcctacagaggggcgcttcgcggggacatataagccatacactcccgggagagagaaaaaactctcgtttgatccgagagcgcccgagaacagaaaaaagaaacgcgggtgggtcctcccgaggtgtggtgcgcttccacgaggaaagaagggcctgtgtagaccagtgataacataccgcgagtagtgcacccgaaggagtgtctattctccgcagtgggagatagtgagaggagcacctccgccccacggagggggagaagaagcccttctcctcttagtgcagggaaaagatacacaaccacaacaagacggggcgggttccaccacaacattgctcgtgggcggtggcggaggagacacacccagcggcggccaccaacaaggaagcagaggcggggcaccaaggaggagacgacggcaagtggtggggggaccagtctccacacagatacgctgactcacagggagggccccccattgacaaacaaacccccgaggtgggagagggaaaattgtactgccgcgaaggaagaaaggagcacgaggacccatcatcccagcaccagggcaccaccgaggggggggaccctcgtctaccaccaaaaaaaacagggcccccacagtatgggggaggacacaccacgggcgagagtaggcacacacatatgtatgaggtggcacacacagcaccgggtatgacaacacacacaggtgtggagtagtgggagtgcccccgccgcggaaagagagaacaccccccag

SEQ ID NO: 677326 - DNA, 522 bp, Homo sapiens
  misc_feature (410)..(410): n is a, c, g, or t
  misc_feature (493)..(493): n is a, c, g, or t
cttcactgttggcaaaaattcagagagagctatgtcatcattttctaccaattactttagtagaccaattaaatatataaaactgttgggaagcactctaaggaaaaactaaacaacagcttatttgttatctgaatttttaggctttaagaacagttacttaacagacattgacgatgtcttgctaggcatacattttggtccttaaagtagaaatccacattttaaaacataatttgctgttagcattttgttcaaactttccccattccttctttctcaagtgtcagggagaactaagtcacatagaatctacgaaccacaattgtgtctaatagctatcccttatgtgatccagaatttttgctgtattgtagagctgatatcattgaacacaagagacccatgtngaaaatacatacattagggtcgggtttactgtatgtacttcaaaaatatggctattgtaaatgcttcacttggtgaaatatgnggagagtatgcattttcattggatatttt

SEQ ID NO: 677327 - DNA, 353 bp, Homo sapiens
agtggaagcaattcaatgggatggttcagtctctgaggtgtggattggtaaactccattgtaatgaccagtcattttactgctccactaaccccaccctggcctatttgtgccatcctttagacacaaagagatatttgcctcaaggtgggaagaatgaatgtgggtggtttctccaaggtaggtctacacttcaactcactggcaacatccaggaggaacagagaaccccatacccagataaagagctaatagtctaccatgcctcccgatgacaggatatcttatcctttccccacaatacagaaggaaatccatccatagtgaatagacacaatacctacaaaaacatga

SEQ ID NO: 677328 - DNA, 452 bp, Homo sapiens
gagagcttgtggaggccatggggcgcgtcgatcgcggagctcgtctcctcgctgctggaggtagtggctgattgctgtgcagctgacggagtgccccgagggcgccgaggctgcgtgcgtccgccagatacaaatcgcgattgattggagccggaatgggtggcagcttcgagcagcctattactcgtgcggtaggaaatctgggaacagatgtgaacgatagacctgtttgacaggagaatgaggtcggcgggccgccctggactaccagtgattggtgcagggagcaagaataccgaggcaggaggttctgtcatccatcctttaagagtctgcacatgaaacgtttgtcaagaggacctgggtctctctgctgttcaggcctctggtgggctactggggatctataatggaaagactctggtagttggaggagagcaacgtggttcata

SEQ ID NO: 677329 - DNA, 965 bp, Homo sapiens
tcccttttcatacaaacaaaaaaaaaaaataagaaaacagagagagtacgggtgtgtgatacagcaggacgatatgttacatgggcgggtctttttcacggggaatatcacttctgctgctggctcacgtgggtctcccgttgtggcctgtattttgggcttacagcgcccctgtcccaatggagtttcccccccggcattttccccccttatgccaggctgccgatgatcaggtgagattgaattgaggatatgggttaaaaccgtcccccggaggtcaagtttaaaaggaagatattgacgaaggattggccaactcccaatgagaagagtgaagcaacgtgttaaagaagacttattgaagatacccacagccattatatctaaggaaccagtggaagaccgcgtgtctgtgttaccctggagatggtggaaagatgccttggaccagcttcgaggcccggtgatgattgtttaccccctggggttgcccccgtatgatcccctccgcctggagtttgaaaataaggaagacttgtcgggaaccccaggcagggctcaacgtccattaaagaggcagaggcgccaactgtggtgggccacccaggagctgagaagatacgaagaagctttccagactacgtggggaagaatgaaaaaacccaaattatccgcccagattccagccaaggggacagggagctcccagcccgagagcctattattagccagtgaggagccagaagccagctgatgctgtactatcaccagaagaccagaggagctccagagattggaagaaaatgatgatgatgcctatttaaactccaccctgggccggataaccctgctttgaaaagacattttcatggagtgaaagacataaagtggagacccagatgaagttcacccgctgatgacacttcccaagagattagctcccctttctcctaggccattataat

SEQ ID NO: 677330 - DNA, 237 bp, Homo sapiens
  misc_feature (166)..(166): n is a, c, g, or t
  misc_feature (202)..(202): n is a, c, g, or t
  misc_feature (220)..(220): n is a, c, g, or t
  misc_feature (222)..(222): n is a, c, g, or t
  misc_feature (225)..(225): n is a, c, g, or t
  misc_feature (227)..(227): n is a, c, g, or t
tatcataacagaggtagttttaaaaaaatcattacaggtgtgagccaccatgcccagcctatttgtcacattatttgtcacatttattttacttttatttattttttgagatgaaatttcgctcttgttgcccaggctggagtgcaatggtgcagccttggctcantgcaacctccgcctcccagggtcaagcaattctccngcctcagcctgggcaatngncangnctcttgactc

SEQ ID NO: 677331 - DNA, 127 bp, Homo sapiens
  misc_feature (113)..(113): n is a, c, g, or t
cccgcagcacatatagtagccaatcttcccgaagagcaggccatgaggacccgccaatcatcccgacatgcaagggtacatgcaagcccggtacatgggtacatgcaacccgntacatgcaacgggg

SEQ ID NO: 677332 - DNA, 852 bp, Homo sapiens
cacggtggctcatgcctgtaatcccagcattttgggaagccaagcagggcagatcacctgaggtcaggagttcgaaaccagcctggccaacatggcgaaaccctgtctctactaaaaatacaaaaattagccgggcatggtggtacacacctgtaatcccagctacttgggaggctgaggcatgagaatcttgaaccgaggaggtggaggttgcagacagccaagatagcgccactgcactccagcctgggcaacaacagagcaagactctgtctcaaaaaaaaaaaaaggaagaaaagaaaaaaaattggacaaaacaaaaatttacagcccagaaataatttcacctatacttgaaattttggtactctgatacaggtagtatttcaaaccaataatgtggagacaagagactattccccttgggataaaagaatttgtagatcccaatttttcacacctgaacaaaaataaatttcagaacaactcaacttttgaacttaaaatttacaccttatagaagtctagaagaaaccattaatcatattttattaaatcctggattggagaaaggcccccctcaaccattgtagccggaatcacattatctcagtgaaacgactgatggattccgactactttaaaatcaaactttctctattgcaagaatatatacttaggaaggcaaagtcggctggtcacccatgggcaaggccaggtccttgtatcaccatcttaaaattggttattacctatccttagtcataagaaagcgaatccccttaaatatccgtttaaaaaacggccgcgataggagacgttttaatacacaactggcggcacggcacgtac

SEQ ID NO: 677333 - DNA, 406 bp, Homo sapiens
ggaggtgatctagaggatccctcttctacgtttcatcactggtcatagagaaatgcagatcaaaatccacaatgagataccatcccatgcagttagaatggcgatcgatcattaaaaagtcaggaaacaacagatgctggagaggatgtggagaaatagcttttacactgttaatgggagtgtaaattacttcaaccattgtggaagacagtgtggcgattcctcaagggtctagaaccagaaataccatttaactcagcaatcccattactgggtgtatacccaaaggattataaatcattctactataaagatgcatgcacacgtatgtttattgcagcactattcgcaatagcaaagacttggaaaccaaaccaaattcccatcagtgatgagacgtagaagg

SEQ ID NO: 677334 - DNA, 130 bp, Homo sapiens
tcataagtttctctcatcatgaactcttattaatatttactgctgtcagagaaatgaatgagcctacagatgataggatgtctcatgtaggtgtatgcatcgcgggtcgtccgagttacgtcggggcatt

SEQ ID NO: 677335 - DNA, 516 bp, Homo sapiens
gcaatatattagtgttttgttgtttttttaaataaagtgtatattatttaaagatcctttgccctagagtatccgggtcttaaaattatagaaaggtactaatttttaccaataaaattttttttctagtacaattggcataattgtcattagcataaactttccgaagtagaaatgttgaagctacctagtatataatacagtcaaattcttggctctactgctgccaactgtattttcaaataacttttttctttcacctcctattttccattccctttctcctttcctatctaactctattactaggcaaaaccaagggcttctatccccaagaatggttgtgtctccagaagtgagatcagttgtaaattctcttttgctaagtgtagccagctgtagtaagtacagtacctccaatctgtgtgttgcttcttgcatagcaggagttttgcttgcactgactgatgtgtgaaattatgaaatctggctttgttttttatgttacatgaaaac

SEQ ID NO: 677336 - DNA, 331 bp, Homo sapiens
cattatgcatctggaatatgtatgaaattgccaacatattatatggttaatgatcctcccattcctgtcgccacgatcgctgcgctgtcagcgtctgtggtggtcagcagggtttgatgtgagtggctaccccaccatcgagatccttgagaaggggcaggctgtcgactaccagggctccatagcccaggaagaaattgttgcctcggtcagagaattctcccatcccgcctggatgcctccagcataagtcacgctagtgttggacaaagaggactttgatgcagttgtgaatgaggcggatatcattctggtggggtgtgatgcccca

SEQ ID NO: 677337 - DNA, 331 bp, Homo sapiens
  misc_feature (277)..(277): n is a, c, g, or t
tgagacaagatcttgctctgtcactcaggctagagtgcagtggcccatcagagctcactgcagtctcaacctcctggactcaggtaatcctcccacctcaacctcctgagtagctgggactacaggtgtgcatgaccatgcccagctaattttcttttttttcttttttttgtaggatatgggatctatgttgcccagggctggtcttgaattcttggggctcaagcaattgtcccacctcgggcctcccaaagtgctgggggttacagggcgtganttgctgcgcccagctgagactggggaatctttataggagccccatattcttaca

SEQ ID NO: 677338 - DNA, 1903 bp, Homo sapiens
  misc_feature (1178)..(1178): n is a, c, g, or t
ttttatatccatcctccgttgtctcgattggtggtttatattgtcgctgttcgttttgttgttgtccgcggggggtgttactcttgggggagtttgtttagccgccacgcccgtctcgtgctcactcactatggcgtcgggtttgttgtgtttcttccccgtcctctaacagttgggtggttggtatacactcccgctgcctgcttgtccgcacatatgttgtgtttgctagctgcttttttcacctactacctgtacgggtcgttgctggtccctaattatcttagcctgctgtcgcgtcttctcgcggcgtcgcgcttgtggttttgtctgctgcggggcaaccacccgcatcgggggtgtgtgtggtcgcggcccccctctttgtctttgtccccgctgaggtggtttctactgcctcctcaatcttgtccgactcgtttttggtgccccccctctgtgtggatgcaacctgtctccgccgccctgtctgtcgccctggtgccacctaagtgtcacagcgatcgggtgtctcaggttgtcacgccgcctcttgattagtggtatgtcttttctctcttgtacacggtggtgtcctcgatcggttgtccatcaaactcgtcccttccctctctctctctctgtggtggtccacgttttagcattaattactcctctcgccatctgtttgttctcgcccaccaccaacaatgtaagatttgtttgttctcatctgcgacggcgggcgattcttattggaccacccgcgggggggggcacccatctttttactatcccgtatcggggttccatctctcctcctcaccggaggtcctcccctcccccctgggggggaagacggttgtcttcgtttgtttaggtgaacccccttcttttgtggtggaacacacgcttctccacgcggtgatgagtgtaaccccgtgtgtgggcccccctcttctgttgctccgcttggtgggccaacacacacttttcatctacgtccgcgatcaccgcgcgtcttctctgtctcggcgtgctttatatttggccccacccacatatgtgcccttctttctccgcgggactctgcgctggttgacaccccacgactgctttcctcaaaacgcgcacctctcggggcccgcgcgcttacacctctttcttcaccagaagtnctacttttcccacgcgcgcgcgcgcttgttgttcacttgtcactccccgcattgtgtctcctctctctctcctcgcccactgtttttctgtgtggttctctcggtctctatattagagagtgttctctctgcacacagtgatctctttttcttctctccctgcacactatgcgcttctcacacgcgtcgtgagatgagaagatctcgcgagcgctctcgagattatacatccatacagagagaaagcgagagatctacatagtagagataatactttgtgttctctctaagaagagttcactcttttctctcgtgcgctcgcgcactttctcacgacgccctctctgggcccttctctctcctctcacacaccgctagagatggcactctatgtttctatgtttttgcacacgaggtgctcctgcccctcagtgggcccctctctgtgctctctcccacatgccctctaagaagaagaagtgatggggacggcacacggcccgctcaccccggagaaggctgctgttgcggcgggaacactaccgaaggtcggtcggtggaccacgagaaaggacacttgggaaaggggaagcgagaaattcgctttttctcttcctccctgggccagaatagtagcttttttgcttcactgtggcccgcctccttcctggatccttagatccccgaggagggtaagaaaatttgccgtgacctgaaaaccagta

SEQ ID NO: 677339 - DNA, 177 bp, Homo sapiens
tgagaccctgtctcgcgaggagatggaggagctggagaaggagctggacgtggtgacccagacgggagtgttcccgtgcggctgcggcagagaaaccagacggagaacagtcccgggtgttacaaccgggagccatgctcaacttctgtgaaaaggagatcaagagcgactaacagg

SEQ ID NO: 677340 - DNA, 164 bp, Homo sapiens
tgtcgcatctcacagcttccccatcatcccaggttaggctctctctctagctctctttctccctcccctaccagcctcattcttcctccggtagccaagcgtggactagtactagtccacggtaggctaaggttctcctccagcgtactaccagacaaccttag

SEQ ID NO: 677341 - DNA, 386 bp, Homo sapiens
tataacacgcataatatagcacgactaacccctataccttctgcataatgacttcactagaaataactatgcaaggagaaccaaagcatagcaccccgaaaccagacgagctacctaagaacagataaaagagcaccacccgtctatgtagcaaaatagtgggacggtatatacggtagaggcgacaaccctaccgagcctggtgatagctggttgtccacgcatagcatcttagttcaactttaaatttgcccacagaaccctctaacatccccttgtacaaatttacactgttagtccaaagaggaacagctctttggacactaggaaaacaaccttgtagagcgagtacaaaatttaacacccatagtaggcctaaaaagcag

SEQ ID NO: 677342 - DNA, 274 bp, Homo sapiens
gcccgctttacagatattcaaggccggatatcgggatatctgctatgcaacacagaagcgccaatctgcggtaagggacttgagcaagctggtcgacctgatcctggtggtgggcgccgccaacagttcgaactcgaaccggcttcgtgaaatcggcaccgaggccggggttgcgagttatctcattgccgacggagggagcttcaatcccgacgtttggtcctagctggggttaggttaccttgggttacggtctaccctgtggggtaccaga

SEQ ID NO: 677343 - DNA, 173 bp, Homo sapiens
caaggatccgatatgcgttcatcagtgtcatcatatttgatttcttatctcacatagtcggatcttttgccaggtcactaaacaggaatcgggtatcatctgttgacccagcagcaggtcaatctctttcggcctttcctatgtccgcagcttttcattctttagaacagcta

SEQ ID NO: 677344 - DNA, 961 bp, Homo sapiens
gggtctgaatctgagacggttcgtgaggaatgtgcgtccgggttgcttgccggtgctggccgcgtcgggagagcccggggcagagcagaggtgctcatcagcactgtaggcccggaagatgtgtggtcccgtcctgacccggctaaggtccctgtcttgcagctggatagcggaactactcttctccatagtgcaatctgccgatatatatatattcgagtaatctaggctgggagcaagatgacctcactaaccagtggctcggaatgggaaagcgacagagctgcagccagctttgtctgctgccctgtactatatctagtggtccaaggcaagaagggggaagatgttcttggttcagtgccggagaagccctgaatcaacattgaccaaagcttgagtcgtcaggaactgtcctttcctgcgctgggcgagacagaatctctagccgacattgttttgtggggagccctatacccattactgaagatcaccgcattaactaccctgaggagcttgagttggcctgaacaagcttggtttcaagaaactgagtaccaggaaccatgtacaggcgagctgctgagacttgtacttggaaaccagccaggtgtccttgggacctccgggctaacctccaaaagaagccagccagccccgaagaagggaaagagctagtcaccaaaagcgactagagagatgaggaaggtggatacccactcttggaggagggagatgccaaagggagatactgatgggaagaagggctagcaaagtaggacccgagcggccagaaaaccacgggtgctgggctgagaaaggcaggccaaacacgggcactaagaacacaggcccacctgggacaccatgcagggcacagcgcagatagcaagaacacagcacagggaaccctatggtggaagcagacaaagacagcagagggaaccaagatgaaaaacgg

SEQ ID NO: 677345 - DNA, 221 bp, Homo sapiens
ttacttctgaaagacatccactatgactgcagtgtcatgctcgtctgggtgaagagaccaccaaataggctttgtgtgagcaacaaggctgtttatttcacctgggtgcaggcagactgggtctgaaaaagaagtcagcaaaaggagatggggtggggcagttttataggcctggggtaagcagtggatagttacaggttaaggtggttatctattgtcag

SEQ ID NO: 677346 - DNA, 283 bp, Homo sapiens
caaatataattacagtttattagtacatgtgcacgcacacacaaatcctctacggaaaattatctttctcaccactcacccaaatataaacgtggacaatttatcaggggtaaatggtgaaggtaggataacgccgtgattccaattccttctcaaaccaaatacaagttctcctaaaacgggggtggcatgtccctgtcaggcgcacttcgacaggcccgttcctacggcctccgaggttacacatgtcccaaaaggcccccccggcgggcgggacgggggc

SEQ ID NO: 677347 - DNA, 116 bp, Homo sapiens
caggaacgagagaagcatttcgcagagagaagagcaagagcgccttggagagaaagaagcgacttgaggagattatgaaaaggacccaggagaacaggaggtacaagataaggaaa

SEQ ID NO: 677348 - DNA, 901 bp, Homo sapiens
  misc_feature (495)..(495): n is a, c, g, or t
  misc_feature (499)..(499): n is a, c, g, or t
  misc_feature (508)..(508): n is a, c, g, or t
  misc_feature (513)..(513): n is a, c, g, or t
  misc_feature (544)..(544): n is a, c, g, or t
  misc_feature (550)..(550): n is a, c, g, or t
  misc_feature (554)..(554): n is a, c, g, or t
  misc_feature (556)..(556): n is a, c, g, or t
  misc_feature (593)..(593): n is a, c, g, or t
  misc_feature (608)..(608): n is a, c, g, or t
  misc_feature (630)..(630): n is a, c, g, or t
  misc_feature (636)..(636): n is a, c, g, or t
  misc_feature (639)..(639): n is a, c, g, or t
  misc_feature (643)..(643): n is a, c, g, or t
  misc_feature (658)..(658): n is a, c, g, or t
  misc_feature (702)..(702): n is a, c, g, or t
  misc_feature (812)..(812): n is a, c, g, or t
  misc_feature (854)..(854): n is a, c, g, or t
acaagacagagtccaccctggaaagtggccacaggggaaggcaagaggcgatagctgggggtcacttgtcactagatggaagctccttggtccacacagtcccaaagaaaggtctgcccttgggcccacgaaacccatcccagccctcacaggctgaacctcaccctgggttttcccagagaggtgcccaagaagacccaagctgccccaagtcagaggagcagcaggaaacagcctcagaagtccgtcactcttcagtactcctcccttagaatgtccacttcctgtttggtgaccatggcaaccaaaagacaatggcagtgcagtgcgtgtgggatgggggagctccatcttccttgggtacatggggaggagactccagtgaccaggagaagcggggagagccatgggagatgttagagggacccagagaagatgggggacaggaaaaaggagagatttgttctcaagtaatggctccgcttggacttcggngaangtggtgggnttctnccgcgcgagggaggaaagagtggtcccattngccctntagntnggccccaggttgcctatctatttggtggccagattcntccctgaagtccccnccccaggggctccgaggaagcncagagngtnggangggggtctggggcanacaggggtggcccacgagagcccgtgggaggtggggtcttgccnaaacagatggcagagtgagctaagggcaggaagctctgcagggtgaggtcatccccctcacggtcctccctgggctctggcgtcaagcccgggctcttggcttggacagnccccattggctgtggcagagggccctcaccccatcaggcacnaggatgagatgcagacatctcggtgggggataatacgcacggcgtac

SEQ ID NO: 677349 - DNA, 960 bp, Homo sapiens
gcagtattaacccccggtcttgggtacttgttacagcgccacttcgatatgtttcctttgggcccacaattttgccgccccagatctgttctcagagacccgcctggtttccatttggggcctccttcttttttagtgccgcctcccgggcccccggggttctttcggcccccccgcgcattgtggcgccccccttcgggccccggttgggtctaccctctgggcgggtctcgttctcccctgtgctcctcctcccgcccttcgtgcccggatggatttcccaccccgcctcttgtttggacaggcgttaatttcccgccgcggtggcgtccatcttcatgtttgctcagagcgcccgctttttctccccgggctttttaccccccgccattaccagtcgtcgcccgttggacgtatccctcctgccgctttcggttgagtggtcctcaagtggtcgccctcagagggggtcccccctttctttaccaccgggctttgcaggcggcctcttcgtggcctagaatcccgggtcgcctgggagggccccctcattcattgtgctcgctctcctcccctcggtgaggagctttctcctctagcaggccgggtgttctttggacgcctaaactccactccatcgccatgtatggaatcttcttgttgcacagagattcttcgcctttcagaacgcccttgtgcggtcctacgaaacgccagcctcgcccgctgagagtggggagccagacccgcggcgcgaatgccccctccaaggggagtacggcccgccgtgaaatagtggttgcgtcaggttgtttaaccacgccgcgactatttccttgagagcgccacgactgtcggaaacacataggttacatgctggctgtcccaagtctgttactcacctcccgatgcaacatgtcctcaccgaagccccaacccaccccccccgcccacaaacaa

SEQ ID NO: 677350 - DNA, 907 bp, Homo sapiens
atctttctacaccatccgtcggttgctcgtgccccattgggtagctgactattgtcataggtgttgcctaggagatcctggctcctgactagtgcttgcaatctcagaagtaaaaaacagccggggggcgaactcgagctgtctgaacaaattcgagatagctacgttcgggacggtcattattgccatcatcattcagggagcgaatgtcccacacgagagttgcgcatataagaattaggccccagctcggtgaaggtgggaccagaattttgccacgaggaatgttaagttgattgcctttcaatagacagtgttgaggaccatcttgcctgagcaaggtatcaatgcttacaatttgtgaagagccacagaaaacgttaccttttcccatcatcgatgataggaatcgggagcttgccatcctggttgggcatgctgcattccaggcaggaggaaggatgaaaagggcatgccttgtgacagcctcgtgtggtggtgtttttggtcctgataagaagctgaagctgtctatcctctacccagtttaccactggcaaggaacttgatgagatactcagggtagtcatctctctccagttgacagcagaaaaaagggtttgccacccccagttgatgtggaagatgcgcgatagtgtgatggtcttcaagcatcctggaagaagaagccaaaaaattttcccgaaaggagtctcacaaagagtcccatttgggaagaatactccggttaaaaccaaccttaagtcttgggaagtgtgctgcgccccagttgtctgtgccatggtgtctgcgggatccttaacctctgggtgtcccggcagttcgccgctccacggttaaagacggcacgtttggaatttctcgccgaaacacacaacccctcggt

SEQ ID NO: 677351 - DNA, 164 bp, Homo sapiens
gtcgctaaagcaagccacgagatatacgcattcacactgcacacaggacacgacgctagacctcacacacaaacctcacacaccacacatgacctcatacacacatgatctcacaccacacacaaacctcacataccacacacagacctcacacacaccacagt

SEQ ID NO: 677352 - DNA, 100 bp, Homo sapiens
agaactacaaattgaaacatgggccacggattcacagtgacaggcaggccatgcacgtgccacgtgtgatgaccaggacggacatgtggcaggatacatg

SEQ ID NO: 677353 - DNA, 496 bp, Homo sapiens
agatagatgtcctgatatgaagtctacattcttttactgtggggcatctatatcttttatagccaggtggtgggctcaaatgacttttgctggcagagtttgaatggaggcatgtggatgagtatatggataaactatggcacagtgagagagtctgtgatatcatgctgccccgactacgggtaagaaataaaggtctggttaccagagtcacccttctcttcctagaggggcagacagacaaacacatacagatagttaaaacactgaagcctgtgaatctaatgggtcctctaaaggaatagtcttccggtcgggagagtcccaagatagtggatggggagtgagaggaacatagatcaactatgggaggggtagggctaccaaagtgcctggttgacaccaaggaaagttggtttgcctccatcctttggtcgtccaggtgcttgtgtgagtggtgcctccctcagaccttgttacaaagtccgcacattac

SEQ ID NO: 677354 - DNA, 383 bp, Homo sapiens
tccaatttacaggggaactgaagtttagtggttaaataacgtacccaaagtcatgcagctagaaagcagcagccttctgaaagaacaattgatcttaactactttgccctactcctccagcagactattcaaacgataacttcctggtatcattgcttataaaagtaaaatattttaatggatgcaatgaaaaaacggcattaaataaattgggagaaataattgctgttatactttttaaaaaactgtctaagtataaaggttatagatctccaaacgagcaggcagtaaatttatttttcttgtaatctgaaaatagtagccatgtttccctctcaatgtttgagttggggttgggatgggtggaacaatgcggaatcatc

SEQ ID NO: 677355 - DNA, 359 bp, Homo sapiens
tcaatggaatcgaaacccaatagttagttaatataaagccagaaggttttgttttttttcaggtggggtctcgctctgtcacctagactagactggagtgcagtggcctgatctcggctcactgcaacctctgcctcccgagttcaagcaattctcctgcctcggcctcctgagtagctgggattacaggcgtccgctaccacaactggctaatttttacatttttagtagagacgggggatattgctatgttggccaggctggtctcaaacttctgacctcaaatgattgcctgcctcagcctcccaaagtgctgggattacaggtgtaagtctctgtacccagcccaaaagcagttt

SEQ ID NO: 677356 - DNA, 269 bp, Homo sapiens
cgttagcaccaccctacgtcagtcctgccaccaccctacaccaccataccaccaccctgcagcctaaaacaaccctacaaccactctagcaccaccctaccaccaccctacaccaccttacaccaccctaccaccacactgccaccataaaactaccctaccaccaccctaccaccctacaactaccctacctccacctaccaccgggctaccatcaccctaccatcacccgcctattttacaccaacccctgttcggttgagcggaga

SEQ ID NO: 677357 - DNA, 729 bp, Homo sapiens
tcacgccagacagcggcccgcgcgccttctcctcggcgtcggccgccgccagctcccagaaacctcttcgtgccctcgacagtgccaggcccgcggcggccgcaaatccgcgggttcaccagcatgtaccgcttcaggacccctggcatgcggatgggggagggaacccacgcagcacagcgccgggtaccgagcaacagcaacccgcaacatcgcccgggatccccagcagcagcgcagcagcgcaggcaggcaacgcaggcacgcaggcacagaaagcaggcaggcagcgcaggcagcgcaggcacaaaacaggcaacaagccagtcgtcacataccgtaggccacacgggcccccagcacgggcacccacagcaccaaccgaccgttccgccagcaagggctctcgcagcccatcgccacacgtccatccctcacccatatagcacaagccaccaagccagcccccatccccaaccacattcggcccaccaccaggggcacccaacgcgtgcgcgcacggccccaccaccctctcccaggtacggcaacgcaacttccggcacgcaacgcgcactccccgagtccgctaccctgcccccctcccacacggtccacaccagcagcaggcaccacacaactcgtgagaacttgcgcacaccatgtgtcacgccaccaactcccttccaccccacgcgccacaaccctgccggtgcgatcgcccccacg

SEQ ID NO: 677358 - DNA, 229 bp, Homo sapiens
cggaggtcttttggaatagttcttctgtactctggaaggtacatcttaagctgatcaatgtaactggagggctacattatttaggcagtatttgcatcccagacatacaacatttaaagataccactaaaattctgaggtagctatgctgcaaaattatttaaaatttaaccattggaccgtactcatttattgttgaaattcccgtcctaggaccaggttgggggccc

SEQ ID NO: 677359 - DNA, 666 bp, Homo sapiens
  misc_feature (666)..(666): n is a, c, g, or t
agcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcaaaaaaaaattaacttggcgtggtggtgggcgcctgtaatcccagctactcaggaggctgaggcaggagaatcactagaagctgctaggcagaggttgcagtgagctgagattgtgccagtgccctcctgggcaacaagagtgaaactctgtctcaaacaataatataacataggtggtctttatatgttcgtggaaggattttgttcaggaccccacttatattaatggattaatgctgggcttn

SEQ ID NO: 677360 - DNA, 251 bp, Homo sapiens
agtcactttgtgcatagtgggaatctggactttgagtgttgccatgctgtgtagcacacattgggcaggatctctatagggttctttgaacatgaccctgaatgtgttagctgtcccatcacaactaaaagcggtatcattctgtcccaaggtttggttttttctcatattcaatgatctgattcgatcactcgttccactgtatacccagcgggtttctacttgctggaatctatttgatgcagcataca

SEQ ID NO: 677361 - DNA, 578 bp, Homo sapiens
  misc_feature (158)..(158): n is a, c, g, or t
gctaatttttcgtaattttaagtagagacagggtttcaccactgttggcccggctggtcttgaactcctgacctcgtgagtccacccccccttagcctcccccaagtgctgggagttacacggcgtgaagcccccgtgcccggcccacggacttgttnaaaaccagcattcccacggggagttccggtgcctaccacgaaaagtcgcaacactgcttggctcttgagggcgcctaggaggtcggtgtcgcctaagatgggataatggcttcacggccactcctagccttccccatatttcctgcctcagcccccctggccccatgctggggcgtcagctaaacctgatgcttcccagaagtcaggttgcccaaggagaggaggccttttgaggaccctcccccacaccccccaggtttccacaggccctccgtaacctgggggatcaaccacaggagtttttgttttcgaagaaccccaggcctcatgatggttctacggtagaggtcccacaaatacagcctgtgggccacatttggcccccgcctgatttgtaaattaagttttattgggacacca

SEQ ID NO: 677362 - DNA, 185 bp, Homo sapiens
cgatccccgatgcttataatacacagcgcagaggcctggcacttaggagagggcagcactcactgccttctgaggggatcttggactacacggtgtaataagggagaggatggtattctcttctgccctacactaaggccatagggaacccagagagcaaatcccaccactgccttccaatcact

SEQ ID NO: 677363 - DNA, 306 bp, Homo sapiens
agtaggagctcaggaaagagagaaagaagaagaggaagaggagaagaaggaggaggaggaggaaggaaggaagaaggaagaaggagaagaagaagaatcagaagaagaattagtagtagtagtagtgaaagcgaagagaaagagaagtctttatgttaaggaaagctgtcaagcttccagtggaggaacacaacttttccaaaattatacattttgctagaaatctccaattttatcattggcacaacaaataccagttgttttccgtgaagaggccaacttagttcaattttgagaaaatgtctg

SEQ ID NO: 677364 - DNA, 541 bp, Homo sapiens
tttttttctagaaaaaaattaaaagggaaaacaaaaccaaaaaaaccagaaaccacgaataagaatggaaaaaaaaaaaaaaaaaaaaaaaaaaaaaaaaaaaaaaaaaaaaaaaaaaaaaaaaaaaaaaaaaaaaataacaagaaaacaaaaacaacaaaaaacagaaaacaaaacaaaagaaacaaaaaacaacaaaacgaggggcggcggcggacgactttgtactctcttccgtcggtgatagcgaactaaagaccgtgcgcgccccctccttttatatataggagagaggccgacccagagtaggtcattactaatacccacgcgcgtacttaaaaacaacacacacgaggagagaaaaaagaataatacatcaatgatataaggaagagagaacaaaaaaattggtggaggaggaaaggaaaggaggggagaaaaacaaatgaaaagagataaaatcagccgaagcagagaaaaaataaaaccataaaagagggaaggaaagtgggcagaaaacaacaaaaaatagagagtgaaa

SEQ ID NO: 677365 - DNA, 543 bp, Homo sapiens
  misc_feature (37)..(37): n is a, c, g, or t
  misc_feature (67)..(67): n is a, c, g, or t
  misc_feature (90)..(90): n is a, c, g, or t
  misc_feature (96)..(96): n is a, c, g, or t
  misc_feature (160)..(160): n is a, c, g, or t
  misc_feature (184)..(184): n is a, c, g, or t
  misc_feature (190)..(190): n is a, c, g, or t
  misc_feature (195)..(195): n is a, c, g, or t
  misc_feature (245)..(245): n is a, c, g, or t
  misc_feature (269)..(269): n is a, c, g, or t
  misc_feature (274)..(274): n is a, c, g, or t
  misc_feature (290)..(290): n is a, c, g, or t
  misc_feature (368)..(368): n is a, c, g, or t
  misc_feature (443)..(443): n is a, c, g, or t
  misc_feature (526)..(526): n is a, c, g, or t
attgaagtgaaaagtaaagaaacgctttgtagccgcncggatttccttaggggacagcaagtaaatncttataagcggtcctcagaaganacaatnttgattaaaatcagacccatctcactcagtttataaaaccctgaaggaaggatactcttcaganatagaagacatgcctttgattaancattcnacccnattgccattccaagcattaccaactatgttgcacctctagaaagagaganccttcgaattctaggaagacacanttacnaaaatccccaggggcncatgaccgcttctcagcccgccccgctgagaagaacccaagtggttagcggggatgggggggggtggtcaccactggngaggcaaaaacctagttacataattcacttcatggtctgcagttagggtcagttacttacgacaaaattcctgcntgatgataattaaattgacagaagcctgaaggcagagggagtgactgggcttgcgccaccactggctgactccgtagccttanacagtttacaccacacc

SEQ ID NO: 677366 - DNA, 308 bp, Homo sapiens
tgggccacagcatgaaaggcagagctggggctccatcagcaccaggcctcacctcctgcctgtcttatctcagggtcctggaccatccagacggagaggggaatgccctgggggtgctgcgcaacctgctctggccggacccaaccttctaccatgcttccctcaccaagaactatggctacgtctacagcgggcactggcgacaagaacatggacttgcccttcatgctatagaatgggagccaccctggatgtatctaaacagagtctagacatgattttgttaagcttcaaaaaaaagaaaaaaa

SEQ ID NO: 677367 - DNA, 1256 bp, Homo sapiens
  misc_feature (1256)..(1256): n is a, c, g, or t
gtaccatctcacttctaggaatactgagtatatcgactcagccacctcatgtcctccctactactgtcctagaaggacctaatactatcggctgctttcagtatagtatgctacctctcagtagaacccatcagatgaggccatctccgcgtgcttaggccaactattgctggcctaattgaccagtactacgatctttgaccgtctctgacgaacgtcagccggtgggtgctagtctgctatcatagttctcaagtctccaacgctatattggcctaggaccgtagcgatagcactaaagcactaacacggctatgcatccatgtgccatagaacagctatgttacggttgccccaagacaatcgactatttacctagccaccgtgaccactgagcgtatgtcacaatgcatacatctactaagtatgtgtacatgcaaaaacgcaacatcacactccacagggtcgtacacgtgtaagtatatgccattataagcacgcgctggcatactctcgcttgcatgcttcgtgcacacgcatgcgacgcgcacagggacctcaccctttactgaataatgcctgcactatgcatacgtatcaatgtacatggaacgctcgtagttacgatcccctaaggttacattcgctggcaaggaaacgcgtagtaattggactactaggaatgcttccttattagtgttgcccggtgctaggcaacataccctagcgcacagcaactgcgcaccgctcaaacgccacacaaacgcgacggcgaaaaactacagaggaactccgcgtatcagcatacagcaagctgccaggcacgagaccgccgtatacgcacaccactaagcgaggcgactatgattcgcgaggatagggtaccatttcctgcactgagcacccgggaccaacgccatgagtgacctaggttccctgaaccaccgagaccgccatcacgacacctacatgatacgtggagtctgcaacaacgcctattggatccgatgatcacggtcgccgagcgtttgcgcccatcgtttgaggttctgcacagggcccctgggacacgaattccttagtgctgccctaatgtgagggcctcgaaccgggatcagccaggaacgccaaatagacatgcgctaccacgcctcggatcatatccaactccctatggagtctgtatcgacatccatgactctttcagaaggcaaccgaattatcgacgtcaacaacgccgcgtttccgtagactcn

SEQ ID NO: 677368 - DNA, 175 bp, Homo sapiens
  misc_feature (4)..(4): n is a, c, g, or t
cggntagcgcggtctctaattgtactgtccctagagagagcccccagcccgcaggaggcagggaagatgagcatctcaagggaagagcctccaaacagctacccatctgctaaggcgcttatgtcaccatggagaccagttggctatctttcatccaatcagagctggctttacc

SEQ ID NO: 677369 - DNA, 305 bp, Homo sapiens
cagggagcattcatgtgaccatcaggcaaagccatgagatcaagaccatcccacagcctttcaacaatgaggtacaaccacctgggggctatctcctcttgaatgtattcctgagccaggagcgtatgtgaaaacatcaaccactgcacatgacaggctgggtcctctcatacagatgggatggggttcagaaagccagagccagtatttccatctggcgtttcctgtgtcctccaggtttatatgggcacatcgaaacagtttgttcaatctgatggggcagcagtccatgggcagatttccct

SEQ ID NO: 677370 - DNA, 1581 bp, Homo sapiens
  misc_feature (690)..(690): n is a, c, g, or t
  misc_feature (914)..(914): n is a, c, g, or t
  misc_feature (938)..(938): n is a, c, g, or t
  misc_feature (943)..(943): n is a, c, g, or t
  misc_feature (969)..(969): n is a, c, g, or t
  misc_feature (973)..(973): n is a, c, g, or t
  misc_feature (976)..(977): n is a, c, g, or t
  misc_feature (987)..(987): n is a, c, g, or t
  misc_feature (994)..(994): n is a, c, g, or t
  misc_feature (997)..(998): n is a, c, g, or t
  misc_feature (1013)..(1013): n is a, c, g, or t
  misc_feature (1022)..(1022): n is a, c, g, or t
  misc_feature (1027)..(1027): n is a, c, g, or t
  misc_feature (1034)..(1035): n is a, c, g, or t
  misc_feature (1043)..(1044): n is a, c, g, or t
  misc_feature (1047)..(1047): n is a, c, g, or t
  misc_feature (1050)..(1050): n is a, c, g, or t
  misc_feature (1052)..(1052): n is a, c, g, or t
  misc_feature (1058)..(1058): n is a, c, g, or t
  misc_feature (1060)..(1060): n is a, c, g, or t
  misc_feature (1070)..(1070): n is a, c, g, or t
  misc_feature (1076)..(1076): n is a, c, g, or t
  misc_feature (1079)..(1079): n is a, c, g, or t
  misc_feature (1084)..(1084): n is a, c, g, or t
  misc_feature (1103)..(1104): n is a, c, g, or t
  misc_feature (1119)..(1119): n is a, c, g, or t
  misc_feature (1123)..(1123): n is a, c, g, or t
  misc_feature (1154)..(1154): n is a, c, g, or t
  misc_feature (1157)..(1157): n is a, c, g, or t
  misc_feature (1174)..(1174): n is a, c, g, or t
  misc_feature (1186)..(1186): n is a, c, g, or t
  misc_feature (1190)..(1190): n is a, c, g, or t
  misc_feature (1193)..(1193): n is a, c, g, or t
  misc_feature (1222)..(1222): n is a, c, g, or t
  misc_feature (1235)..(1235): n is a, c, g, or t
  misc_feature (1264)..(1264): n is a, c, g, or t
  misc_feature (1266)..(1266): n is a, c, g, or t
  misc_feature (1344)..(1344): n is a, c, g, or t
  misc_feature (1357)..(1357): n is a, c, g, or t
  misc_feature (1379)..(1380): n is a, c, g, or t
  misc_feature (1400)..(1401): n is a, c, g, or t
  misc_feature (1407)..(1408): n is a, c, g, or t
  misc_feature (1413)..(1414): n is a, c, g, or t
  misc_feature (1455)..(1455): n is a, c, g, or t
  misc_feature (1563)..(1563): n is a, c, g, or t
  misc_feature (1575)..(1575): n is a, c, g, or t
ccctcgctcgtgggtgtgtcttgtcgccggggtagcggtgtgcctctgttgacgccccgcgttcggtgctatccattctcggtgcgggttgttaggacgcttcgtgcgtcactcccccgttgtctcgtcctgtggttgaatgggtgagatcgcggtccgtctcttgtgggtgactcgagtccctccctccttgggctctcttccccccctctgagctgtgttcgtcggtccccccactggtgcccgctgatacgtgggggtcgtccgccacacgactgttgctcgggggtagtgaccccaccacgcggggttgtcactttttacacgcggcccccccgacgtgcgtgtgtcgtagtatctcctgggcctcatcttagttgtgctccgccacgtcccacaggtgtgttttatttggggggacgaccctttctgggtgttatccgttgtctgtgggggttggtggttgtttttccccccccgaacggggctccaccgtgggagggggtctccccgcccacgccacgccgaggtagattcccccccggggggcccccccagtataaacttgcgcacagtgggggagttccccccctgggggacctcttggggggagggggaacaccccttgcttttctttgggtctttggtgggttggttgtggcccccccaccgcccaccgggaatttctgnggggccccccggtgtcccgcccacagtgtggagggaggccaccatctcacagagagcgcccgcgtgtgttggcagagacactgcccctgggctcacggacgcccccacaacaccccacggtgtgaaacacgccgtgttttgtctttgggcttcccccgctcttcacggcgcctcctcacggccccccgctgttcgccgcgcactttctgttccgcaccccctcngtgagcgctctcactgtcccactntgagngagccccctctggtggccctcggctntctnttnncgtgcacacncctctgnganncacacagagcacacnccccaagtntcggngaccacnncacgagtnnccncanangcacgncncaaggccccntgtctntcncccanatctgtccacatcttgttnnacacacaggggcgcngagnggtctccacggagaagtgtgccccacaaagnctntgaccacgagatccccncgttctcctgancacntcnccacgcacgccctccaacacaccaaggcntccacagagcctnatggctcacatggaacgcaagaatgggananggcacacacgggaagaaagggaatatacccctatcaccccacgagccccacggctggacacacatgctgactgtcctnctcccctcccacncctcttggcctctggctttttnnagcctatttaacctcgcacnngctgannccacnntcttcttccctctttccccacgcactcacctccccaagganagaagcccactgttttccacccataatacccttttgccgacccctagttccctctgctcagacccagcttgttatccgcttttcagggccctggttcaccttagaatnaaaggtagtaanttagga

SEQ ID NO: 677371 - DNA, 404 bp, Homo sapiens
tcagcataatcgttatactgctagttattgcattcatgagttctgtaaactcatctcagggaatccgtcttccaagtgtatcaagcaatgtgctgcctctcccctatcctccctaacactacgtcgtgactgctacaccactaaataggttaagtgactattgatctgcgagatcagtgctctctatcgatgttcttgcaggtctccagaaccattcgctgtggcatatagactagaaagactcgtagattatgtgatagccagcacgtttcccactaaccatgtctcacgaactgatctaaactccagctcacttacccgaatcagatgggtcatcgaaatccaacgcttgatgaatacttgttctcaaagattgtaataagcgacatccaagtatcataaag

SEQ ID NO: 677372 - DNA, 900 bp, Homo sapiens
gcactattatataataccttgagatcttgtaatgtcatagaagagggtaatggaaatgatcatggaaacttttacaattttatcagcaatgttctgtggtgggtgcatgcatatgtaaattatggctttaattagagcagcacatgtgtaaaataaaaaatacacttaatttttaagaaataatttaaatgaaacaatttccattcctttaacctgcttagacttatatgtgactgtgtatggtctcctggtaaaaggggaatggggtcagaatattcttgcataacaattatttttcataacagtcctttttaaatatatttgggtaaacataaatatcttcagagaaataactgtggaaagcctactcaggaataatctcccttaacctcttaaaaatttaatctcatgtgaaagtgtctcagtaagtaattcacctgaatggtcagttccttccattggtatcaccatatttacattcttaattatggaggcccatgtgagtaataaaaaattacggaatatgtagaagactaagaaggggtggcaatataatctggggaatatgcttcatgttatttaaaccagaaatgtttatctctaaaaatttacgtagtaattatttacccaacttaagaacctttctataatataaaggttgcttatatttaaggacaatataagggtagaattggtgcctccggacctaacatttaggggaatgatcatcaaaacaagcttccaccaaatgggttaaatctgagatgagctctggtcccgcgcgttgaaccacctggggaacttacacactcccgcagcctggtcgtgtgttcggcgacgctagagctagggcactcgggcaggcgaggcaagaagagggaactgcaacgtgtggagata

SEQ ID NO: 677373 - DNA, 304 bp, Homo sapiens
  misc_feature (66)..(66): n is a, c, g, or t
  misc_feature (74)..(74): n is a, c, g, or t
  misc_feature (83)..(83): n is a, c, g, or t
  misc_feature (139)..(139): n is a, c, g, or t
  misc_feature (167)..(167): n is a, c, g, or t
  misc_feature (240)..(240): n is a, c, g, or t
  misc_feature (275)..(275): n is a, c, g, or t
  misc_feature (285)..(285): n is a, c, g, or t
cagctgggacaaggatgtgtaccctgagcccccgcgccggcacgccgggtcagcccaatcccatcntctacatnatgaaagcnttcgacctcatcgtggaccgacccgtgaccctcgtgagagaatttatagagcgggnaacggcaaagaacagggtattactactnccaccggcagtaccgccgcgtgccagacatcactgagttcaagggaggaggacatcatgttcatgtatgaagncgaaattcagtggaagagggggctacaaagtcgancaagaaattnttcaagatttatgccagga

SEQ ID NO: 677374 - DNA, 959 bp, Homo sapiens
gtggaatggccgcgggcggctcgaccgcagcagaggcgacgcgagatggcggcagcttcagcggcggctgatactcaggagctggtcgctgtcggcgtaagcaagattggagctacgtcgtcgtccacctccagctcgcgtaagggtggctgtgctgactgctggccattttgtgtgatggaacagcggtgagcaatgtgattcccgcccgtgttgtgccgggcgcatggagcgagctgcgtcgtctatgagattgctatgctggaggaaccaccaggagactctcaacataccagttatgagtgccttctatggggagaggagtactcagctaggactagtctagtgcaggttcagtgcatgcccatccgtaaggctacttgcctggtacatgtggcacgaatgccgacgtgttgcattgtcctatgtgacccacgaggtagtctggcgaagactgctacaacaattgcttgggctatgcccgatagcaaaccttgggggttgatcaccgctggagctctctatgtgacctacctgtctagactcgacaaggcgcaggacgggttgccgagtgggccggccgatgggctcgtttcttgtcacccatgatcttaccttatacgagtcgtggcacggagcaagggtattagatcctccttggaatccgtgcattcgcgcgagaacgcgtggtagagtcccgaggaaagacctgtccggggggacatagtccttgtattccgtgggtcgtcgtcccatgagagctccatccggtagcgtttgcttgatttctcgatgctggcacattctctggccagcctagtctgaaatcggaactgtagtgatgccagcgcgggttcaaaccaggggctcctcgctgcaggtcatgctgtgctcctggtcaaggtggaccaagcgggaacggtttgggcccatttcgccagcgagagggaaaaactcta

SEQ ID NO: 677375 - DNA, 141 bp, Homo sapiens
ctccagcatcaagacacattacagtcacaattgttgaaagccaaagacaaagggatatttattatttttttttaaaaaaagggtctcaccatgatatggcccaggctggtctaaaactgcgggcctcaatggattctccca

SEQ ID NO: 677376 - DNA, 515 bp, Homo sapiens
gcaatagacaggaacagtactagtactacacagacagctccttaatctacaactagctaatcataggaattacataatacctaggagataaacagtggtaacatactcacgcactactgctatctctgcagttccttcacactttgctgtggttttacttttcagatgcccttaaaccatatttagggcattgtggcacagacccacctatctcctccaaccttacatttaccattaagtaggtggccatgtgacaagtcagtacagttgttcagcatcactggaggagtggattggcaatatgcaaagcggcaaaaaatggaaacgaacttatccaagagcttctaacataaacagcaatgctaagttgattcaaagcagaaaagagtaaagccacatatccctatgtgaagcaaaacagattttgaggtacatatacgacaagcctgagtaggacgttcagatgacaataactgatttactaagggattttggcagaattcttacccctgaag

SEQ ID NO: 677377 - DNA, 360 bp, Homo sapiens
atcattgcccagatcatgtcaagacgattcttgctccttatgtttctcttctacatagatttatttttatcagcgtcttgactggaagacactctgtcgatttaattggtatcctttttttctgccaatttactacagaacttattgaatgtggaaaagattcatgcaatcatgagttttctgcctataattttgaatcagctcttcaaagttctggtacagaatgaggaagatgaaataactacaactgtcaccagggttctgaccgacattgtggccaagtgccatgaggagcagctggatcattctgtccagtcatatattaaggtatgaaatgcctcttggaaattgctcatatcc

SEQ ID NO: 677378 - DNA, 943 bp, Homo sapiens
gagcaaaggtggaaaggtgtatgaactgagaccagaaagaaagggagcaggggccaggtgacagagcgagactccgtctcaaaaaaaaaaaaaaaaaaagtaattagttattattcgaagggggcggggcaacctgtagtgagaccctcgtttctacaagaagtttttaaaatttttagccacctggtagtctcagcatacatcgggaaggctgcggggggaggatcatttgagacccgggagggtcaaaggcccaacacgttgagggcatgggttggtgccacccacattcccagccggggaaacaaggtggaagaccccttctgctcttggtttgagttgttgcacaacaaattaacaaaattaacggggggcttattaccatctaaacaaagggggattttagctcccagggaaaccatctaggtgggcttagaaacttccgagaaagtcaacaagggtgtgaaatactagcacatggcttctttacaagattagacgacgcaagaaaccaaatattgatcattgttcatactaacttattggaaagagccattttgggcaaaaaagtccaaaagaggcttcaaggtgaaagcacacagaaaagaagagttgacacggaagatttgcgggggaggtgttcaaaagctcgaacagggggacatatagcaaagaagccacaaagataagaattattcggggcgcagatacacatatttgggttgcgcctaaggcgagggaacagagaccaggatgtatatacattggcatatctattgacaacaggtttgggggtttcagccagaataataaggagagacaattacaagacatcagagtgaaagaaaggaaatattctaggcaaagagctggtctaaaataaactaagggcgcccaaaatgatatacaatcggaggggtggaaataaacgagggagagacgg

SEQ ID NO: 677379 - DNA, 223 bp, Homo sapiens
ttgcttatcccatgatctgatagcaaaaagcaactagtacagtgacaacactgagtgtctggccagactccatggcagaacaacatatgacaaatatttgggaccacggtaatgtcgcagagcattactacatctagaaaaagtgctcaaactcccacacctccatgggaagcctgtagaattcctacacggaagtaaacaaccgacagagaggatgagccca

SEQ ID NO: 677380 - DNA, 304 bp, Homo sapiens
  misc_feature (20)..(20): n is a, c, g, or t
  misc_feature (162)..(162): n is a, c, g, or t
  misc_feature (291)..(291): n is a, c, g, or t
cactctgttttgcccaatanctgtttttttttgttcttgtttttcccggcggtttctgttaggtcggtggtttgggtgggaacccagtcccaaaactttcctgtttcaaaataagtttctccttccctttttcttttccttccagaccctttttttttttanggtttcttccttcccattccccctggcttattgtccacctcccgttttttttttttttttttgagagggcttcggtttgtttttctttattggtccctttcggggtgccttttctttttggtggttggncttgtttggcttc

SEQ ID NO: 677381 - DNA, 139 bp, Homo sapiens
caccacctgagtccacacacgacctgagtccacaccacctgagtccccactaagtcacaccacctgagtccaccataaaatgggcttaagctggcacctgcctcatatcttagtgtagcagcaaaggtggaatgagata

SEQ ID NO: 677382 - DNA, 329 bp, Homo sapiens
ggtagtaccgcgattgtgtcccctgtatgtactgctggaatctgccaccgagtgtactgaagaacttgtgtatcaacgactgcttggaagtggtgcgcgggtggcaggaatttattgcggaaaggacgtgaaggactggggcccgaagccgaattggggcttgtgggtgagctctgtctgctgcgtaagtgctttgatgaaggcgttgtgatttcctcggctgtccaaggtgggaaagggccgctcgaggccttccatgactttcaaatgggtatgggggcgatagagggtcaattccacatgtgccaacgggaaggcttcccgggtga

SEQ ID NO: 677383 - DNA, 633 bp, Homo sapiens
tccaggggaaaataactttaattggaaacccccaccaactgcaacaatctgtcccgggcataaaccttccttctccctttgcaatccggtctcttctctccagtgtggccccatgaatgcttcctctcctccctccagtggctcgtggaagcggccagtggcccaaactaggaggtggctgtcaactgaccttaaggctcaactctctcctccagaccccgccgctttcgtctgccccagcaaggacttgccggagggttgaccccccgctctctgggtctcccaccacacagccttctcagcattgacacaagctcatgtggctcacttcaccattaggtggaccaaagccaccccagcagggttgactgctcttgtcagcataggctcatacctcacgtggacggcattggtctcttgatcagcttgccgcccttgactaccggtacccctggccaatcttataaactctccttgcggacctcagggccggtgatggtacccttcctgcccagccgcttgccacagaacaaggctacacgacgcaggatgccatgccccatatacaggccaccttgcccaggcctcggtgggtcttgcggggcacctttgtgtgtgccacccattggtgcc

SEQ ID NO: 677384 - DNA, 948 bp, Homo sapiens
  misc_feature (1)..(1): n is a, c, g, or t
  misc_feature (249)..(249): n is a, c, g, or t
  misc_feature (259)..(260): n is a, c, g, or t
  misc_feature (270)..(270): n is a, c, g, or t
  misc_feature (273)..(273): n is a, c, g, or t
  misc_feature (297)..(297): n is a, c, g, or t
  misc_feature (304)..(304): n is a, c, g, or t
  misc_feature (308)..(309): n is a, c, g, or t
  misc_feature (313)..(313): n is a, c, g, or t
  misc_feature (321)..(322): n is a, c, g, or t
  misc_feature (325)..(326): n is a, c, g, or t
  misc_feature (330)..(330): n is a, c, g, or t
  misc_feature (332)..(332): n is a, c, g, or t
  misc_feature (336)..(336): n is a, c, g, or t
  misc_feature (340)..(340): n is a, c, g, or t
  misc_feature (353)..(353): n is a, c, g, or t
  misc_feature (355)..(355): n is a, c, g, or t
  misc_feature (379)..(379): n is a, c, g, or t
  misc_feature (383)..(383): n is a, c, g, or t
  misc_feature (389)..(389): n is a, c, g, or t
  misc_feature (393)..(393): n is a, c, g, or t
  misc_feature (397)..(397): n is a, c, g, or t
  misc_feature (405)..(405): n is a, c, g, or t
  misc_feature (412)..(412): n is a, c, g, or t
  misc_feature (422)..(422): n is a, c, g, or t
  misc_feature (426)..(426): n is a, c, g, or t
  misc_feature (451)..(451): n is a, c, g, or t
  misc_feature (453)..(454): n is a, c, g, or t
  misc_feature (457)..(458): n is a, c, g, or t
  misc_feature (460)..(460): n is a, c, g, or t
  misc_feature (463)..(464): n is a, c, g, or t
  misc_feature (470)..(471): n is a, c, g, or t
  misc_feature (476)..(476): n is a, c, g, or t
  misc_feature (489)..(489): n is a, c, g, or t
  misc_feature (495)..(495): n is a, c, g, or t
  misc_feature (508)..(508): n is a, c, g, or t
  misc_feature (510)..(511): n is a, c, g, or t
  misc_feature (516)..(516): n is a, c, g, or t
  misc_feature (522)..(522): n is a, c, g, or t
  misc_feature (526)..(526): n is a, c, g, or t
  misc_feature (537)..(538): n is a, c, g, or t
  misc_feature (541)..(541): n is a, c, g, or t
  misc_feature (543)..(544): n is a, c, g, or t
  misc_feature (553)..(553): n is a, c, g, or t
  misc_feature (555)..(555): n is a, c, g, or t
  misc_feature (568)..(568): n is a, c, g, or t
  misc_feature (571)..(571): n is a, c, g, or t
  misc_feature (580)..(580): n is a, c, g, or t
  misc_feature (597)..(597): n is a, c, g, or t
  misc_feature (608)..(608): n is a, c, g, or t
  misc_feature (621)..(621): n is a, c, g, or t
  misc_feature (628)..(628): n is a, c, g, or t
  misc_feature (635)..(635): n is a, c, g, or t
  misc_feature (946)..(946): n is a, c, g, or t
naataattcagttgtaacaaagccaccaacagagcaaaacaaaaacaaagctaattaagaagcattgcttcagctcaaattagttatctcctttaaacaggaaaaacgaccattagtctactggttctcaaccctgtctgcacatgagaggaatggagggaaacaggacaggtgtttaaaaaaatagttatatccaagacccacctcagaactattaaatgagaatctctcaagagtgaggcccaggcnaagatttttnnagtgctgtcngtnttgaaaactacaggctctaaagtnataaggnatannaccntgcctcgnngcnnttcncnaccnagangctgattatcccntnccttttttcctctcctcctggganaacngggggnagcnggcnccgcttcngttttcntttttctttntccntcttcagttgcccatagtagcagcntnnccnncntcnnatattnnccgcnttgcccccccgcncccccnattgccattctcncnnctttncctttngccngctcttttcannccntnncttttaccncnatcccgcccatcnccngtttgcctngatgtccccgtccgccntttgttccacnccccgcgtccatngcctgtnttcgacngtactttcttaacaagttattataaaacaatattcattttatataccacaaataaactttttggtgcagataggaggaatatttgagtttttcccacctatttctaaaactgctagaatttctttttataagatcagtaccttcaattctagaatttaaacaaaactttttgctctaagaatgcatacataaaatacttcccctacaactgtactctatccttgacaaatccttattaagaggttcagtagtaactgtaggtatttaatgtcagaccaatctttcttcatttctcaggtttggaaatatantt

SEQ ID NO: 677385 - DNA, 324 bp, Homo sapiens
caacagtgcaaaagttaagggatgcaggctagacaccagggtcatctaggatgcaggtcacacagaaaccctctcctaaccccgcaagactgcgcgtcctggtgtcttctttcctccaaactctctttacctaacctctcttcatcagacaggcaagcgggaatctgtaccgggtttcagtagcagtgggagaaaggacaggcaaaggcacagatatttaggcgagagttaagctacttctggcccttgcatgtcccttattcaggaatagtgggccccgacgactggcactccgactctcaactctggttttgggagaacatt

SEQ ID NO: 677386 - DNA, 175 bp, Homo sapiens
ctcgatggcttgggtggggccccgggtggggtcttggcagcaaaagatataggccttagttggaaccattaaacagataatttctcaagggtgaggtgtgtcaagaagaccacgttatcaattccatctatatctaataacacatggtgggcttgaaggtgataattgacctctc

SEQ ID NO: 677387 - DNA, 147 bp, Homo sapiens
tggtagatctctagagatatccccggcccggtatgaagttactctaaatgtgatacaaagttttaaacttcaaagaaaaattttattagtactgactgtacaatgaaagcaaaaaagaaaaaaaataaaagcaatgtacatgttgcc

SEQ ID NO: 677388 - DNA, 816 bp, Homo sapiens
  misc_feature (11)..(13): n is a, c, g, or t
  misc_feature (15)..(15): n is a, c, g, or t
  misc_feature (27)..(27): n is a, c, g, or t
  misc_feature (29)..(29): n is a, c, g, or t
  misc_feature (31)..(31): n is a, c, g, or t
  misc_feature (38)..(38): n is a, c, g, or t
  misc_feature (49)..(49): n is a, c, g, or t
  misc_feature (57)..(57): n is a, c, g, or t
  misc_feature (63)..(63): n is a, c, g, or t
  misc_feature (66)..(66): n is a, c, g, or t
  misc_feature (68)..(68): n is a, c, g, or t
  misc_feature (77)..(77): n is a, c, g, or t
  misc_feature (79)..(79): n is a, c, g, or t
  misc_feature (87)..(87): n is a, c, g, or t
  misc_feature (90)..(90): n is a, c, g, or t
  misc_feature (99)..(99): n is a, c, g, or t
  misc_feature (112)..(112): n is a, c, g, or t
  misc_feature (134)..(134): n is a, c, g, or t
  misc_feature (137)..(137): n is a, c, g, or t
  misc_feature (142)..(142): n is a, c, g, or t
  misc_feature (153)..(153): n is a, c, g, or t
  misc_feature (163)..(163): n is a, c, g, or t
  misc_feature (193)..(193): n is a, c, g, or t
  misc_feature (196)..(196): n is a, c, g, or t
  misc_feature (203)..(203): n is a, c, g, or t
  misc_feature (210)..(210): n is a, c, g, or t
  misc_feature (218)..(218): n is a, c, g, or t
  misc_feature (223)..(223): n is a, c, g, or t
  misc_feature (226)..(226): n is a, c, g, or t
  misc_feature (243)..(243): n is a, c, g, or t
  misc_feature (252)..(252): n is a, c, g, or t
  misc_feature (264)..(264): n is a, c, g, or t
  misc_feature (284)..(284): n is a, c, g, or t
  misc_feature (287)..(287): n is a, c, g, or t
  misc_feature (296)..(296): n is a, c, g, or t
  misc_feature (310)..(310): n is a, c, g, or t
  misc_feature (327)..(327): n is a, c, g, or t
  misc_feature (331)..(331): n is a, c, g, or t
  misc_feature (334)..(334): n is a, c, g, or t
  misc_feature (340)..(340): n is a, c, g, or t
  misc_feature (349)..(349): n is a, c, g, or t
  misc_feature (351)..(351): n is a, c, g, or t
  misc_feature (367)..(367): n is a, c, g, or t
  misc_feature (376)..(376): n is a, c, g, or t
  misc_feature (384)..(384): n is a, c, g, or t
  misc_feature (394)..(394): n is a, c, g, or t
  misc_feature (401)..(401): n is a, c, g, or t
  misc_feature (404)..(404): n is a, c, g, or t
  misc_feature (412)..(412): n is a, c, g, or t
  misc_feature (415)..(415): n is a, c, g, or t
  misc_feature (448)..(448): n is a, c, g, or t
  misc_feature (459)..(459): n is a, c, g, or t
  misc_feature (466)..(466): n is a, c, g, or t
  misc_feature (471)..(471): n is a, c, g, or t
  misc_feature (477)..(477): n is a, c, g, or t
  misc_feature (486)..(486): n is a, c, g, or t
  misc_feature (545)..(545): n is a, c, g, or t
  misc_feature (560)..(560): n is a, c, g, or t
  misc_feature (608)..(608): n is a, c, g, or t
  misc_feature (695)..(695): n is a, c, g, or t
  misc_feature (740)..(740): n is a, c, g, or t
  misc_feature (746)..(746): n is a, c, g, or t
  misc_feature (801)..(801): n is a, c, g, or t
tgagtcataannntntcattttttaanancngtagggngaaagtgaacnaataaacnaatganccncngagagtccncntgccggcngtnaggccggcngccgggtttaggngccgaggcagccgaagaccggngcnttccngtctttaattnccgtggcccngacaccgatgcctggggtgaagatacaccnccngacaccnaaggggntcggcccnagggnggnaatgaaagccgttaaanagacgcccngccccccccccncaccagcctgcctcagaggnccngcctagccncagacacaatcccngacaacccccaagaacnagcnggnagagcnataaaagancnagggtttattttagcnaagaaaacncgtaaganccacactggnagtcccnggngaggcccngcngccaatgccgagaaaagccagtggctttttgcncagcctgcccntgggggnggggngccccngagccggcncccgggcccccagccgtgcctgggaatagtccaggctgtgctcccgaggagccgccccnagcagaccctgaggnagggcacaaatcccaaatgctgcttgctttaaacaggcaccctcggtnttgcctcctctgaggctggcagttccttcctggatatgcagggtcaagagcggagggggaagcagaaagagttccgcctcacacgtnctccccacagttggcgatgatcaccttctgctttggcttcccgtncttgcngccctgggcctcaatttgccgcaagaaaactaggccttcggtgacctctccaaanaccacaagctttcca

SEQ ID NO: 677389 - DNA, 173 bp, Homo sapiens
catgactacggggttaatcagtccccagatgagctgagcccccagagagagtctgacgtcacaagtaccaggccagctccaggccccaatccgccagctctcccgtctgatctgcatctaacatcgatctgctgtcatgggaagaacagaattgtcctgatgaacacaccacg

SEQ ID NO: 677390 - DNA, 413 bp, Homo sapiens
  misc_feature (1)..(1): n is a, c, g, or t
ntattgtattgttcatatcacagctcctatagtgcaacgcttgtatctctaagtccatctaatagcatctccatgtcgtgctgcttctgcttgctgtctcctgccacccataagtgtacataagcgtgtgtgcacgattgggccacagacagcttccaacctccacactacagcatccaatccacacacagcagactcttcggcatgccgccctctcacaggaagccagaggcttaggagcttgccatccatatttatttggcaaggtcataagaagcatctatgagacaagggagaggtgcaggttgaagcagcgcctcaacagacagggacatgtaggcaacacgagcaggcacagcgcggacaccactgtccacacgctcacacgagtcaggcgcgcagggcctcgtgcc

SEQ ID NO: 677391 - DNA, 831 bp, Homo sapiens
gtgaactccaagccgcgagcagattaaatgcatgtcgacgagaaaagggccccctgacgaaacgagacgaggggggccctgtctggtgggccagcagtaggagcacccccaggctggagatgaagcctcctctgtagtgtggcagtggcaaccagcatgcgtccagcaatctccagccatcagcctaagcccagcagtggaggcctggctgactgaggtgtggccagcgccacgaaggtgaagtcccagggtggcctgtgtgactcctgccagctggctgctgaaccttcccctgggacaaccatcacgagcccagaggggaggtcctcaatcgtcagtgggcacacacatccgaaccgagattgtggcaagtaggcagctaatgaaccgcgcatacgagaaagcattccacgagtacaaaggccacaaaaagcggtagtgccctcctatcaatatgcacaccaagagcagcagtgaagcccaaagtgggggaagaaacagaaaagaaaacggcatgaaccgaacaaagaacaggagagaatgaatcacggcaagggaacaggaagaacaaccatagtctaagtggataacttcagccgacccgtatagttgccgttcagcgcaccacacaattaacaagacggcgacaaatcatgagggcaaccatataaaatcaacaaaacaacagtgtgaaaaataaggaaagtaaaacaagcaaacccatgaacaagaggaaatgatagacatgatcaaaagaaaaaaaaaaagataaagaaaagcaggtgaagcagcaaacaaacacaaaaaaacaccaacggcaaccacaaacgc

SEQ ID NO: 677392 - DNA, 441 bp, Homo sapiens
  misc_feature (22)..(22): n is a, c, g, or t
taccaaacactgcagttgggtngcatcgccctccccaacttctcattgggtttccttttggcccccccatggtgcccacttgtgggcttgccaaacctcatgggccccggaccctttattttgccctgctggtgttgaccagcccggcaaccccgctccttggcagcctgttcctgtggcgggaactgcaggaggcccccctgtccctggccaagggctggcagctcttcctggcagcgctagcccagggtgtgctggagccccccccctacggcgccctgcttttcccactgctgtccctgggcctctacccctgctgggtgcttttttggaatgtgctcttctggaaatgaaatctgcccgtccgggctgggacaaaaaccccccaaggacccccttttccccccttttggggaaaaaaataagggtttgtttcaccca

SEQ ID NO: 677393 - DNA, 896 bp, Homo sapiens
tgtagtcccacctactcggggggctgaggcgggagaatcgcttgagcccgggaggcggagattgaggtgagccgagatcgcgccattgcactccagcctgggcaacaagagtgaaactccatctcaaaaaaaaaaaaaacattggcaatcagctataatccttccctaaactacgtgggttgtgactggtgcttctggactccttcaattattacccaaaagatgattggactccttagtggacccttgggcctaggaattattcataggcttctggtgagcaaatgggaacctggggtctcactcaggatactaagcatgtctgaatccctgggaagctttacctttcttcctggcacacacttcattccggggtccctgtgcgggccagccccttggatgttccccactcccctggggatcctcaaggggggtcgaggttcctcctactgacattacccttgggtccccggcaacgtctgttgtcggcgccttccctctcttcgagccgggtctggctctgtcgcccaggctgcagtgtactggtgcccgtctgctcattgcactttctgcccgggctcagggcggtttccccgctcagctcctcgagtatcacgactgtcggcaggtgtcaccatgcccgtgcaaaacttgggcttctatggcacaagagggtcggcgatggcccaggggtccaaacccgactaagcactgctgcagctcccagtctggcaaagccggacagcgccacaggtggagtcggcgtggggcaacatggtgcaaggacctcgattaggcacagctcgtagtgccgtcagcgcgcgatcgagacatgaccagggagcgcgccggacgggccgcacccgcgccgaccacacgcgccggcggcatacaaa

SEQ ID NO: 677394 - DNA, 126 bp, Homo sapiens
ttgcggcgttgcccctcctgtccactgagcctgcccctgagggatctcctctgagcagaggcacctgctaagctaccgtacttgtcatcctcagcaaaacgcaaaattgagcataaaagcccaggt

SEQ ID NO: 677395 - DNA, 267 bp, Homo sapiens
cgtgtcagcatttattcagctcaagtctgaagctgtagatctggaagacaactgcaccttggaagggtgggccgaacacagttgattgtctctacagagctatgacgggggcactgagccccgcggtatgtctgtggagggtgctccggtccaggtactgcactggacactgcccatccctgggtgtcagagcaggtggctgcaccctaagcccggcgcaaaggcctgcgccggcaggcttggcatgagttggctggcgcgtgacag

SEQ ID NO: 677396 - DNA, 87 bp, Homo sapiens
gcaagatggtgtctttattttttatactcttttaagtgtgcattcttgataaatggttaattcagaataaaggtgactatgtgatat

SEQ ID NO: 677397 - DNA, 258 bp, Homo sapiens
cagctgacaggtgcagcaaccgaagtgcatgactcagtcggcgtgtcaaatcactgaagcgagccctcgagacaacctttgacctgggaattcctcaggtagtacttcccccattaccatcgaggcctgctcttgaaaaaaccaacggtgccaccgaagtctttaacactggtatttaccaataccaacaggctctagctaacatgcagttacaaccagcatacagcatttctcacaccagttcccatggtgcacggt

SEQ ID NO: 677398 - DNA, 318 bp, Homo sapiens
ctcgacacgtcagcaaaaacagaagaagtaaaatggtttgtatgtccttatattaaatggctatatttgcctttcttcaggccaaaggcaaaatacttttatcttacccataatagtatatgaataaaaaatgagatataagataaactgaagctaatgggctaatatcaaaacactacatttgaactactcatggggaattgggtagagcagagtaaaagttcatttctgttcgatagcatccattttggagtacatccagtagtgtaagtaaaattagaacagaaccattaaaatacataatgtaactcatcatat

SEQ ID NO: 677399 - DNA, 359 bp, Homo sapiens
cgagaccagcctggccaacatgctgaaaaccccatctctactaaatatacaaaaattacccgggcatggggacgggtgcctgtaatcccagctgttcaggaggctgaggcaggggaatcgcttgaacccgggaggcggaggttgcagtgaacagagatcgtgtcactgcactccagcctgggtgatagagtgcactccgtctaagaaaaaaaaaaaaaaaagaattcaagggccggccggtggttttagacggcaacctttaccgaagcctcagtgcacagccacagcagagggacacacacctgtatcttttctaagactgggagaattttacaattgcttgactaattgaacagtgc

SEQ ID NO: 677400 - DNA, 420 bp, Homo sapiens
cgagaccagcctggccaacatgctgaaaaccccatctctactaaatatacaaaaattacccgggcatggggacgggtgcctgtaatcccagctgttcaggaggctgaggcaggggaatcgcttgaacccgggaggcggaggttgcagtgaacagagatcgtgtcactgcactccagcctgggtgatagagtgcactccgtctaagaaaaaaaaaaaaaaaagaattcaagggccggccggtggttttagacggcaacctttaccgaagcctcagtgcacagccacagcagagggacacacacctgtatctgcaaaaaaataacaaaaattaggcaggcgtggtggcacacacctgaggtctcagctactagggaggctgaggtgggaggatccctagagcctaggaggttgatgctggtc

SEQ ID NO: 677401 - DNA, 799 bp, Homo sapiens
aggttgttgccggattagaattctgccagccttttgtcggccggtccggtagtaggggttaaggcttggtgatgtgggcgtagatcccgctcagggtcagctgccggtcctggggcggaggagatggcctgcacgatcagctgcgcgtaggagaacggcggctttgacctcatccttggggctgtctcctccagacgtgtctgcctgctgctccgacgcggcctttgctgcaaactctgctgccagctgcaggtccgaggtcacgttctgcacaaagcggtaactggaggagccggcaccgcgtggactggctgggcaggagttggggacactgatggtgcccgtcggggaggggacggggctgaccatgactccggaggtccggctccgggatgtggatcttcagaggggagatctgggggtacagtggccgcagcggggaggctggggcctcttctttgtgatagagcgacgtgaactggatcttgatggccgtgctgggaaaccggaaggtacactgcttgggcagctgcagggcgggcgcgccgcgtctctggaaggccccgtccacgaagacgccgttcttgccgaggcagcgcaggtagaagtgcggctcctggaagctgagctgcaggtggcgccgcgagatgaagctggacaggcccatgctcaagtccaccgagccctgcgacgagttgcggccgatggtgacgctgggctggcgcatgaggaactcgaactcgcggccctccagccgcgccagcgccggccccgggctctgccgtaccgaggcggccgc

SEQ ID NO: 677402 - DNA, 834 bp, Homo sapiens
aggttgttgccggattagaattctgccagccttttgtcggccggtccggtagtaggggttaaggcttggtgatgtgggcgtagatcccgctcagggtcagctgccggtcctggggcggaggagatggcctgcacgatcagctgcgcgtaggagaacggcggctttgacctcatccttggggctgtctcctccagacgtgtctgcctgctgctccgacgcggcctttgctgcaaactctgctgccagctgcaggtccgaggtcacgttctgcacaaagcggtaactggaggagccggcaccgcgtggactggctgggcaggagttggggacactgatggtgcccgtcggggaggggacggggctgaccatgactccggaggtccggctccgggatgtggatcttcagaggggagatctgggggtacagtggccgcagcggggaggctggggcctcttctttgtgatagagcgacgtgaactggatcttgatggccgtgctgggaaaccggaaggtacactgcttgggcagaagcctgtgaagctggtagcagaaacgagaaggaacgaaattaactccaaggcagtaagccatccacaagaccactacacgaagttaaggcatctgactctgcagaatccatttgccaaacctgggcgtggtggcgcatgcctgtaatcccagccacttgggaggctgaggcaggagaattgcttgaatccaagaggcagaggttgcggtgtgccgagatcacatctgcactcctgccgtgttagccaggatggtctcgatctcctgacctcgtgatccgccagcctcggcctcccaaagtgctg

SEQ ID NO: 677403 - DNA, 479 bp, Homo sapiens
  misc_feature (18)..(18): n is a, c, g, or t
  misc_feature (62)..(62): n is a, c, g, or t
  misc_feature (123)..(123): n is a, c, g, or t
caaaattggttggttgcnccctttcaccttttaaggcaatggtttttaacttaaccttgaanccatagaccccacaatgaaaccttcatagaaatatatggaatgtatgattttgcatgtaantttgagggccttcatggttctcctgatgcctcattccctaggttcctatgctgtaggttaagaatgtgttttttcttaggctgggcattttggcttatgcctgtaatcctagccgtttgggaagccaaggtgagtgaattgcttgagcccaggagtttgagacccaggatgggcaacatggcaaaaccccatctctagcaaaaaatacaaaaattagctgagggtggtggcacacgcttgtaggcccagctgttggggaagctgaggcaggagaatcgcttgagcccaggaggtagaggttgcagtgagccaagattgtaccactgcaccccagcctgtgcaacagagccagacct

SEQ ID NO: 677404 - DNA, 342 bp, Homo sapiens
  misc_feature (27)..(27): n is a, c, g, or t
  misc_feature (60)..(60): n is a, c, g, or t
  misc_feature (63)..(63): n is a, c, g, or t
ctgctctttcagcacagcccacactcntagggacctcgcacttcccggagcaacaccctnccnctgtcctggctgcagggcgggcgcgccgcgtctctggaaggccccgtccacgaagacgccgttcttgccgaggcagcgcaggtagaagtgcggctcctggaagctgagctgcaggtggcgccgcgagatgaagctggacaggcccatgctcaagtccaccgagccctgcgacgagttgcggccgatggtgacgctgggctggcgcatgaggaactcgaactcgcggccctccagccgcgccagcgccggccccgggctctgccgtaccgaggcggccgc

SEQ ID NO: 677405 - DNA, 1517 bp, Homo sapiens
  misc_feature (899)..(899): n is a, c, g, or t
gctagatagaaatgatagatagatgaaatcatattatgtataatgttttgttatattgttattttctgttttgttgtctctattgtgtgtgttttgtatttggttagtatgagatgttcttatatgtgtgtttgcatagtatattttttgttttaatttatagattgatgttttgttgtttttttgtttattgtgtgtttgttgttgtcttgtttttacgctagtgtgggtgatgggtgtgggttgaagtagtaaattcagtccttttttggatcccttcgatagtgttccccctgggggaaccctccttccagcctcgggtgtgtgcacccccagtaggagacaccccgggggcccagattctcactcttccggagttttttaaccctttatagtcccccgggggccggggattacccacatagttttcgcacagacggggggaacccagccttattggccaccattctagtcgccttaatattagtgggcaacaccttatagaggacacaatgtttggtgaccacaagaaaagcccaggcgttgggtgtacccggtttccggggaatttccccccggggattatttctgtgtgaaaaccacaaacgcgttttccgggccgcggaagggttccaaggtctcactgggtggtccttttaaatgggtttctgaagagcccactttttttatccttggggccacacccttgggcagggcacacattttgtggggcgtataaaacacaggtgatactctgtctgggggacccgcgaaaaggtttgcgttgtgctctctcattaaccgccctcgttgagaagggccactattcacaaccacatgttttttggcacacattttgtttaccacggagacaccacaaggttgtagaagtaaacgcntggcgttttctctttctcggcacatagccgcgagtggaacacccacaacccccttttctccgagaggcgccccttataccacagttctctaggggcgcccaccatacaccgcgaattttttttgtgcgcggagccacgttgccgagaggtatatatttgtcgccccaccgaaaccacaagcggagagacccaaggccacgcttctttggagcccgtcttctaaaagggtgttttgacacggcgaatctccaccccgcccttatccgaccacaagagaaaaagccggagatggtggttctcctgcgtgcccctcacaaggtctgtgcggtttgaaagcctaacacaagagaaagttttgccctaatcttggggcgcgcctggcgtctaacagagaggttggctggaagtaccacggcacgtgacagccacaccctggaaggagaagaggagaaagagaaagcccagagtccacctaccggagaagaagaaacacgctcaatgaggctacggagaaacacggccgagaagaaacgtggagaagaaaattgaccaaaacacagaggtcctcaagacccccggactcctggtttgagccccataaagactgttaattcctca

SEQ ID NO: 677406 - DNA, 119 bp, Homo sapiens
ttctcacaggtgacgagggggaaaagggttggggcggatacactccatgaatgtgaagcctggagccacacaccccgctggcagccaatagaatacaaacaaaaaatcttttgcggccg

SEQ ID NO: 677407 - DNA, 1324 bp, Homo sapiens
tggcatacactacgtgctgccgtgtgcaacatgaatgccacgagcggcatcatggcatgcctgatgtgtgttgcctggggactgtgaactgtgatgtgtgcaccccccgatgctgctgctgtgccccccgctgggcagtgtttaaaactcccagttcatggcgtcccccgggtgtggccagccaggaggctccctgcccggccagcatgcagctgcagaagctcaacaaccagtatttcaaccatcacccctaaccccaggaagcactacatgcctggatttgcaccctgctgcagggccaccagatgaacgggacaaaccagcacttccgagattgcaaccccagagcacagctggccggcagcagcaccccctggcggctcgcggctggcagcagcgaacccccggacggctctggcagcaggctcgggcgagcaggcagccgggccaggcacgaacacacaggctggactgtgcgtgccagcggcaacgcggcacgccacattgcccggaacctccgatggacccaacggtcccccgagtgccatcattgcttgcctgcgccagatggtacataagacaccacctgcattctacatcggacggagcgaacggttcctacacatgtcctttggggctgatcggaaccattggcgctccacgggaaccgcgatcaaggcagcagcctagtcccgcgacagcatcttggcctgtgtgagccaagcacccgaacggtaccggcactcgcgcacctcgacacgctgacgtctcagcatgatcgccacgcgccagcgcaggcgccaaggcacgacagcagagcgtggtcggaacttccggaacgccgaagcagccccggggcggaacacgcggagcacatcgcagccccccccgcgcagacggcttccatatccgcggccgctgcagagttcaacccccgacgaacacagcccgtggcgcgccgccttcagcacacgcgcccgggcgtaagattcttcaacagagtatagacagacaacacttatggcacacacaggcgcgcggagccgggaaccaggcacctggcacgcagcccacaacgccgcatccaaccccgacgcaacaaggcctcctggcacccagcagatcggggagcacacacccgaaggcccaccccaggcactgggcccacggctcaacaagcaccccctacagacacacctggacagcaaggcaaaggaagggaagccacgaccgcgcacgacacaccacccccccagaccgaccagcgccgagcacagcgaacgcgccgcacgacgagctgcaacaggagcaagagctcggggag

SEQ ID NO: 677408 - DNA, 346 bp, Homo sapiens
tggcctgattctcactttgatgtccaggctggagtgcaatggcacgacctcggctcactgcaatctccaccccccaggctcaagagattctcctgcctcagcctctcgagtagctgagattacaggtgcccgccaccacgcctggctaatttttgtatttttggtagagacagggtttcgccatgttagccaggatggtcttgatctcctggcctcgtgatccgcctgcctcggcctcccaaagtgctgggattacaggcgtgagccaccgcgcctggccacattttgtttttctctactgtgtgctacttgtatgacgtaacctgtgtccaaagtttgactatgg

SEQ ID NO: 677409 - DNA, 179 bp, Homo sapiens
atgtcttggcttcatttaccagttcttagaattcagtttggtggctacaaacagcctttccatgctgctggagtggctgttttgggaattaaggtcaaaaaaacaagccatgacctatttgccactctcatgatttacgaatttttccaagtagctgacaatgggcagagggcaaggtc

SEQ ID NO: 677410 - DNA, 152 bp, Homo sapiens
gatagtgttaggcgactcacattatatatctagtcgcctatagcgagtgtttctctgctcaggtgataagtttcaggagagcagggacttagtctgtggggtatccccagcacttagaacaatgttcagcacacatagctggtggtccatat

SEQ ID NO: 677411 - DNA, 764 bp, Homo sapiens
gatgacaaacattcgtgaaaccagttgagagaaggcttgatgtgtataaaagacgtgatgtgcaccacctcgactctcggtgtttcaggcactatatgcaacaaaaccaagcccatagtatctcattctcgttctatcaggatcctagaagacatatcctgtgtttgtccagtcgatgtttagcccacgatgttttgggcatggatactgtgaagagtgcctagctcaccattgatcccgtgcagtcgtgtacaccgtttcgattgtcactgacgcactcagaaggggccacgggctcctggctgtgattcctgagccctcgcgtcgtgcctctcccagtagagtagctgtcttgggccattgcctgggtcgatggggcacgacctagtgcgctagggcgtcatgcctcgcgggcgcatgtgccgacgtgctagcaagctcgtgctgctgaagctaggacagctggctgagaagtgggttcaggcgaagggtagaagtccatgtcgctagcattctcctgccagtgcaagatctggagaggagctgggccggaaggcgtggttgtgaaagcacccttcttactgtcaggaggccttggggacaagttggagtatcttcaaaaatacatgtaaaggtctgtagtgcgaatggtacgtctgccccctggataccagtatacagatagcatgcctgcatggctcgactttggcattctgcttttttctaccgatgtttcatctttagtcacttgaggcttaccccag

SEQ ID NO: 677412 - DNA, 358 bp, Homo sapiens
aggtcaggtaccgtgggtgtcccagtgtgaggagaaacagcgaacgtttgcactcgagatgcccgagttgggacactaagttctatggtcctgctgcacaagactcaccttttagagccagcagtcatcaaacttgaatcatgtgctggactccatggcgaggcatacaaattcctacaaagacacctcaagctgtgtatttaaactatgcatcagagaatgtgatttacaacacaaaaacctgaacacaggtataaagtcgccatccaatcttccagctgttcaagtcaactgttttcaagccatccccaatttctctctgtcattggtatcacacgtgccattggtcagcaaatcc

SEQ ID NO: 677413 - DNA, 1060 bp, Homo sapiens
  misc_feature (552)..(552): n is a, c, g, or t
tttttctcggcaaccctctgtgtctcttcctcgccaacacgcgtggttttgtttataacaggttgggctccctccctagagttctctctttgtcgcgttcttactatagggtgcggcggtggtcttatagattttccccccgtcggcggggtttcttttggtaactcacactccaatctttgtgtcggctagtcaggcacttatttcactcccgggggaggattctttcttatccttgttgctcctgggcggagcgtgttcttcttatttaggggtggtcttcttcctgcgcccatcctcctctttcttgttcggtgatgccacattcatcaatagagtgagagagtttggttttctctacctccagctctcatgagagttgcgttttccgttttgttatacactcatatgtgggctgccgcatggggtgcaccccatcttgttgtggccggcctcactgatttgttcatttcggaccacatatctctctttgtcttgcgaaaatttcttctctcttgggggcgcttctccacctcttcactttgtatgggngggcacaccaccacacaagtgggttctcacccagacagggtggtacaacaaaagaggtctttctctcttctttacacctcctctgaatcaacgacatggttggggcgcaaaccacacaagcggcgcctctcctactcgaggtctttctctcccctgatgtgtgtcaaactcttcgcgccgctctttaatagggcgtctgattggcacccctcgcgctgcatctccaccacaatttttcctgggcgatcttttgcgtggagagaccaccataggagacgctcctagttctactcttgtctacacctccgaagcaccacatccttgccactggtggagggggccaccaccccctccttctcttcccagcccgctgggttcaacaaatgtggctcctctaggagctcaacggcgggtgcggggccaaaaagggtcccaacaccgggcccccccccaccccccccccccctttttagggcccccccctataaattgtgggggaattttttta

SEQ ID NO: 677414 - DNA, 170 bp, Homo sapiens
actctttctgcggctgtttgtggggctgctgctgacctgggagagtgggcagttcctgcgggaacaggtgttcatgggcggtggggcggtaattccttctgatgcccaaccacagatagtgcagactggctcgttcatctggagacgagcggacagactccaagacgcag

SEQ ID NO: 677415 - DNA, 750 bp, Homo sapiens
attaatcccctggcccaacccgtcatctactctaccatctttgcaggcacactcatcagagcgctgagctcgcactgattttttacctgagtaggcctagaaataaacatgctagcttttattccaagttctaaccaaaaaaataaaccctcgttccacagaagctgccatcgaagtatttcctcgacagcaagcaaccagcatccataagtccttctaatagctatcctcgttcaacaatatactctccggacaatgaaccataaccaagtactaccgaatcaatactcatcattaataatcataatgggctatagctaataaaatctaggaatagccccctttgcacttctgagtcccagaaggttagccaaggcagccctctgacgtccggcctgctttgcttctcgacatgacaagaaactatgcccccgatctcgaagtcatataccaagatctctccctcagctgatacgtaagccttctcctcactctcgtcaatgcttatccatcatagcaggcagttgaggtggattaaaacagatccaggctacgccaaaatcttagcgtactcctcaatgacccacagtaggatgaatgataggcaggtctaccgtgacaaccctaagataatcattcttaatttggactatgtatatgatcgctaactactaccggagttcctactactcaagttaaagctccagcaccagcaaacgctagtactatctcgcacctgatacaaagcta

SEQ ID NO: 677416 - DNA, 173 bp, Homo sapiens
gctgagacacacaggccgaatccgggtgcatggtatatggctggtggccacaagcaaccgtgatctgaatgattgacttacttgcgtatcctggcctgagtgagaccaagtcagcgaccctcttgagtgagacaggttatccaatgtcctgctactgatccctggggtacctg

SEQ ID NO: 677417 - DNA, 1864 bp, Homo sapiens
  misc_feature (161)..(161): n is a, c, g, or t
  misc_feature (232)..(232): n is a, c, g, or t
  misc_feature (283)..(283): n is a, c, g, or t
  misc_feature (308)..(308): n is a, c, g, or t
caataattcagaacgggcgtagcaagccatcaactacacgcagctatcctcacgaacgatcctcaatattggtaagctgcattacatcactacacactagctaacatgggtggccacatatcatacgatcatccactatacgcagagatggcataatgtgntgtacgcatggtaacgtgtacatgcactaacacatggcactttcgtgctgtccgctagtaacgactgcagnggatgcagtacggtgacacacacgaccgtagtagaccatcgcctcattganatagcgacgacactcgaaagtgatncgtaagccacaatgcgatagctccatagcacacatgctcgattgtaagtttgagcacccatgcaaccctggttccgatatcgcaccacacccaacaaagtgggccattagccccttcgaatcagaggagtaaatacggattttccacaaaatggaaatctcccagaaaagggacaaatgtcgggaagcgcaagaacactcaatctcacactcgccagtcactcttggaatgtcacacgcgcagacagacaacctagtcgataccctcgtaaaggcttcatcggactcacggggtcaattaaggcaggaggcccacctcggaatccttagcccccgatgcgtagaacccaatcgagttatgtattgtcacattacggaggcccccgcgcgcggccttaggcgcacaattgacaaacggctgctagccaagagaggaagatgacgttcaacttacaagtttcaaggcctttaccgggtgtgacacctttcttaatacacttccacaggtggcgcacaccgcggtgggttaacttggggacacgtaagtgggtttggccccacccccgaaaaaggggaagggtttgccaaacgggcaattcggggtttcctttcggttgttcactccgttggtcactacatggaccaaacggcccacgcgcatgggcatcatcaggtttcatgaggaacacccctttgaagacgccgccaaggcgttcgcaaaaagggaacaagaaagcgggcggccgccggatctttagacattcaaagccaccccacaaaacaggcgccactccggcacccgcagaatcgaaattcccctttccaccttgagacaaagatcactcgttggtagatccgttgtggggaaccttttcaaaagtggagcctaccacatgcacaaagggctctaggccccgttaaagcgccacagtatgtagtggccatccgaaccgacgggtagtgctatcctctattacgagaaatgcgctataacaccataaaaatgccgccgttgggcgcatatttttaacatcaggacagaaaataatatgcggcggccgtatggcgcaggtgggtcaggtaggcctgttccgaaggaaagacaccatactgggagacatgtcctccgacacggccgcgatcgcgggaacaacccgagggatagaccacgtggtccagttaaaaagcaatcgcgtgatacacaggcacacgcggctcggtacaaacggcacgtgcacgtacggaaacaccttgatgaatggtgcgcccaaacctgggcgcagcacccccacaggttgagacccatgtggccacgcaacacgcggcaaaaccacaaaggggttgacgcccggcaataacgggaggagccatacacagcagcagccgcgcgaaccacaccgcagacgtatgcgacgacagacagcaccctcccgcagtccaatcagcacggacgcccccagcagcacgaagtgaccaacacgacgacacccaccaggagagagccgggggcgagaccaagacgcataactcccccaccagcagccgcgcagcaatgcc

SEQ ID NO: 677418 - DNA, 379 bp, Homo sapiens
ccctccagcagtatttctgtcagatgctacgtcctgcagtctcagccagaacagctgcctctgcgctggagcacagctggaacatcctgtggcggaagccccctcgtgtccttgccaggctcaggtgggtggcgataagaattattgaaatgcagtaagaattaccaaaatgttgaacaaagacaccaagtgagcacgtgctgttggaaaaatagcaccaatactacactagctcaacacaaggttgccacaatcgctgtaactatattgaaacaatttgggccaggcaagtgggccagggagggggtggctcacaacctgtaatctcagcacttatggggggccaaggcaggcggatcacctgaggtcaggagctcca

SEQ ID NO: 677419 - DNA, 168 bp, Homo sapiens
  misc_feature (144)..(144): n is a, c, g, or t
gctggatggcgcgactcacagtgtatcaacagtttctggctcagaggatgggagagggtctggccataatcatcgccagtgggtggtgtagtacaatgttcagatggctgtgtgagcaggtggattcttgtcagctccctttangagatgcaaggttcatagatgcac

SEQ ID NO: 677420 - DNA, 484 bp, Homo sapiens
ggctcggtacgtagcgctgcatggtaactgccgttgtcacagtatagcacacagacatatacatacacacacacgtacgtgtgcacacacatttttttttccaattattgggaatggggaagaaggagaatgactaatagccaagcctacccctgttccctagggttgtgggaatattctgcttgttccctttggcgaaatggaattggagttttttgtttttgtttttgtttttgtttttttttttttggagacagattctcgctctgtcgcccaggcgtggattacaggggcgcaatctcgactcacgtgcaagctccgcctcccgggtttcacgcccattctcctgcctcagcctcccgagttagctgggactacaagtgcccgccaccatgcccggctattttttggtttttttagtacagacgggttttcacctttttagccaggatggtctcgatctcctaacctcgtgatccacccg

SEQ ID NO: 677421 - DNA, 105 bp, Homo sapiens
gggtatgatcttatagagtagaaaatcaaagatgcgttcaaaaatctcttaaattcgataaatgaattcagtaaagagaagattccaaatgggaaggaaaataag

SEQ ID NO: 677422 - DNA, 1495 bp, Homo sapiens
agcggaggtgcgcgcgagtccggggactgacggcgagctctctgccaccgggtccgcccgggaggctcaactgacacggggcggcctgcgcgtcccgcgggggacccaggaaatcgcggagacagctgaaagatgccctcgggaggagcgagggaccgaggtccggacagatgccagacgctcatcatcagagtcggatggacagggtcagggcagggacggtgcgtaccatgtaatccgagagcacgagaatctagcgtccatcagggcctgatcagttccccttcgctcgtccgcacctcacgtcgcccgcgacgcgacccgaggacggtatatgtgcttgtactttgctgtttccttttcctaacgcatttctcctgagtcggcattctccatgctggaccgcgaaggccgtgcgtccaccagttgtcgtgggtgtcgcacggcgtcgtcggcgagacttccacaaccgtcacctctgtgccttatcccacccatgtcgtgctcccactgtaagggcgatggcaactttgggctgctgtgcgcgccgtaggttagcctagatcgcatccatcacgagatctgtgtgggcacccattgcaaccgaggtcgcactgtgtgggggggattgccaggtcgttggtcgtcccgtcagcacggtcacttcggtccccgaggtccggggtagcgttcccttcaccatgcccgcgggatactctcgccgcgactgcgaaaaagagcgcgattctagtaggaaactaactcgatgccattgggcaacttgctttcgaggccggacgggcaacggagcaagggtccgaagttggttcctttgggcaggcattgcgtttcccaaggcagccacggccatggggttagttggcaatccgcacattggcacagccaacagggccgatggacacgagttccctggggcaggtaggacggcctcccctccggcaatgaccaatgcgtggacggtaaccgggtggggcaaacctttttgggcacagtggcccgccccatgcgagctttcacttcaggaccggattgggcgtcccccttaggcattaccccgttcgacagtaatgccttaggccgttacgcctttggacatgtaggggttaggtctatcgcctttggaaactttcgcgaacgacacctcaggggacgcaccaattggcgggttccacgaaaaaccgacaaaggggcggtgccaaggaagaggattaccgagccataggcgtcaagagactttcgggatactcaatctgcggctatgagagctatacacacgacgaggaagagcttcttcgcgcttccccctctgtcaattattccccgcacccggaagcctatttgcgagagtttctacacacagtttctccgacttggacactctgccgagtacctacccgagagcaaaacaacctccgcgacttggacaagaaaagccggttatacccccagttgcgagcgcctggtacgttcacta

SEQ ID NO: 677423 - DNA, 393 bp, Homo sapiens
  misc_feature (34)..(34): n is a, c, g, or t
ttctagggatgtggcattctgctggatggctttntaaaatgggttttttcctttagggagaccgaataaactgtgttgtgcacctgcattttgactgtgacctgttatgtgaggtcagatgtggaattttctacctgtagcatcattttggtgctcagaaagttttgaattatggagcacgaatttcaggtttcagatttttggaaatagggatgttcatcctgtatttatacatgtgtgtttgtgtgtgtatagacacatacatttctaaaccttttgaaactgattgcaagcatcataatagttcaccccaaatgtgtcagcatgcattttctcagaataaagacatcttcctaaacaaacacaaaaccattatcacaactgcagcagtta

SEQ ID NO: 677424 - DNA, 171 bp, Homo sapiens
atgtgattcccctgattaaaaaaacttcaaaggcagattccccattgctcttaagataaagacctggaaatggactccaaagacctgtatggaccagacgtctaaggaatctgcagttacatctcgtgtctgtaactcatgatcaacatcctgttcctactgcatggcaca

SEQ ID NO: 677425 - DNA, 271 bp, Homo sapiens
ccaaacacagtttttacttttctcagagaaccacgaagtgatctcctaacagcagatgcaggctctaccagcatatgaggtcaaacttgttactagtctacaatatgggtagatacattgcttggaagtgcctgtttctggcttctggctggaggctcacttcccagcctggcatttatttatgagaaataaagctctcctttccaaataaaaaaattttccatcctggcttacacagtgaaaccccatctctctagctgaataatctcaa

SEQ ID NO: 677426 - DNA, 294 bp, Homo sapiens
  misc_feature (201)..(201): n is a, c, g, or t
cacgagggcggcgtgtacatataaatgtccatacaaatatatatgtttcccatagatacatacacttctctcaatgcatcctgctgtctttgagtttctctgtatttctcccactatcttcagagggaattctttaatctttagaaagctctctgctgggtgcagtggctcatgcctgaattctcagcactttgtgaggcnctggtgggaggatcacttgaggtcatgagttcacggccagcttggatcacatattaagacccttatcttcactcgcgcccagcgcctaacctg

SEQ ID NO: 677427 - DNA, 224 bp, Homo sapiens
aaaacgttcggggcagggtgggagtgggtatggaaatccaatttgggactccggtcgctcgcgtggaagttttgtgtgtacgttggtccgggtgggttcgaaacccggtgcgagtgggtaaaaatgtaaagcgtcaaagtccctgagcttgttggcctgatcttgcgtttggaaaaaaatcttgtaataaaactgcacccgtagggcttcaggcagcttcccca

SEQ ID NO: 677428 - DNA, 149 bp, Homo sapiens
  misc_feature (141)..(141): n is a, c, g, or t
tttagtagagacggggttcacgtagaggaaactggcattgcagtcaggtggtataataggcttgtccacataaaccagtacatgttcatcctattagtgcaaaaagccctaatggcatagtaccctatataaaattcaggnacatctcc

SEQ ID NO: 677429 - DNA, 313 bp, Homo sapiens
gtgggggggggccccgggggagattccaagctcagtccccccaaagttcagggccggttggaggcaggggcaggtccgggttcaaaacaaggaccccccagttttttcgactccagcaacaggtccaacgatttgggcccggatgtgaagttcccccctgctgggtccaaacagcccgaaagcattccgggcaaggccaaaaagccccaagttaaaaaaaaggaaaagggcaaaaaggaaaagggcaaaaaaaaggggggtccccccttaagggccctgggcaggggtcatttaaccttcctttttgccttca

SEQ ID NO: 677430 - DNA, 380 bp, Homo sapiens
  misc_feature (192)..(192): n is a, c, g, or t
  misc_feature (220)..(220): n is a, c, g, or t
  misc_feature (315)..(315): n is a, c, g, or t
tggtataatagactgatcgagcacactgacagaagatggagtgagttaatttgccgtctcgacatcgaccatctacattcacgtggcagagagtattggttacaatgacgatttctacgaaaaataaccatcgtgcagggaaacacagagaagggtcattacctggcaggcgcagtttgaacatcgcagtgngccagcgagtatcatgggcggtgctggnccctgacgtgacaagcctcgcaagacattgaaggcacgtgctgggaaggggatggtgggtggccaggtgaccaaaagcgtggcagccctgtgacncagcagatgattttggtgaggtgtttcccaacccctggaagcttcatgtggagtggacgcgtcct

SEQ ID NO: 677431 - DNA, 298 bp, Homo sapiens
  misc_feature (38)..(38): n is a, c, g, or t
  misc_feature (42)..(42): n is a, c, g, or t
  misc_feature (53)..(55): n is a, c, g, or t
  misc_feature (57)..(57): n is a, c, g, or t
  misc_feature (59)..(60): n is a, c, g, or t
  misc_feature (62)..(63): n is a, c, g, or t
  misc_feature (80)..(80): n is a, c, g, or t
  misc_feature (87)..(87): n is a, c, g, or t
  misc_feature (89)..(89): n is a, c, g, or t
  misc_feature (101)..(102): n is a, c, g, or t
  misc_feature (110)..(111): n is a, c, g, or t
  misc_feature (115)..(115): n is a, c, g, or t
  misc_feature (121)..(122): n is a, c, g, or t
  misc_feature (125)..(126): n is a, c, g, or t
  misc_feature (128)..(128): n is a, c, g, or t
  misc_feature (133)..(133): n is a, c, g, or t
  misc_feature (140)..(140): n is a, c, g, or t
  misc_feature (162)..(162): n is a, c, g, or t
  misc_feature (174)..(174): n is a, c, g, or t
  misc_feature (176)..(176): n is a, c, g, or t
  misc_feature (179)..(180): n is a, c, g, or t
  misc_feature (182)..(182): n is a, c, g, or t
  misc_feature (201)..(201): n is a, c, g, or t
  misc_feature (210)..(210): n is a, c, g, or t
  misc_feature (231)..(231): n is a, c, g, or t
  misc_feature (266)..(266): n is a, c, g, or t
gacgcagctcctcaactaggcaagaggaagcgcgaatnggangtggaggaggnnnangnngnnaggacagaggaaaaggngggaggngnggggaatggtanntgtgctcnngtgnggttanngtnntnggggntgggggngggggggggggggggggggggngggggggggaangnggnntntggaggggggggggggaanggggggtgnggggggggggggggggggggnggggtgggggggggggggggggggggattgggggngggagggggggggggggggggggggggggggg

SEQ ID NO: 677432 - DNA, 297 bp, Homo sapiens
aggtgcccacatggcaggcatttattttctcacagatcatatgttccacacatgtttgttcaataagcatggactgcaaccacgtacatgaatattcatagctcctcctgtagcctgttgaatatgtatgtttagcctacctcttcagcataaagctcctgcccaaacccctcctgctcctaaatgtctgtctctggtgttaaccagaggttgctcttcccaggctgctggatggctaccttgcaggctgtcacccttaacaaaaaatccagtgtcccctgcaaatgcaaaaaatat

SEQ ID NO: 677433 - DNA, 360 bp, Homo sapiens
  misc_feature (247)..(247): n is a, c, g, or t
gcaccgtctgctctgcaggcgtgatccagcaggcgtgggcagcaggagtgggccctcgggcaggtgaggctagagcagtgccggacggtgagaacaggtcagtgtcctagaggcagggcgtccccgagagggcctcttgcatgctgaggtctaggaccaggtagccgttgtggattccgccctgtatgcccagccccagcgtgtccaggtcgtcctgccgctgccgtaggatccagtcccgcaccgngcggtgccgctcctccgccttcaggccctccacgttgggttccagaagtttctgcacctcagccacagtcaacggcagcaccgcatccgtccgcaggttcatgaacgttggca

SEQ ID NO: 677434 - DNA, 220 bp, Homo sapiens
ggcgatctcggtacacaagacacgggcttgtagctggcagatcgctccattctccgtccagcacgaggcatcacgcgtcctccacgggctgctcctcatagtgggcccagaccttctctttcttctgcttggcggcctcctcggcagacagcagggactcgtagtaggagctgcgttcggcggtgaagtggacctgggagagcgcgtgctccaccagcag

SEQ ID NO: 677435 - DNA, 269 bp, Homo sapiens
  misc_feature (132)..(132): n is a, c, g, or t
  misc_feature (144)..(144): n is a, c, g, or t
  misc_feature (150)..(150): n is a, c, g, or t
acccgtatgtctctgatttctttgttagttctgagccaaaatctcaatggagtctcatggcagcacgaagttcatcagcatcaatgcctacaggtgacctgtaagggctttcttcagtgtttcatcccaggngctttccctgtntcctgngagatatgctgctttgatcctgttgacgctgtgcattgtttcgcttagttagaatgtccatgatggttgcttcatccacacctttaaccattatggccttatgcaaggcagcgacatcc

SEQ ID NO: 677436 - DNA, 1406 bp, Homo sapiens
  misc_feature (744)..(744): n is a, c, g, or t
gctgttgccaggaagagacagggggtcttattatgtcagaaaaagacgctggtggatgaacgccgcgccttcctctttgtgcagagaaagccaatctgttgttgtgggggggaaaaaataaatagtggtggagacgacacaactcttggttgagagagagggttcctaccaacggacgagtgagtttgtgttggattgagttgtgtcagtgaggttctgatgttgcgtgttgtgaaaaaaagaggttatccatacgtggacgacagctctttgtgaaatgttggtgccccaaccaccctccctctttcttctttctccacataaattgggggttgttccaacatctttttttccctggggaagcaccacatatctctcttgtgtggtcgcccttcggcaagaactctgttggtggacaacaacccccgctgttttgttgttagacagcggcgccccagaaaaccgtcttctttggggcaaaaagggtggtccaaccgcgtgtgttgtcaacgtgctcccccctcggtttaaaagcagcccacacaaatagtggtgtctcttttgtgacacacgcgccacagcagtagaaagttggggccacaacatatattgatggacccggaagagatttataaaagaggggaccacaggctctaataaactcggagagtgcgcccaccacttataggaggaggagagacacacttttatactccggatagaccccccccacacagggtttcncccacagagagaatggcgcccctcgagagagagattgtgtgtggttgttaaaagggggagaaacacacgggagagccacagcgagaaaatgtgtgacacacacacaccacagagtgttgtctctctgtgtcccttctgtgtggccacacactagactctctcttctgccccgtactctcacacaatacacacactctggcacacaccacgctataatctatcaccacgccctctcctctttctttctctcacacaactctgtgattttttctctcctcgtgagaatatgtatatttctctcacagagaaattgagacctctctctctcttccacacacaccacactcttcaacacgaattcctctttctcttgtggttttgtgggtttcttgcacgtgttctaatgcacattttataaaatatacacctcttggagactcgccacgcgtataaaatgccacaattaaggagacacacctatacccacagtatgacgaaacccagttcccctaggccacggggtgtccacaataattttagctttccctggagccgcacattggaaagaaatttttcttgggccacacacatgtaaaaacaccacctaaccacctaaaccacatagttgatgagctttaaaaaattaaaatagaaaattgcca

SEQ ID NO: 677437 - DNA, 286 bp, Homo sapiens
tgtacagatactaaaatgtgaaacattagaaaaattaactatattcatgtaaatatgtgagcatatataaatacataaagattttctatcagtgaatatcttatgggcaattatttagttcattacaaattaatgatttcacataataaatttactctttgttatttctagttgtggagtgtaaattctttatagatcaaatacatgcaaaagtggcttcacatttttcatctcattactccatgaccccgcccatggctgataatgtaacttacattttaacaag

SEQ ID NO: 677438 - DNA, 1066 bp, Homo sapiens
gggctgcgtcgggctgcaggagaagatggcggatctccacaggagttacagttcctcgtaatttgcgcttgtcggaagaacttgaacgaaggacacaacaaggagtaggcagacggtacagattagctgggtgccttgaacgatgcatgaagatatgacaccttacaaggtggacaggcatgatatattgggccaccaaggacaaattatgaaacacacgacatatatagcctgaacagtagaatgtggacctaaatacccagaagctcctccgtcagttcagactcgtacacaaaaattaatatgaacggcactacaataattccagtgggatgagtggatgccccggagcaataccagtgttagcaaaatggaaaaattcatatagcattaaaagtcgtacttcaagcagctacgaccgtctaatgatgtccaacagacaaatatgaagcttccaccagccaccagaaggaccaacatacaacaaatctacttttagtggatctccacaccttgtccttcacatccaccaaaccttctacctcatgtcactgtctctgcatcacatatcaccacatgcaccactacaacataaagatacaagaattccacacggataaacatgaccctggacatacgggtacagaacaatctattataactacatcttgtatccaccccatttaatgtaacacaggagaaaccgagaggcacaacatggccagcacaccattataacaaccttgacaagcgcaccagccaattaacaaccattaacacctggaagaaacagaaaaaagacaatcacgagatttacaaagatgacaacgcggtggccaaacaaaggtaaaaatgagacacggcaacgatgagctgctaccctcacaacacacactcccccgaccctcatgagaattctaccacatcaaccacaccccacacacacgtgctgccacagtactgaccagacacacaaccaactctcacacagtaacactcgaaaaacaacgctgaccaaacacacaaaaactgacacgaccacctgccaaaacacagagccgccacc

SEQ ID NO: 677439 - DNA, 188 bp, Homo sapiens
tcccccccccccctcccctttttccccccccctttttcccagggggtttgctttgccaaaaatttcgggggaaggggggcggggaaaacccgcccaaacttgtttttccccaagggtttggggtccaaacccccggttttaaaaaaaaaggggggggggccttaaaaaaaaaaattttttttttttta

SEQ ID NO: 677440 - DNA, 209 bp, Homo sapiens
ttaccctagggataacagcgcaatcctaggctagagtccatatcaacaatagggtttacgacctcgatcttggatcaggacatccgatggtgcagccgctttaaaggttcgtttgttcaacgattaaagtctacgtgatctgagttcagaccggagtaatcaggtcggtttctatctacttcaatcacctgtacgaaggacagagaata

SEQ ID NO: 677441 - DNA, 329 bp, Homo sapiens
cgtagatagagaatgacgcccaggtccaaagaagattgcagcctctgaaagctgggaaaggcaaggaaatggattcttccctgacagcctccagaagaaactgtgtccctgatcggttccttctgatgggttcttggtctcgctgacttcaagaatgaagccgcggaccctcgtgaaaacatcaatattctgaatggacatttctcaaaagaagatatacaaatggccaataagcacgtgaaaagatactgaatatcactaatcattatggaaatgcaaatcaaaaccacaatgaaataccacttcaaatccattaggatggctactac

SEQ ID NO: 677442 - DNA, 293 bp, Homo sapiens
  misc_feature (212)..(212): n is a, c, g, or t
  misc_feature (285)..(285): n is a, c, g, or t
ttcgatgtgggactcagagggggcgcagcctcaaaccctgtctttcctttacttttacttttttttttttcccttgtgaagagagaagaacagatgtgtcgattctgccctattatatgttctactcgggaacaaacgttggttgtgtgtgtgtgtgtaccctggtgtgggtttttaaaagaattggggaagaagaaaaaaaatttctcggnccttttcctcgatctcgctccccctttgggtacttacgacgggtcccccttccctttggggtccggtacggtnaggtttgg

SEQ ID NO: 677443 - DNA, 146 bp, Homo sapiens
ccgtaggtctcagagaagagtggatgcgagccccccccggtacgaggccacgttgaaaattgaccatagttcagtagtattttagaagtgtcagaattctagcattatttaaaaaatcatgacataccttttgaagaagtttatta

SEQ ID NO: 677444 - DNA, 573 bp, Homo sapiens
  misc_feature (167)..(167): n is a, c, g, or t
  misc_feature (301)..(301): n is a, c, g, or t
cactgctataatgaacagcccccaaatgccagtggtttaattcagtgcaaagagttcctttatcctccccaaggatggaaaatacaatttattttgcttaccatacaaaaaaaaaaaaaaaaaaaaaaaaaaaaaaaaaaaaaaaaaaaaaaaaaaaaaaaaaaaanaaaaaaaaaaaaaaaaaataaacaaagaaaagaaaagaaacaaacagacaaaggaagaaacaacaataaatagaagagccagcaacggagctgcgagcgcgcgcggcgcgacgcggacactaagtatagtcttntacacagctagctagagacagaggaaacagcacataacataaaagcagtagactacagttataaaaagacagagcgaagagagcgaagcgacgcagcgaccgagacgaccactacacacacggtatcacgaagcaaagacacagagcactagctcgatagcgaagggacataaaaacatacaaaccgaagaacctcagtacacacaagccgacacaaaacacagtagagacatcctatacatcaaatacgcaataggtcacgagacaggcga

SEQ ID NO: 677445 - DNA, 269 bp, Homo sapiens
  misc_feature (261)..(261): n is a, c, g, or t
aacactttcaactgagtaactaactcctcccaggaaagcatttcctccctggtgccagaaaacactttccccaaagataagcctcacaccctcaggctaggaaaagttggccgggtaatagcaaatgcctcctcctgttttaaaagcagaggaaaaggaccatacctggggagatcttcaaatattattaacaccatacttgtaattgctggaaagttcgggaagtttgggaggaaaaaggacataaggaagggatgattntaagggaa

SEQ ID NO: 677446 - DNA, 231 bp, Homo sapiens
cacgcactgggagtggactccggtggtggcgcagacgcggacgcagtgagcgtcctcggtgcacctgcctcaggaagagtacctctggcgaacgtacttgcctttgtcatactggtgctgcccgctgctcttcaggggtgcagagccggcgtcgtcatcatccaggatgtcctcgggctaccggcgcttctcgtattttgcagatgatggtgaccagcaccagcacgaata

SEQ ID NO: 677447 - DNA, 625 bp, Homo sapiens
  misc_feature (589)..(589): n is a, c, g, or t
ggtcgtactctagagagactcccccaggaacgctatacgaaactggactggcgtatggagaggagtcctcccctctccccaggaatggggtctcaggtgatcagcatgctctggggcctgcattccccattcacttgtacttccattctgagactcccagtgtgaccgcttggacaggtccctcttcccaggaatgcgaggctcctcctctcatctctcaatgtacatcgcattgattagctgctccaccttataagccagccgctgccgtcgtgactggtaatacgttgccagggccccgatgagctcctcactatacttgctgacataggagtagatctcattgagggcactcagcatgttgaactccacggcgtgcaggcgggactgctcggcgaggtaggccttcatgtcctggtcactgatggctgggggcttggcgatgtctgcgtagtatctctccacccagctcttgtagcttgggatgtccttggcatagagcagcttgttggagggggagtccttgcccagccggtgctctgacgttgaacaagagtccatgaaggtctgggccaccacagagaggcangcgtccgtgatgctgcccttgtggattttcaacacg

SEQ ID NO: 677448 - DNA, 150 bp, Homo sapiens
acagcgctcaccgctttgatcatcgccacatcactcgggcggaaattatggtgggcatccgtacctccacgcaatgggctcaatatctttatctccccttcctacaaacggggggggctatatacggtcattttctactaagaacctaac

SEQ ID NO: 677449 - DNA, 363 bp, Homo sapiens
atttccatatactacacccaatcaaaggtggctcggaatgaggtgaatacgtgagtcatgtatacaggtgttgttcgatgaaattgttatctattcccaacgctgcagcaagagatgagacatgattctgttattaaggctaaaatactgcatatctagcaatttttctcctttctgatatcccgtgacactcaagtgtgcagtacttaaaatagagcctggattgcctataattgtggcttttttcaccctttcttggctatgaaatagttcatttcatacctctaggctttatacaacgatgtattgaatttagagaaggggcatgtgctatcttgcccacttacaaatgtagttctcggc

SEQ ID NO: 677450 - DNA, 263 bp, Homo sapiens
tgccgactatggaggcggcgactaagcacgattgtcggcttcttcctctgcaccgatccctacggtggttgtaacttgtaagcatgtcaaaccattcttgtaggtaggatagcgagtggtacataggggtagatatgatagcctcgactttaggtgatccattctacgacgatggccctgcctagatctccgtcgagcactgcgacgctctttctccttggatcttcgtcgagcacggagacgattatgttggatgcttctgt

SEQ ID NO: 677451 - DNA, 803 bp, Homo sapiens
  misc_feature (11)..(11): n is a, c, g, or t
  misc_feature (96)..(96): n is a, c, g, or t
  misc_feature (128)..(128): n is a, c, g, or t
  misc_feature (247)..(247): n is a, c, g, or t
  misc_feature (298)..(298): n is a, c, g, or t
  misc_feature (301)..(302): n is a, c, g, or t
  misc_feature (307)..(307): n is a, c, g, or t
  misc_feature (403)..(403): n is a, c, g, or t
  misc_feature (407)..(407): n is a, c, g, or t
  misc_feature (410)..(410): n is a, c, g, or t
  misc_feature (419)..(419): n is a, c, g, or t
  misc_feature (486)..(486): n is a, c, g, or t
  misc_feature (497)..(497): n is a, c, g, or t
  misc_feature (505)..(505): n is a, c, g, or t
  misc_feature (514)..(514): n is a, c, g, or t
  misc_feature (517)..(517): n is a, c, g, or t
  misc_feature (603)..(603): n is a, c, g, or t
  misc_feature (607)..(607): n is a, c, g, or t
  misc_feature (645)..(645): n is a, c, g, or t
  misc_feature (660)..(660): n is a, c, g, or t
  misc_feature (662)..(662): n is a, c, g, or t
  misc_feature (673)..(673): n is a, c, g, or t
  misc_feature (681)..(681): n is a, c, g, or t
  misc_feature (795)..(795): n is a, c, g, or t
ctgaataagtncactatggatatatataggaagagatatacatatattctatccacagatacacacacacatatatatttctgcatgtatatatanataattctttctatagttacaggaaatacttnttctataattctgattttgactcccatcctccaccatttactcatccactcattacctaaatcttggctttctttcctatattgtaaataatccatccaaacttctagccagtactgtnaggagggttcttgctcgagtgagcggtgaatactattttccactgagaaanaannggggnggaggacacagtgtatctgaagactccgctgtatacttccaacaacgggggcatttttctttcgtagtgggcatgaaaatgactttataggaagantctncangaatataancaccttctaagttgatgaggaatttccctttaagctcgattacatctgcagttatctcttgtggttnctgagcaagtnaagttganttagaagcnatnattaattcatttaactgagaggtgctggaagtttcttcagaatgcagcatctctattatctcaaaaagcagttcaggttctatcanagtnataaccttgtactcagctgcatttttgccagggatgcntccaagaaatgagtntngcattgcacangcactctncacagcttcttccaacccgggctttttccagaaagaactagtactaatccacccagtacgggaaaaacttttgggctctttaatataaggtatgttctggaacactcttcagcnaggtgagg

SEQ ID NO: 677452 - DNA, 228 bp, Homo sapiens
tcgacggcaggactttgagactacagtaggctgtgattgcacgactgcactccatcctgggcaacagcaagactctcttaaaaaaaaagagcatggactgggcgtggtggctcacgtctgtaatcccagcacttttggagaccgaggcgggcagatcacgaggtcaggagatcgagaccatcctggctaacacggtgaaaccccgtctcgtctctactaaaaatacaa

SEQ ID NO: 677453 - DNA, 847 bp, Homo sapiens
acacgccgcccgtgtttgtggcgacgggttgtgaagagccacacaacacaagaggttgttgagagccgccctcgggcgaaggcacctccaccccctgtggggggggcccccgtgaccacctcgtggggtgtctacaccgccacgttttaaacaacacacgggggggttgtcccccggccacacccggccgttattgtttttcggccgcccaccacctgggggggtggacgccccctcttttctccgcgcacactgcatccccaaaggaggcaccccccccccacccgggtgtgtcgcccacccgaggtgggccattttttgagacgtctttttccccgacgcaagtgtcccccggaaaataaacaacgtcgccacaagagtagttgttccccacaagggataagatgatctgcgccttcaaccacggcgggggtcacaaccgcccacaagaaaagaaggggggctcacacaccaccacaacaacagggtccccaccaagagagaggtgctcaataaaaaggggttttttctccttgagagagcccacctccttctcgcccggcccgctgtgccgcggcgaggcccccactaaaagtggtccccctctcactttcctgggggcaccacatggggtgcttccgttgggggtttatattttcaagcaggagtggtgttaaaaagatggggcgtcttccctcctcttggggtgtttatctgcatcccccctctgtttggcacaccccgggggttttttttctaaatttttccaccggccgtggggccccccccatccccccctttttggtttttttttttttaaagggggggaaacccccctttttttata

SEQ ID NO: 677454 - DNA, 431 bp, Homo sapiens
tctctacagatccccgcccgccacagcttctgtagctcgactctagtgtggctgcggaattggtattctctgctttgcacgtccagagttacagctgatcctcgtcccgagctctgcgcagctagtggctgtgtgtatccatgctacccttctgggcttggcgtattgaaaatagagcccctgtgctggggtggctgctgaccctgggaggagcggtgcactccactggtcgctctgcctgtcgatcatggggctattctgcagcagcttctgctcacagggtagtgcgtggcggtcgggagtcacaccttacactcctaattcctaggcagtgcatctgcactaattccaggctgctctgtcgtctgggctccgggcttgtgagaagctgtggcggtcggtgaagcttggcggcttgtgtcccagctcta

SEQ ID NO: 677455 - DNA, 337 bp, Homo sapiens
ccttttttccccccgggggcccggggggggttggggggtgggggggtttacccgggctccccccccctttcccccccggtttgggggggggtttttcccccacccccccggggtttaagggcaggggtttccggcagggtttttggcccccctcctccgggcttttttttttccaagccccccccggggggccgggggtttttggggttaaaatttctttagtcccccctcaagggggcttggacccggggggggggggttttttcccccccggggttcccgggggggggtttttttttcgggcaaagggacccctttaggtgcccccgggggtcca

SEQ ID NO: 677456 - DNA, 977 bp, Homo sapiens
gagcactagatcagtgacatctggtgccgtcagcggcacattgatgacacagctggggtgtggtaacaccacagggcgcgtgtggacagacatggggcacaacaaacggggtgttagccaccagggtgttgtaccggggtatacgggccgctggattataccgggggggaccgttctgtgcgcgatgtgctcctcccctatgggggggtgcccctccccacgcggcatgggcgaccaacacgccgtgggggacagcttgtcccacgcgcccgcgtgtggttgttagggccttcttgccccactattgtgtctacgaccccggcggccctcttcttcctggcgggcagcgggcagcccattttcagcggggaccagccaccaggggcccacccccgccaggggcaactccgtgccctgccccccccccgcgagcaaagggtgccccaccccccgagcggaccgccccccacgaggtagttcccccgcggataaggcgccgccagatagtccacgcaagtcggcccgaggctgtcttgtgcgagcccatgcaggaacgctggcttgtcaaatcattccggagcctcacggcgtttttctgcggagaacgcgactaaaggtccagcggccctccggcgacacaccacagatcggtgagccgtttcacagcggggaccaccccccccgtacttgcagcacctcgaggtagggagccactgatgcttttccaccgcgaaagttattaggcggggccccccagcgatggcagccccctaggcgtggtgccaccacccggtgcctgtcgacaaacgggccctgttggctcctttgggatgtggacaaccaactcgccacgcttgcccggttggaggcttcacggagatcacgcactgctctggggcgctcctcccccaggttttcgcccaataatgggttcaacatttgggggtctaataaaatctcccccggcaaacaatgac

SEQ ID NO: 677457 - DNA, 243 bp, Homo sapiens
cactctagaggatcgctgcaggtgttgtgggtagttgaggataggggctgggcaggaaggatgcagtgaaaccaacttcttccgggcttgcttactgtattgagttaagaaggaagagacttggttccggaggagaggcccacagtgcagaagtcacttaaaacactgtgcaaccctcatgcaaaggtggtacctgtgctgtgcacatatccctctctgtttgtcctgtggtggtggccccac

SEQ ID NO: 677458 - DNA, 165 bp, Homo sapiens
gggactgtttccctactgctgggattttgggactgcgttccttgctcctcagcttgcagattgtctgtagtgggactttaccttctgatcgtgtgagtcaatactctttcataaactctccttcatgtatacacttatcctatgggtcctgtctctctaaagcag

SEQ ID NO: 677459 - DNA, 80 bp, Homo sapiens
cgttttccggatttttctttaatacagttgccatcttacatgatgtactattaagtgccttcttaatagcatctaaccta

SEQ ID NO: 677460 - DNA, 1413 bp, Homo sapiens
cctctcgcaaaggatctccttcatccctctccagaagaggagaagaggaaacatcaagaagaaacgcctggtgcagagccccaattcctacttcatggtactgtgaaatgcccagtgatgctacttaacagtcaccacggtctgtgtagcctcagtgcactaaacggctagtgttttgtgtgctcggctgcctccacttgtgtcctctgccgagcctacaggtaggaaaagcaaggctttacgagaacggcatgttaccgtctcgagtgaaggaaagcgatgcaacctaaaaaggcaacatctgaaagtcaaagatcgatgtgtggaatacccatcttctaagtatagaacaccatgtgttggcatgaataaacaacagagacaataaaaaaaactctgaaggcccctcctggtgggaagagaggaggcgcggtatacaatagaagtgatccactgaaaaattggcgctacctgtgggccacagtgatccggtgattccgcgtgtgcccagatgtcttcggtgggtacaaagagtggggttaatattgcatggccgtgatcctcacctttacatatgcgtgagacggtgcgtgtatcttgcacagtgtctcagaaatacaccacaagtggtactaccccagtggatgtgtaggtaaaccttcgcgacaaagttccggggccggccacacactactgaacgccctggacaacccaagccgggccttttcaacttatccaagacttgcgcttgacagcccatcccgccaaagactttcccttcccgaaagaaacccatcatataccctttccaagccaacaacaaaaatacggccccaatttcctctgaggcgcttaaacacctggccaaaagcaaaataccacgtgtgggacaaacccactgcaatgaaacgacatcttggtgaacaaaggacacatcacaacccgcttgcgtcccgggattgcgacttcttcacaattcgaactttaacgccacacggcattcgctcggcctcctatccaggcaacaacacttaacccttccacccaaacttattaaaaatcgggcattggcctcggctccacctaacgtaggaacacaaaacggagaaaacaccgggacacttcagcgacgaacacaatccacttagaccaaacctaatgaaacgaccaagcctacacacacagggaaagccctggcgaaacggccccagaacagtggaaagcgcgatgggccagcagacaccatgcaccggcacgccgggcgcccaagaccacagcaaccaaccgcagcgggaaccgcgaccagcatccagacagaacccaccgcgacacacggcacgcacaaccagtgatctgccaacacataaaagacgccgacaggacaaagcaacagtgacgaaaaaacaccgaaac

SEQ ID NO: 677461 - DNA, 293 bp, Homo sapiens
ctggggtcaagggctgggtagcccccagccagccccctcctatggataaacagaccagtgagcccaagtggacaagtttggggccccccagggaccaaaaacaaagcctttgcaggacacagcaaatgggcacctgggaccccctccacccagggccctgccccaaacgggcaaaggcccgacccaagggaaaagccagccccttgtgccagacctgagtggcagaaaacaaaaagttcctttgctgctttaatttttaaatttttttacaaaaatttaggggtttccccata

SEQ ID NO: 677462 - DNA, 719 bp, Homo sapiens
  misc_feature (716)..(716): n is a, c, g, or t
gggcagggttcagaaagcccacccacaaagcaggcgtctcctgagagtaccatgggaggggccctcccagaaggagtgagagccttggatcccagtgaaccgggccaaggtgacccctggaagccaggtgggcacctgggcctcatgcaggttgggatgtgcatgtcaggtgctgacagggtgggggccaaccggggacagcggtcactgctgggccttccacgtccacccccacgaaggataacagcaaaatgtccctgccacctgagtgcccggggccaggtatctgcaaggatgagaaacgcacacgtaaactgacgcccgtccgctcggaacacactgcactaccccgccaaaaagcacttccaagagtcctcgcgtgtcctccacaagaacacaatgctctgcgaccggcaggagggtgactgggggtggttcatcacacggacgcagtgctctgcaaccgacaggacggtgactggggtgggggttcatcacacggacgcagtgctctgcgaccagcaggatggtgactggggggggttcatatcccacccccactcctcaggagcccagtctctgtcccccgcaccctccaggcctggtcacactctgcccacagcagagtgcaggggtggaggcagccggtacccagctgggtgaattgacgggccttgccatataccctcgggccacctttctgaaccctgccctancca

SEQ ID NO: 677463 - DNA, 133 bp, Homo sapiens
attttacgcgagagaagggagatgagattgcccacggttgcctaacagatgtggagcgtggcatgcgaacccaagcagacctggctccaggagccacatcctttaattattactaaacccctatttatatatt

SEQ ID NO: 677464 - DNA, 371 bp, Homo sapiens
  misc_feature (104)..(105): n is a, c, g, or t
caagcaaaagccttgaattctagacaagaggtgctgagtagagatcatgtcagccaggcacttagagtcagaagaggaaggaagcagacacactgctggagcanngccacatggcctatgacagaaagagacagagagagtcactgagcttctcaccctaccctaggcctcacacatatctctctcaccccacctttccctaaggtggcccaaattgatagggaaggaggcagggaaattctgggccaaagagggtaggtccccagcgagggccccaccctcaagccgaaaagcctaataccatggcccaaagtgagaactgacagccctgtttcccactcaaatgttgccttttccaaaacaacccatgg

SEQ ID NO: 677465 - DNA, 283 bp, Homo sapiens
  misc_feature (121)..(121): n is a, c, g, or t
tcactctaaggatagtatcgccacacgttcatgctcactactctcgttgtaggagagagtgggactcccagcaaggattacacccggcttgaggacggaactgcgctttcctcccacttcncctaggacttggcgatgcagtggcggacaaattcacactcagggctatgccagaaagcggtgtacaccagctcagcaaatttcaagcccaggccttgttttgattttgcacacctcccagtccatggtgaaggcctcgatgtctaaatgagtgtggtaaagg

SEQ ID NO: 677466 - DNA, 725 bp, Homo sapiens
  misc_feature (506)..(506): n is a, c, g, or t
gaaaaaaacagcgcgttcttccttagcaggatctagtgccggtagcacgttgtgatagacgagcgtgagctgcagaaactggcccctcgtacacatcttgccgatgactgtgctcagagaatacatatgcataccgcactcactaattggctagctccttactttgcttcatgaccctctacctacccgtatcatatatgtcgttcttactacctgaatgacttgaatctgataatatcagtgatcctctgatatgagatgagaacatttatttagacgataactacgaaccatatataacatatctatgcagtgcacatgagacacaaaacctttacacacaaatgttacatctggtacaagttgaaaaactctaagtcagtcacgcatgtactatgacaacatctgttgtatgcgataatcacacaagagctgttgcatcacctctgtaatttggggtgtgcatttgctgagtcagaactaagatgacctgaactccgccctcntcagggcctgctatgaggtgttgaagcctaattcttcatatgtgaccctttcgcatctacatagaccctccttcaacctatcctgtctggggctgttgagcgcataatctatcgcagagaatgattccccgtatataagacacaagctccatccactcctagttgaatagcactggaggcctgcgaatatgcaggggacttggtggcctgctttttatt

SEQ ID NO: 677467 - DNA, 1284 bp, Homo sapiens
cccacgcgtcgcggacgcgtgggtcgacccatgcgtccggccaataactatgcccgagggcactacaccagttggcaaggagatcattgaccgttgtgttggaccgaatgcgcaagctggctgacctagtgacacctggtcttcaggtgcttcttgtgtttatccagcagcttctggtgtggtgtgcactgtgttctgtgttcacctccctgctcatggaacgtctctcaggtgagtcatggccagaagtccaatgctggacgttcatccatttacccagcaccccaggtttccacgagctgtagttgagcccgtagaacatccatcctcacgcaaccacacgcacccttggagccatctgcatcagtgccattccatggtcagcaccaaggcaggcccatctcatgcaccatctagtctgtcagcaaaccttcgcatcatcgcagcggcctcaaccatacgactacggcctacaacctggccttcctccagggcaatgatctggtgtacctacccatacacctgactatccactgacgactacttgactgcgacggcccttgacacattgactgacacctgtaccagtaccttccaagaccgcaaagcgatgggtggccacataaaccgccacgcaaatccaactatccctactgggcccaacatattgccccattgcacaatcttctgcttgcagaaaggcctgaaccatgaaaccagtttccctggaagccggcaggactcaccaaacggccacgcaccattggagcccacgccgaacaccaccgacttcggagcaaacaggtacacccacagaacaccggagacccacacagcatggacaagccgcaccatagaaggaacacagaatgcaagaacaacggaacaccagcaaaacaggtcaatcccagcaataaggcacacaccacacacaccgcaagagccacgaccacaagcagcagaggcactgtcgtaccccccaggagcccacaaaagcatgacacaacacccacccacccccccacaccagggagccacggaggacacaagaacccgacacgaatacacacaacagccgagcgccactcgcggacacccaacaacagacccaagccgcacgcagccgcgacacgaaaaagaagagcaaagcgaagagaaaccaccgccgagcagccgaccaagaccgaagcgagcagacgatccgggagacgcacggagctgccactccacgcaagaccagccaaggccaacaaccgagaacatccccaccagacacagcagaca

SEQ ID NO: 677468 - DNA, 155 bp, Homo sapiens
agtctaacacacgttgaccctacttttttgacacttccattgtttaaaaatacacatggaaaaaaaaaaaccctatatgcttactgtgcacctagagcttttttataacaacgtcttttggttggtgggtgtgggattctttacctatatattat

SEQ ID NO: 677469 - DNA, 178 bp, Homo sapiens
ttctcatcttgcatggattaaatgcaacactgacaggtcttcactctcctcctccttgaaacatttcacttagcttctgggatgccacgttctttgtcaactctcacttcagttactccttcttgggctcctttgtaggttcgtcatttttctaaatgttggtgtgccccaggtgtag

SEQ ID NO: 677470 - DNA, 125 bp, Homo sapiens
cttaaaaaaaaaaaaaaaaattttggctgagaattggaaagggaataagggaatatccttctcactcagatttaaaaccctaccttttccccagttcccaaaccctaaatgccaggaaaggggta

SEQ ID NO: 677471 - DNA, 917 bp, Homo sapiens
ctttgcggaggcgcgccgtgttccgccgtgctctgtggcctcccttccccaagggtttccgggctcaaatttcgcgagtaccctcctcttccagggttctgacgtggtgttaccggcccccgaagaacttctctgatgcattttgagccggccctctcccttgctgcggccagacgctcccccacttgggaaggtatttcagagacctcgggtcccccactgcgtcgccagcgggcaagtttcgtcagcaggggtacttgccctcctgatactcccgcggcggtgcccatggtcccaacaccctcgttgcaagagcagcttacagtgtgccaaacatgtttgtgccgaaacgggctctttctttcccccatccccccctcctgataatgctcacaatgcttcttctgcccgccaggggacctcgtatgttggtggtctccccccgccccaaattgttgaaagcacttcaatcttagtggccgctaatatagtgttgatcccgccagcgcccccccgttgacaaacatcttttcaatagggagctaacaagtgggagtcaaacctgcaaattgtttattcctccttcttgtaataaacggcgcgcgcttttgatacattcgtcatattttacgtggcgcagcatatttttttaaaggcacgagaaaacctggggggtcacgagggggctaaaggatcaatcatccgtaatcgcgtgtgcccttggagacaacaacaattttgcgagatagagttcaactctaggagattctcgtttggagcctttggtagacagcagaaaatcattgcggcaccacgtctcgtaatcacccctgctgctgtcccccacttagtgtgatccacggagcattccctggcatcttgtccgggtaaaaaaaccccccccgccaaacaaaaca

SEQ ID NO: 677472 - DNA, 86 bp, Homo sapiens
ggatttgctggtgcagtacaactaggcttaatagggacaagctcagagagaagagaaagcgaaagcctccgagctctccaaaaaaa

SEQ ID NO: 677473 - DNA, 131 bp, Homo sapiens
ggcctcactttgtggctgctgaggcattacagcttaatggggtcatttggaaggcaattgccaggggttaatgtagtatagagaggtagagtttttttcgtgatagtggttcactggcctacactagtgga

SEQ ID NO: 677474 - DNA, 104 bp, Homo sapiens
agtctcgttatcgcccaggtggagtgcagtggtgtgatcttggctcaatgcaacctccacctccaggagtgcagtggtgtgatcttggccattcaacgcctccg

SEQ ID NO: 677475 - DNA, 171 bp, Homo sapiens
gcccagacagtgctgaaccaatttacatggatccatgcccagttctccaattccttcatgtctgtcgtcctcctcttctttcttcttggcgggttattgattggtagggctatagatgggaacatatgggtagagggtgactgatattcaggtgtccacttgactttccat

SEQ ID NO: 677476 - DNA, 290 bp, Homo sapiens
attcaaactaggcaatcctaaacctgctcatcctacctcacctgttccttcctacagaaaccgcaataaagcctctcacccatttttttcttcctactccttccgtctcctgagctcctccatggggccctgcgtgatatgacacccccatcttcttgggaccttcttgggaaagtaacaaaactttcttctcaagagcagtcgtctcctggtctgttgaccttactctacctaaatcatgataaagcctatattttaaaaccattccctgccctggattttctggttcg

SEQ ID NO: 677477 - DNA, 451 bp, Homo sapiens
cagaggtccccttgtaaaccttggaggatattgtttgatattgaaactgagattggaggggctaggggcagaatatatggtttggctggttccctacccaaaactcaccttgagttgtaataatctccacttttcaaaggcaggccaggtgggaggtaattgagtcatagggcagtttcccccatgttctcctggtgatgaatgactctcacgagatctgatggttgtataaaggggagttcccctgctcatgttcttcttgcctgctgccatgtaaaacatgactttgctccttattcaccttctgccatgattgtgagtcctccccagccatgtggaattgtgagtcaatagaacctttttcctttgtaaattacccagtctggggtatgtctttcttaagcctgctgagaaaggactaatacaattatttatagttaaagtattgtgg

SEQ ID NO: 677478 - DNA, 134 bp, Homo sapiens
  misc_feature (37)..(37): n is a, c, g, or t
gtcaggaagcaggtcagatcatggagagcctcctacncttattcggaaaatcactccagctgcgtgtgagaagaagggggacagggctgatggggatggggagacaagtctgaggctgtcacagatgatgagtg

SEQ ID NO: 677479 - DNA, 401 bp, Homo sapiens
  misc_feature (106)..(106): n is a, c, g, or t
  misc_feature (203)..(203): n is a, c, g, or t
  misc_feature (358)..(358): n is a, c, g, or t
ttcggcacgaggggactccccttctgtcagcatgaagcttatccataattaacgaactctgctcttcccagatttaaaatcaagatgaaattaatgtttcccttanaaatgcgtgctgtggccccaggcacggtggctcatgcctataatcccagcactatgggaggctgaggcaggtggatcacaaggtcagcagttcaagnccatactggccaacatggtgaaaccccatctctactaaaagtacaaaaattagcttggtgtggtggtgcatgcctataatcccagctacttgggagggtgagggatgagagtcacttgaacccaagaggtggaggttgcagtgagctgagaattngccactgcacttcagcctggtgacagaacaagctctgtcaaaa

SEQ ID NO: 677480 - DNA, 510 bp, Homo sapiens
ttactgttaatggccgcgtctgttcaccgtgttgcgacggctcgacgctgtgctggaaggcaccaaggacgcggtgctggaacgcaaaaagttcctcgacgtccaccaggtggccgagcaggacggcgcgctgcgtatggcggcgggtcaggcgttctacaacgtctcggaattcacgttggccaagctcaaggccagcgcggcagggcagcgctgcgtgatgacttcattgcgtatctggacggtttctcgctcgacgtgcaggagatcctcaccaagttcaacttccgcaaccagatccagaagctggtggattcccatgttctcggctacctgatcgaagacttcctcgaccctgaggtcaatcttgcgccgctgcggtgaaggatgccgacggcgcatcaagttgcccgcgctggacaaccatggcatgggcacggtgttcgaggagctgatccgccgtttcaacgaagacaacaacgaaagacgcggcattaacagtaacgaaag

SEQ ID NO: 677481 - DNA, 262 bp, Homo sapiens
  misc_feature (12)..(12): n is a, c, g, or t
  misc_feature (23)..(23): n is a, c, g, or t
  misc_feature (88)..(88): n is a, c, g, or t
  misc_feature (90)..(90): n is a, c, g, or t
  misc_feature (122)..(122): n is a, c, g, or t
  misc_feature (161)..(161): n is a, c, g, or t
  misc_feature (176)..(176): n is a, c, g, or t
acttctttagancgaggaatganccagatgggaagggttccctggtaaaactccaaatggcctgtgcactgctctggggtggagccananaagttcgctcctcagtttgcagctgggaggancctggccctcctcttcctcgggagaacctgggatttaanctgtgaggtgggaancctacaactaggagaactctggctctgctgagtccctgttcccctttttcttcctttacacccaataaaaccctgccttacccttc

SEQ ID NO: 677482 - DNA, 316 bp, Homo sapiens
gctcgaccagggtgtggtggtgcatgcctgtaattgcagctactcaggaggctgaggcaggagaatcacttgaacctgagaggcagaggttgcggtgaccgagaccgcaccattgcactccagcctgggcaacaagaatgaaactccatctcaaaaaacaaataaataaataaatcaaacaaacacatgtccacacaaatgcttataacatcattattcataatagccaaaaggtacaaatgatacaaatgtccatcaactgatggaatatggaaaaacaaaatgtggcatacacacacacacacacacgtcgacg

SEQ ID NO: 677483 - DNA, 204 bp, Homo sapiens
gtaatttttgtgagatcttaaacttagggcaggaaaaccacctccggtctgtctgacatagcagggacattataattgcagctgttggcaaaagagctctttgtttcacctgacggtttgaaagaactgatgggatgtctgggcagagcaatacatttaaaaaagtgaaatgaagcttgacaaactgggtatgttgaagcttgg

SEQ ID NO: 677484 - DNA, 107 bp, Homo sapiens
ttcgacggaagcacccagctatttttttgtattgtttgtagactggggtttcgccacgttgcccaggctagtctggaattcctgcaggcctgcctctctgtcctgtc

SEQ ID NO: 677485 - DNA, 361 bp, Homo sapiens
agtgcacctgaatgcctgtaggtcgatctagagtatccccatattgcggacgaatgtgtggtagggctggggggcatccatattgtcacttccaggtttatggagggttcttctactattaggacttttcgcttcgaagcgaaagctcctcaaatctatgacaattatccctattactgctgttagataaatgaatgatcctacagatgatcggattgtttcatgtggtgtatgcatcgtggtagtctcgagctacgttcgggacattccggataggccgagaaagtgttgtgggaagaaagttcgatctacgccgcataatatcattgttaattgcattttggcgtacgtttggtctcgt

SEQ ID NO: 677486 - DNA, 122 bp, Homo sapiens
agttttgggaaatttttttgaaattggcatgttttcggcctgtcttgaaaaaatctgtttattaattaaatttcaaacccccccccttttaaaaccagttcagttatttttccctggggcca

SEQ ID NO: 677487 - DNA, 190 bp, Homo sapiens
gatctcatagatcggatccccatcgaaacctctgactttcgttcttgattaatgaaaacattcttgtgaccggcgcatgacggaccacagcgaagagcactttgccaaagaatgttttccatttaatcaagcaacgaccagtcgagagggtttctgatgacagggatttcagattacaagggtttccgat

SEQ ID NO: 677488 - DNA, 314 bp, Homo sapiens
gcaggatcctagaggtcgtataaaaaatagttgctgttatctaaaaattcaataggtgagttagacatggcttttcaagtaggattttcagtggcttcagattccatcatacacaagtgtatgttttttctagtgtaagttttttcccgtgtaagttttttcccgtgctcaacacgtaagtgctcaaccaatctttcttccccactttaagtctagctaatggtcaaaaaacttgcattcaagcttttggtgtgaaagatcctggttttccgcaggaatatatttaaattgttatcctaatgggatgaagagaa

SEQ ID NO: 677489 - DNA, 101 bp, Homo sapiens
gattgcaggcgtgagccactgcagccagcctcttttttgtttttctggttcttcagcctgaaatttcagagagttcacagacaagaaccggggatccttta

SEQ ID NO: 677490 - DNA, 1028 bp, Homo sapiens
ggagtgtgtgctccgggctcggaacacacattattattaaaaaatccaaaaaaacatcgtcaaaaaatcttttaaaaaaccccacaaaaatgtacaaaaaatccgcgtcgtcccccgcggagactttatatttttattcttcctcttttattaaaataacccggtgaagcagccgagacgaaccggccgccgagtgccgaagagctccaagaaggaaacaagaagaactgaggcattcccgcatgaccggaaccgaaacgtcaaccatcgcattacccgacggaagcgagaagcacagaaggaagatgtgatcagagacccggcaatggcgggacgaagaagatagaaactcaaaatacggaaggaattactggaccactcttgagatagcatcgcacgattagaaaattaagatgacagcatacaaccaataaaaacacgaaaaaaaatctaacacaaaacgcgataggcacacaacagccagacgcaaccacagagaaaaaacgacacagcgacaaatacacatccgaccagctaacacaactgacaacaaaacaaacaccacaacaacgacacgaggaacaatacagcgaccaacacacacccacaaaaaacagagagatcacggcaacaaacataacaaagaaaccacgaaaggaaagaagacatagaaagcatcacataccgccatcagcggggaaacgcacacaccaaagaacagcgagcacagataacacgaaagaaagatacacgaaacaacacacgaatagaaccgacaaaaacgccgacacgagacactaaaaagaagatgaccaagaaggacacaagaaactataagagccaaatacagaatcacagaacaagaccataccaccgagacataagacaagacaacaacacaaacaaaacagacagactcaacaagaagcaagaaagacacgacaaccaagccacgtgccagccaaccgagacgacaaagacaacagagcaaaccaccacacgcagaacgacacaaacgacacacgaaa

SEQ ID NO: 677491 - DNA, 638 bp, Homo sapiens
ggcgaggcctgggtgaggctggcgagggcggcccgacggtgcgcgggacgggacgtgggcagcgagtggcgccgggagccgtttcccggaatcggggcgcttcgctcaccgggccccccagcatgaagaccccggcggacacagggtttgccttcccggagttggtgccgtacaagccaagagtcgtcccctggtcatcaaggcacgatccagctgtggcgactttatcctggagctgcatgcgtgaatggaggagtaccagggcgtcatttgcctgtgcagggtggactacggggaattcgtctatcgaaatgacccttgatgagtgtggcccggctgtggggctgttcgctaaggttgctaagccccaggatgaacttactgatcaatgctgtagtccgggccctgcgctattactataacaagcgcattctgcacagatgaccaagggtgaaacgcgttcagccttacgagagcttcaactttcaacgaagactgtgtgctggtcaattacccattcgattgatgtggggttggctgagtgggtgcagtgccccgagagtttgctcccgcctagatgccgtcgggtggtagcacacttccgcttccgctcccgtcggtgcgctcgtccgaggtgc

SEQ ID NO: 677492 - DNA, 281 bp, Homo sapiens
  misc_feature (12)..(12): n is a, c, g, or t
  misc_feature (93)..(93): n is a, c, g, or t
  misc_feature (115)..(115): n is a, c, g, or t
  misc_feature (119)..(119): n is a, c, g, or t
  misc_feature (266)..(266): n is a, c, g, or t
ccggggcccatnaattctaccatgttcctcaaccatgtttggggtggaagctgaaacggcaggaaccccgaaggaatgtgaattcgcaaacgnctttgcctgcttcgaacgaggnaagnctcaggtttaatccatgaaggaccgacctccgggaagctgctcaccaccatgggtgaccgcttcaaagatgaggaagtggacgaaatgtaccggggggcacccattgttaagaaagggcaacttcaactacgtggagtttcacccgnattccttaaacatgg

SEQ ID NO: 677493 - DNA, 196 bp, Homo sapiens
gctcaggcagttcttctgccttggcctcccaaagtgctgggattacaggtgtgagccccatgcctggccactgtcagcatctattaaatttactgatccaactcagctgacttacctggtagcaaataaaggctcacttgacattcctgcattgataaaagctgcccacttaaaaaaataggtttctggaagcagc

SEQ ID NO: 677494 - DNA, 724 bp, Homo sapiens
gaagcacagcctgggtctgggccatccccggagcctgaggggtcgccaccagcccacccgcagtgaccctacctgtcacccagatgcgctaacagatggggcccaggccttcctcggtggaatcccacgggtcctgtcccaactgaatactgggatcgtgacttgcttgcatttgggaatgctggatgacactcagggcatttatcaagcgcacaatcgtggatctgcactggcaagtcttacacatcaaaggatgacccctaaacgacgagagagagcaggggacaggccaaggggaggcaacggacatggaggtaacgtatgaatagtaggaggcgaattgggtacagaacggaaagcatgatgtatccattaaggctcaacagtaaatcgattagcttaaaacatcgtaatagatcatataaaacataaggaacgcggaagtgaagaccgggctcccttcacaaccgagtcactcagagcaggagagaacccgcaattgccgctctgacttcctcgtcctacatcgtaagtctactctagtcacgctccactccatccgtgtcgccataaaccagctcagcaatactaaacaccgagcccaacaacaagaaggtctcatcagaagcagtcgactaaggaggacctctcgccgacgtcgcctctactaacgtaggccagatcttgctatccacacgaaggtgacggaacagcccatgaagcc

SEQ ID NO: 677495 - DNA, 238 bp, Homo sapiens
cgtcgacgtcagggcctgagtcagggcagggacatgaggctcgtggccagcgctgaacgagaggccacaatcccagggccagtgtggccagggtgcaagcaggggtgtctggagaagagaggaggcggagagggcagtgacaggacgagagccatgctgcatgctccatgctctggggtccctccagctgagacctggcccacccagcaccccactctccctcggcaccagggtcgac

SEQ ID NO: 677496 - DNA, 798 bp, Homo sapiens
agctacaggagctatagatttgaatctaatgttgcgttagtcttgtcagtatatcttctacctccggtataatctactgtaataagtgtaatgtaaaggccttccatcaattgaaccaggttcatcttctatctcccctgggatttactataaacagttatattggatatgattggttaagaaataatttgttattaacaattctgtctgctaattggatctggaaaagtatccagagtactcaaaaggcaatgatatgtgagattgattatggtatgtccacggagccctgctcatcaatagaataaccgatatgtaataatcgaattcattttatatgaatcttgagtacgtggaccattgattggattgtaaacttatagtggcagatttgtctcgtttctgtattgcattgtgctattctccatgagtatcgctaaagctgaatagtttggtctcatgggttttcatccttagagaatccatggagaatagacttgagaagtgtatggaaatctataaatgtggcatgagggtgggtgggaagatgaaagttagagctatctatccccgtgaagaaatgttctggcaataatagttttcatatccttttcccaggggcaaaaaacaaaaatggggtaattccttttttccattacaaaacaattttttgcaaaatggaaaccctttaggaaaaaggttctttaaacaatttttaaacgctaattggattggccccaggaaattacacgtttggaatgtggttaggaagaagaaactcgggttaatgggaatttg

SEQ ID NO: 677497 - DNA, 969 bp, Homo sapiens
tgcaggcggtagcagaaggcagcagcagcggtggcgacatgagcatgcggcggcggcgtccgggacagggcgggggcggcccgggtcgggggactgggcccgtggacccccgacaagcgagacacacaagctggtggtcgtgggcggtggcgggttgggcaagagcgcgctgaccaatccagttcatccagtcttacttcgtgtcttgactacgaaccccaatatggaggactccttacagcgaagcatctgcagtcgtgccatggcattcccaggccgggctgtgaacatcttgggacaccggtcgggcccaggacagagttccggggcccattgcaggagcagcgagtaccattgcgtgactgtccacggtggttcgttgctggagtgtcctgcccattacacgcgaaccggtcaagaggtttcacacgtcaggttgcggccacagcttcatttcgacggcgaggctattccgtgcgaggcgctcaaaggtgtacccgggcggacaggacgttttacccccgcggatgggtggctcgggcaccggggagacacccaacgtgtgccacgtgaatttcgtggggtcagttccatcaagccgcacatagggagtttcccacccgcgtaattcaatgaaatagccgcttcgtgtgccccttttaggggaggggccattcccccaaatcaatatggtttgtgaccccataagcgttttttgtggaggagacccttctgggggctcacacacaacgtatgcgggtttactttccaaaaggtgttttgatcaccgacaagcgacatattatgagtggacgcccaaggcactggacatccacgagcgatgtgttccccgtgagacagcatttagcccacagtggaaacaaccaaaggaaggggcttctaccaaaagctggaagtgtcaacatttcccacgataggtgttgccctcccccatgggggcaaacagaa

SEQ ID NO: 677498 - DNA, 316 bp, Homo sapiens
gagagccggggatgaaagtaacgggactggagagcagatgggggtgtcggcttacgtgcgggaggccttctgtccggggaacagtcatatctcgaggtacaaaggccaaaagcggagaagcggtgggctaagataggtcctacagcaaaccacccctccatattgccgtaccatttacaatgcgagtatctgtgacatcgtgggaaaaccacgggcaggaaaaatgcagatattctcgtaagtttatctcttctataacacgtctatatagagctagtgtgagtactaaccacagtggaataatagtttataaaag

SEQ ID NO: 677499 - DNA, 99 bp, Homo sapiens
aagcgttcaagctcaacacccactacctaaaaaatcccaaacgtataactgaactcctcacacccaattggtacaatttatttcattttggaagcgtgc

SEQ ID NO: 677500 - DNA, 103 bp, Homo sapiens
caggacgcgggcgtcaggacgccagagctgggtcagagctcgacgccagcggcgcccggagagattcggagatgcaggcggctcggagtggtcgcgacgcttg

SEQ ID NO: 677501 - DNA, 368 bp, Homo sapiens
gaaggtagtattatacaagaagtaaagtgatataaactgacacatctcttactcactctcttaattatatcctcctcatggtatagaactactgacacattttttttactcatcttaattatttcctaatctggaaagtgctggcgactacaggttcctgccaccaccacccagaaaactaatagtattaatagtagagatggcgttccccatgttggtccggctggtcttgcactcctaacctcaagcagtccatccgcctcgacctcccaaaatgctgggattacaggcatgagccactgcacccggcctattgttgtacgtcctacatctacatgtacaaactaaaacttcatgcagcctcctac

SEQ ID NO: 677502 - DNA, 483 bp, Homo sapiens
  misc_feature (31)..(31): n is a, c, g, or t
  misc_feature (38)..(38): n is a, c, g, or t
  misc_feature (89)..(89): n is a, c, g, or t
  misc_feature (193)..(193): n is a, c, g, or t
  misc_feature (216)..(216): n is a, c, g, or t
  misc_feature (373)..(373): n is a, c, g, or t
  misc_feature (387)..(387): n is a, c, g, or t
  misc_feature (458)..(458): n is a, c, g, or t
  misc_feature (467)..(467): n is a, c, g, or t
  misc_feature (469)..(469): n is a, c, g, or t
ccattgtcccctactccagcaactaagacangcacccnccagcccactgcgactcccaccacgaaggaccccagccctctctcagccanacaacggccccgcccaccgtctcagacatcgtgcttcttctggtgggccaggagtctctcctcgtcgtcgaaggtctggccacagatggcacagcagaaggctncgtcccggatgtggctcttgcgntgggtgatgaggttggacttctggctgaagctgcggtcgcagtcgggacaggcgtaggccgctcgcccgtgtggatgcgccggtgcgacaccaggttggacttctggctgaagctttgccgcagtcggggcagacgtaggcttctcgccggtgtggnatgccggtgcgccnccaggtagggtttgtggcggaagccttgccgcagtcgggacacacgaagggccgatcgggggcgtggatcncgtatgcgncncagatggctgccct

SEQ ID NO: 677503 - DNA, 394 bp, Homo sapiens
gggcccatcatgtcgctgatgagatagttatgtttatcgtaatggtgcaaatgaatttgctcgtggcaaaagaaaggccttgtgactcttaactagaaattgatatatgtgaatgtcctctggtgatatttataattgctagaatttaatatttaggtgtagctttaaaactgttgttgctagtattctttaggaaaagtactttgatactgaaagcctccagccccaaccttttttagttcaataaaacaattgagtttattttaaatatgatatttgataacattgtgtaggcactctctctcagattatggatgaacacattttattttctttcttctcccaggtaaagtattacagagttacattccagtcagcgacggggatcctctag

SEQ ID NO: 677504 - DNA, 452 bp, Homo sapiens
  misc_feature (211)..(211): n is a, c, g, or t
  misc_feature (248)..(248): n is a, c, g, or t
  misc_feature (430)..(430): n is a, c, g, or t
tttttgacccacgcgtccgggaagtgaccgatcgaaagctggcgtcggtggtgttggcgctgaggacccggacagccgttacatccttgctaagccccactccggctacagctcttgctgtcagatacgcatccaagaagtcgggtggtagcttcaaaaacctcggtggaaagtcatcagggagacgccaaggcttgctgttttggaaggncactatgttcatgctgggaacatgggggggacacagngccatcccccctggcacccaggtgcccatgtgggtgttgggaagaataaatgtctgtatgccataaaaaaggggatagtccgctacactaaggaggtctacgtgcctcatcccagaaacacggaggctgtggatctgatcaccaggctgcccaagggtgctgtgctctacaagacttttgtncacgtggttcctgccaagcctg

SEQ ID NO: 677505 - DNA, 193 bp, Homo sapiens
caagctgactcttccctttcatgggtagactctacacgcctctgtggtcaacagcccatcagcgggtactcacgatttgttacttgtgtactgttgcagctagctccagaagccatcccccagaattagaaatttacggctattaataaatgcccagggtcattctcgtgacttgttttgcttatagtcctaa

SEQ ID NO: 677506 - DNA, 107 bp, Homo sapiens
gtgtgcaatggagcgcccatcacatctgggagcagaaaagggatgaatgtgagcagagcaaaggctgggttgagaacaagaggggagagtgggatgcgggaagtggc

SEQ ID NO: 677507 - DNA, 377 bp, Homo sapiens
  misc_feature (10)..(10): n is a, c, g, or t
  misc_feature (312)..(312): n is a, c, g, or t
  misc_feature (354)..(354): n is a, c, g, or t
aagaagcttnaagaggaaggggaacagttcgtgaagaaaatcggtggcatttttgcttcaaagtgaaagatggccctggagcaaagaagctacctgggtggtggatgtgaagaatggcaaaggatctgtgcttcccaattcagataagaaggctgactgcacaatcaccatggcctgactcagacttgctggctttgatgactggaaaaatgaaccctcagtcggccttctttcaagggaaactgaagattgctggtaacatgggactggccatgaaactacagaaccttcagcttcagccgggcaaagctnagctgtgaggagtccctttggcaacctcaggacatcaagatnagatgtgtaggataggtagagat

SEQ ID NO: 677508 - DNA, 203 bp, Homo sapiens
tctgtactatgcatgcaaagatatttcaacacttaattggtgcaaccaaatgtgtcatcgtgtcataaacagcatgtatcaaaattcagctttaataaactgatttaagacagtaaatttgaaagcacaaacattcaagtctccattcaggagtggtccattcatgttgcatccatctcagacatcaacactagattcaaccc

SEQ ID NO: 677509 - DNA, 538 bp, Homo sapiens
  misc_feature (27)..(27): n is a, c, g, or t
  misc_feature (142)..(143): n is a, c, g, or t
  misc_feature (156)..(156): n is a, c, g, or t
ctggatctgcctctgcaggctggctgnctggtgccccgaggatggctgctgagccccaggccatggtcccctctcgcaggacgtgaacctgggatgccacgccctcgctgcggggcctgtggagagtgggccgggccccggnngccctgagccggnggatggctcgccccgcccggagcccctagtctagcccaggccgctccgccctttcccacacaccggccctggggaggttgagaactgggcgtggaaaagataccccagtctgcggtgacgaggacgtccaagtgcccgaagtgcaggctcgaccaggcctagctcagtgcctgagcccttagcgtggactgggctggacccggaagccccaacgggctctacctgacccatgcagggtagaacacctgaaggagaagctcattagccaggaccaggaagtgagaccgactgcgatctgagctggggggacaccgaccttggacgcacagcaccggggacctgctgatggctggagaatgagccgactgacagcagggagact

SEQ ID NO: 677510 - DNA, 237 bp, Homo sapiens
ttcgttatgaggtcgttaaaaatccaagcaggtgccgggcgtggtggctcatgcttgtaatcccagcactttgtttgggagattgaggcgggtggatcactcgaggccagaagtttgagaacagcctggccaatgtggtgaaaccctgtctctactaaaaatacaaaaattagccgggtgtggtggtgcaggcctgtggtcctagctactgagggtggctgaggcacaagagttgtt

SEQ ID NO: 677511 - DNA, 145 bp, Homo sapiens
agcggggaacaatcacttgaattgtagtgattgttaagtgatggttaagtgatggttaagtgatggttcaggtgatggtgaagtgatggttaagtgatggtaaagtgattgtaagtgattgttaagtgatggtaaagtgattgtt

SEQ ID NO: 677512 - DNA, 525 bp, Homo sapiens
gcgacctactactactaaattcgctgccggtcgaccactaccacttccccaagctcgacgcgctgatgaacatcctcatcctgctgcccttcgcggtgcgccggtggtgtcctcggtgggcctgttgcagctctacggttccggaccgttcgccatggtcggcacgccgtggatcctgatcggttgctacttcaccgtggccttgcgttcatgtaccgggcgatcaccaacaacctgcaggcgatcaacctgcgcgacctgatggacgccgcccacctgctcggtgccagcacctggcaggcagcgttcctggtggtgctgccgaatctgcgcaagggcctgatggtcgcgctgctgctgtcgttctccttcctgttcggcgagttcgtgttcgccaacatcctggtcggtacccgctatgaaaccctgcaggtgtacctgaacaacatgcgcaacagcagcggccatttcaccagcgccctcgtgatttcctatttcctcttcgtgctggtgctcactgggtcg

SEQ ID NO: 677513 - DNA, 183 bp, Homo sapiens
gtggtgtggagcagtgtgacagagcccaggatggaagcaatggtgagggcacaaatgtgaggggcagtgttgcttcagtgtgagaagcaggagggagaaagtgggaccagcatgtgtgtgtctagtgggaacggggctggtgtgtgacgggaggcagacgggggatcctactagatgctcgac

SEQ ID NO: 677514 - DNA, 245 bp, Homo sapiens
tataatggctctaccaaaacaactaggaatggccccctttaattcctgagttccaaaggttacccaagggacccctctgacatccggcctgcttttttttacatgacaaaaactagcccccctctaaatcatttaccaaatatgtccctcactaaacgtaagccttcttctgactctctcaatcttatccatcataacaggcaggtgaggggggttaaaccaaacccacctactccaaatcttat

SEQ ID NO: 677515 - DNA, 763 bp, Homo sapiens
agggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggttttttgttcctaagtgtggttatttacaagaaatttcaaatttcccctgtgcttggttcccagagctaaatttcaacatgtagaggtgctaattcaacaaagtgctgacacggtgtacgccaaaatagtgttacacttcaagttcaaagaccgtggtatgctttacgccacgcattgcatattgcattaaggtttgccacccgtcaggtccgtgccaagtttacaggtgagcttacaagaccgagtcacagaagaaaaatgcagagtggatttcaaagcattctccgtgttgttcgcgcatggtggggttagtgtacattcttggactgccatatttgggctacgttgacacttctagtgaccaacgctgcagatccagacgctcgcttcaacagaatattcagagtaacagatgacacttctcagtcctggacaagtgcgacctgcgctgtcaattgattgctggtgcatcctcaccagctgccaggtgtcaaatcatatacaacgg

SEQ ID NO: 677516 - DNA, 124 bp, Homo sapiens
catctcctgttcctgagcccagtcagcaaattcgggcaggcgaggcacccgagtggatgatccagcaaatagggccaaaacttgatgggaaaatcccggcgtccagagctcaggagttttctgg

SEQ ID NO: 677517 - DNA, 305 bp, Homo sapiens
gagatcatgagatctcatcactcaggatggctgtgatttattttattttattcttttttttttagacggagtcttactctgtcgcccaagcgggagtgcagtggcatgatcttggctcactgcaacctccgcctcccaggctcaagtggttctcctccttcagactcccaagtagctgggactactggcatgctccaccacacctagctaattttggtactgttaggagagatggggcttcaccatgttggccaggcgggttatgagttggagtcatcttctttcagtgtctttatggtagaaag

SEQ ID NO: 677518 - DNA, 177 bp, Homo sapiens
aggcctgttgactgcgtgttgcttggggtgcacctcgtcgtagaggaactctgcctgtcagctctgccccatcgccactctcacttctcttggcgatctccagctggaagtcctgctccatggagtcgaggcggcgtgtcttgacgctgacgtacgacgattcgctccttgactgct

SEQ ID NO: 677519 - DNA, 102 bp, Homo sapiens
cgattctgaccaaaacatttaattgagtcagggtagaaaaaaatgcaaaggccttggtccctaggagaccaacactccagctgagctggccttagccccagc

SEQ ID NO: 677520 - DNA, 230 bp, Homo sapiens
aatgggaatgaacatcctagtcatcatctcatagggtagtaacaggtcatagagggcctgaaagtataagcaaaaatgtagctatattatcctccctagtcttatccatacctgacataataatttcacttgtctctattgcttattatcatctccgactataattgtcacatgctctgaaagcaagacatcagtctatacttggcttctctactctcagcacacgcgaa

SEQ ID NO: 677521 - DNA, 844 bp, Homo sapiens
  misc_feature (1)..(1): n is a, c, g, or t
  misc_feature (681)..(681): n is a, c, g, or t
  misc_feature (723)..(724): n is a, c, g, or t
  misc_feature (726)..(726): n is a, c, g, or t
  misc_feature (728)..(729): n is a, c, g, or t
  misc_feature (759)..(760): n is a, c, g, or t
  misc_feature (766)..(766): n is a, c, g, or t
  misc_feature (779)..(779): n is a, c, g, or t
  misc_feature (781)..(781): n is a, c, g, or t
  misc_feature (784)..(784): n is a, c, g, or t
  misc_feature (786)..(786): n is a, c, g, or t
  misc_feature (797)..(797): n is a, c, g, or t
ntagtggaaagccagcagagcccgacgtcgtgtgatctaccagcgcctgcgcccctccccttcagagccgcacggcttcagaacccctcgtaacggagagaaacgggcgctcatggcggtgcacagtccacagcatgaagacgcaagctcttcgtaggcagcacggcccggcccctcacccgtctgtccacacgaggggacccaagggggcatgctcagcgcagggacacagagtgaccaaagtcccgtcctgcttgcctggtacctgtactgtgctcatggagggacgaaagaggggcctgaccgcagactccacgtcaggtgcacacatcacgcaggagacatcggacaggacaacccgggctggctgcttgacagccagcgagaacggtgcagccgagacaggagtagtactcgacgtgtgagctagtgttcgtgcatggaaccttaggaggcactggcgcgtcaaagctccctccccacaccaagagaggaaggacccctcaccacccccactggcgagacaggttacttcgccgactagccatgtttttgccgaaaccaagattttgtaggaaatgattggccagcgccagggcccaggccatgtggcctgcccagcctcaatgtcacttggcggcggggtggggtgggggtgggcagcagcatcccagccttganatgcttcactttccttctctgtaaccagactttgaaaaattnntngnntcatcaggctctgttcctcaatggcctttnnctagtncctcccgagaatntntcntnttgtataaatnacaaagtgttaaaaatgtatttcctgaaataaatgtttcaaatgcgg

SEQ ID NO: 677522 - DNA, 380 bp, Homo sapiens
tacttttcacaggggtaagtcacatcagcctgtgcccaaactgcaaagggcaaactctcctctttccaaagataaactcggccgggtgcaatggctcacgcctgtaatcccagcactttgggatgctgaggtgggcggatcacgtgaggttaagagttcgagaccagcctggccaatgtggtgaaaccatctctactgaaaatacaaaagtagctgagcatggtggtgcacgcctgtagtcccggctactcgggaggctgaggcaggagaatcacttgagcctgggaggtggaggttgcagtgagccaggattgcaccactgcactccagtcccccgcccccgccccctgcaagaaaaaaagcaacctgtgtttgtgttt

SEQ ID NO: 677523 - DNA, 202 bp, Homo sapiens
ccccccttttttcccccaaaaaaaaggggggggggggggggggggtaaaaaaattcaccccaacccccccgtttttttttcccccgggtcccccaaaaatttggggggaaatttttgggggcccccgggattccttttttttaaaaacccccccggaaaaaaaccccccgaaaaattttaaaaaaagggggtttttccccca

SEQ ID NO: 677524 - DNA, 377 bp, Homo sapiens
tgggtgattaaggatccagtctatgattagggtagttggtctaggtgtagctgagcatagggaatcagtgaatgaaggtcctatgatggcaatacagtcctattgtaggactagtgaagtgggtacaacgtatacgtgtcgtgtagtacgatgtctagtgatgagtttgctaatacaatgccagtcaggccacctacggtgaaaagaaagatgaatcctagggctcagagcactgcagcagatcatttcatattgcttccgtggagtgtggcgagtcagctaaatactttgacgccggtggggatagcgatgattatggtagcggaggtgaaatatgctcgtgtgtctacgtctattcctactgtaaatatatggtg

SEQ ID NO: 677525 - DNA, 756 bp, Homo sapiens
  misc_feature (543)..(543): n is a, c, g, or t
  misc_feature (549)..(549): n is a, c, g, or t
  misc_feature (557)..(557): n is a, c, g, or t
  misc_feature (559)..(559): n is a, c, g, or t
  misc_feature (582)..(582): n is a, c, g, or t
  misc_feature (589)..(589): n is a, c, g, or t
  misc_feature (592)..(592): n is a, c, g, or t
  misc_feature (597)..(597): n is a, c, g, or t
  misc_feature (603)..(604): n is a, c, g, or t
  misc_feature (610)..(610): n is a, c, g, or t
  misc_feature (623)..(623): n is a, c, g, or t
  misc_feature (628)..(628): n is a, c, g, or t
  misc_feature (631)..(632): n is a, c, g, or t
  misc_feature (641)..(641): n is a, c, g, or t
  misc_feature (647)..(647): n is a, c, g, or t
  misc_feature (652)..(652): n is a, c, g, or t
  misc_feature (661)..(661): n is a, c, g, or t
  misc_feature (667)..(667): n is a, c, g, or t
  misc_feature (691)..(691): n is a, c, g, or t
  misc_feature (733)..(733): n is a, c, g, or t
cggcggggcaggcatgggagccgcgcgctctctcccggcgcccacacctgtctgagcggcgcaggagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagacaatatctgtcttatgaaacgctctatgcaatggagccgcacagagacgcaggtgggcatctacatcctcagcagtagtggagatggggcccaacaccgagactcagaggtcttcaggaaagtctcgaaggaagcggcagatttatggctatgacacgcacggttcacgcacttttttggggacggncttccntgctcacncncccctattctcacacctaccgtnaagtatntcncccgnggctgnncccggnccccctgtgtggncaganaanncatgtcctnaaagcntgccnacctgaaanaaaccnatggaaaaaccctattgtgaaaangaacccacgaaagcttctgacgtgggccttccttaaagcccnaagttttaaagatgggtggtcga

SEQ ID NO: 677526 - DNA, 202 bp, Homo sapiens
  misc_feature (57)..(57): n is a, c, g, or t
taatggcgatccgcacaggagcgaggcgagtcaggttgtgcgtatatggatcctagnaccagcatgccagtgtgccaaggccacaggaaagcgagtggttggtcaaaatccgtgaggtcggcaatatgttgttttactggaacttactccctactgatgatgtgctccacacggatccgagctcgttcatctttcccagcag

SEQ ID NO: 677527 - DNA, 322 bp, Homo sapiens
ctattgaaggcacaggactacaacggttatacacaagaaattgataatgccagagcaactactagaacagagggattctttgtactcataaacaacaggaagtagaatttcggaacaaatacctggaggcgccatctgtctgacttagagcaacgtctggataaaagtcagaatgaccaagaagcttctcgctataacctgcagacgctcttagacattctggatgtgaaagatctttgaactaacagaattacgagataacttggtcaagctactagaatgcagctcaggaaagttaccctttctgtgcccatttcaaggt

SEQ ID NO: 677528 - DNA, 111 bp, Homo sapiens
  misc_feature (11)..(11): n is a, c, g, or t
  misc_feature (46)..(46): n is a, c, g, or t
acccggcgtanacccctctcttttcagggtcccttctaaacaggtncctcttagtgatcttaccatgctctttaaactcctacctcagccctcctaatgacctccggccta

SEQ ID NO: 677529 - DNA, 328 bp, Homo sapiens
attgaatagaaataatggcttttgaaaatcgcacaaagcaggccaggcacggtggctcacgcctgtaatcccagcattttgggaggccgaggcagacggatcacgaggtcaagagatccagaccatcctggctaactcggtgaaaccccgtctctaataaaaatacaaaaattagctggacatggtggcacgtgcctgtaatcccagctactcaggaggctgaggcaggagaattgcgtgaacccgggcccggtggaggctgcagtgagacgagatcgcgccactgcactccagcctgaagacagcgagccccgccgtctcgaaagag

SEQ ID NO: 677530 - DNA, 272 bp, Homo sapiens
ttattcgtgttgcacggttagaggtacgctggcgttaaacatgtgtcactgggcaggcggtgctctaatactggtgatgctagaggtgatagttttatggtaaaccaggcggtgtaagatttgccgagttccttttactttttttaaagctttccttatgagcatgcctgtgttgggttgaacagtgagggtaataatgacttgttggtagattgtcgataattgggctgtgaatagtcagttcagtgtattagatcctgacggcaggcttt

SEQ ID NO: 677531 - DNA, 168 bp, Homo sapiens
tcgagccggtcctgagatatcaggtagggaaaatgctcacgaaaaagcaatggaagttaacagcgtgagaatattagttcccaaagcggctataactcatgatatccccaacaaaaatacagaaggttcagtctctgggacatcataaagggagaattccgttggtca

SEQ ID NO: 677532 - DNA, 228 bp, Homo sapiens
acaatcagtgcattgctcgtattgtcagtccagcaattgtcacattctatccagaaatcagcctctaataatttcccaggccctcttctgcctcagagtgcacgtcacttccccatggaacccgctttgaccgacaccaactctccctcctggcttatgttactgctcctttgacacatgctgctgaagcaaccatctatcctttccatccagaaccatttgtctcca

SEQ ID NO: 677533 - DNA, 127 bp, Homo sapiens
caacaccttttgggacgcaccggacctgtcacgtctctctgtggacacgtggtcacgcgcactccgtgtcgaggctacgtctgggagggggactccttctacgacgtctgaccctgcatggcactgc

SEQ ID NO: 677534 - DNA, 362 bp, Homo sapiens
  misc_feature (239)..(239): n is a, c, g, or t
  misc_feature (293)..(293): n is a, c, g, or t
  misc_feature (304)..(304): n is a, c, g, or t
ttcatactcccaccagcaatgtagaagtgttcccttttcacaacatccacgtcaacatctattgtttttaaagatgtttaacaacatctattgtttttaattatggtcattgttgcagaagtaaggtggtttctcactgtggttttcatttgcatttccccgatgattagtgatgttgagcattttttcatatgtttgttggctgtttgtatatgtcttttgagaaatgtctattcatntcctttgcccacgtttttgatgggattatttgttttcttcttgctgatgttgtnttaaggtcctngtaagaattctaggatacctagtccggttggtcagaaagcatagttttgccaaagtat

SEQ ID NO: 677535 - DNA, 472 bp, Homo sapiens
gttggggctcattcaggatcatgagcatcatggaataggtctaaagagagggtacaaatatacatttcacctattcagaatgattacatgaaaaaaattcgctttccccaaagtctactatacacattagaggggtagctggtatgtgggccctacactaccaggtgaattagtttaacacttctcaaagacatctgaccaatcattgcagagagggaaagaatggtggaacgggcagataaaataaccctctgctttgcctcgtgtgtatccatgagtcaccagttgatgggttttcacattaagtcaccgtgtctgtcagagatggtctgaagcaagaacagcgtgtcctgtcatagacttagaaatacgcaggggaagtggaggggtcacatgcccaatagtcaaaccagtactcagagggccgtcccagtgcaaagactgtttggcagtcacattggaaatcagagtc

SEQ ID NO: 677536 - DNA, 276 bp, Homo sapiens
attgatattgaaaacttagctagggcttccagccctttaagataatttaaatggaaaattaaatgggtaacccgccatctaatgtcatgtggggggcagtttggatattgcatgaacagctaaggaatcccctgttttagggccaaagatccctccttgctaattttgttctggacagcttatgtaatattttcatgggggagacgggctctgggggctcagggccttgtctctaggaagattttggcaattcccaaaacagttttgaagattcca

SEQ ID NO: 677537 - DNA, 363 bp, Homo sapiens
  misc_feature (266)..(266): n is a, c, g, or t
cgacatatagaggatacccgcacgcggcggtggaatttagaatcacgcccttagcaaacggatgaaggaaacagatgtggggtgattgagtgagagatgacagctgcagggatggttgagagccgctagcgatggagagcagagggagagggccaggctccagacttccacacgcccacacagtatctttgccaggcctaggagaggacaggagcagctcttgcagctctgcgggtgtgcggccaaaggcaaggcccacggtctgnatgtcacttccccgactgtctcttgtgtggcttggccttgtgcaagacccagcctgtcacgacagagccttgtcacttcagaggaggagccaggatc

SEQ ID NO: 677538 - DNA, 164 bp, Homo sapiens
tatggtatattgaagtagagcatgatacattatgtttcaaggcattgaaacactgtcatcttcttattcacttcctgtgattgaatcgtagataactgaggagactgccccatgtggcaggtccttgtggtacggccccacttggcgcaggtggtccctggggc

SEQ ID NO: 677539 - DNA, 417 bp, Homo sapiens
agtttttctttttccaaggtgcccacgccacccctatgtcacgcctgaagtagttattgagaaagtcgtccctttccccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttggggctgatgccattttaggcctcagcctgtctgcatccaggcgctcattaaacccgcatgttgctccaaa

SEQ ID NO: 677540 - DNA, 256 bp, Homo sapiens
  misc_feature (53)..(53): n is a, c, g, or t
  misc_feature (147)..(147): n is a, c, g, or t
  misc_feature (208)..(208): n is a, c, g, or t
cagaagggagtgaagacagaaaaggaaagtgggagggcagcctgtctgggccnctgtggcagcttccaaaaatcatctcccacaaatgcttaccctctgtgctgtagatgcttcccaaatacactttgtgatttgaatgttcttganacgcccgtgccttgcctaatgctccctttgctcttcatgttgggaatacttagctcatcanatcctgcaaactaacttccatggaagaaaaaaaaagaaaaagaaaaga

SEQ ID NO: 677541 - DNA, 963 bp, Homo sapiens
  misc_feature (66)..(66): n is a, c, g, or t
agcccgttgttgctgcggccccagcgtgaacccccgcctgttttgcctgtctgctcaacgcggagntggttccccacgtggggggaaacaccttgtgtggtggctcccccctgtggtaagagctcctcggctgcctgcagggtgtttcatgtttgccagttccggtcgcgttgcgatgcccctgggagctgtcctttggggcctggttggcgccccactttcgggggtccccgcccacctggtgtcgcaagttctctgtggccgcagcacccactatgggtcccctggccccgcgacacatggtgtctgttgggcaacggccctgctgtgtgcccacccgggtgccgttagtgagcatcctctcgcggggtgcgtcattctatgtggccgcccgcctacacacaggggggctcccttatctctttgcccgcccgcctcttcaatctttcttgagcgtcttttacgagccggacacctctgagcgagagagccccacgacagtttatgagagagagagacatgttggtcgaccacctattcccggcacgaatacaactaaagacgagaggagcgctacttactgtcattcatgtctctgtctgacataagtggtggtggcacaccctcgttctgccacgcatacatgactgacatacctcctgttgagacgacgtgcgcccccctctctcattataggcgcggtgctccaaatcagagactcccgccttgtcgccacgtatgagagccgtgtaccctccttttctaggagtgctccgtggcagccctcatccaccgctcccactaatgtcggcaccccatactgcggtttcctagtcagcggggcagcccaccagtgagagcgctcttggaactgggggctttcttcgactccacatcaatgagtacactgctgtccttagccacgaccttcccataaaacacaaacaccccccgcccgccaac

SEQ ID NO: 677542 - DNA, 230 bp, Homo sapiens
gccctcggcctctatcaatttgcacgccattctgcgatcctgcgtcccgctggtcaacaatgaccctgttgcgcgcaatatcgtcaaagacagcgacatatctgtacgttttgatgccgccggtattaccccgctcactctcatttttgatcacggtaccgcacgcagtgaaacgtccaactcgtccaaagcagatctccgtcttggacttgtctcccccgagcacgtca

SEQ ID NO: 677543 - DNA, 267 bp, Homo sapiens
gtctcaccgtcatcaccaaagagactgaaaaagcagtgccccagagacattgaggagggcaatgtgaagatgctgggcatgcagatccccataaagaatgttgagatgctggcctctgttttggttgccattagtgtacccttctgctcgttgttctggctcttggtggagtggtttggtacaccatcgacgaaaagctccacgaataggaggtcctcctgattgaagcttagcttctttttaaacgtacctctaggcctaggattc

SEQ ID NO: 677544 - DNA, 1723 bp, Homo sapiens
ttcaacatagttacacgagagcgtcggtgtggggcttgtcttcatcttgcatagattattgtgtttgtatgtttgtcgtatggtgaggtcgtagtgcgtgtcgcttttataggctatctcaatatatatacattagcttgttagttagtggttgaagaggtaagtgtgcagacgctcctagcgattgttttgttagtgagtgtttatatatgtttagtagttatttttagtttttatccgtgtcacttacgtaactttgtgttgcttatagttggttaggtttatgtgagtcgcattcaccgccgtaagtatgatgtgggttgactgaatgactacgaggtcgttgtgtgtttattaggttattttgttgtatgtaggagatccacgtcgctgtagttgtgatgtatggtggttggttgtcgtcgtgcgtcagttgttgcgtgagtcggctgctctagaggtcgctgttcgttgttggtttagtatgtttatgttggtaccgttcatacattgctctatttagtgtagttgttttactttcgtagtcagctcgtgtatgtagttgtgttagactaagtgttgttgatgtgtgttgtaatgtatgttaattagtgctatctcttctttccgagctagcgtatgctagtcgatcattcttttatgttttcgcttatttaagtctgtttgttggtatgttagtgtggtgtggcttgctgagctttctctttcgtttgtttttcaccacgtgtctgtgatttatgttgttctcttctgttggtgctgctatttagcatgattaggaaggaggtcggatggttttgttgtatatgtcttctggccgctacagtcatctatctattattatgtatggatgttgtggttttttttttattgttgtttctgtatcaggagggatgtggttgattgctcctcccgccatctttttgttattgtttttctgtggggtgtgaccgtcacaccccgcgttattagggtacgactccactcggacacgagtattacgcgacgctccacatgatgataactatcttcattgttctatgatgtgtgagtatattattattatatatgatgatgttttgttgtgcggtggcaggagaatatattatatatgagatggtgttgtggttgtttgctttaccactgcacacgacatcatcgtgtttgatgttggtggcgcgctcttcttctctctgcgcgagtttatgataccgcgcgcgctctgctttttgtcgttgcgcgtagtgctcttctcgctcgcgcgcgttgtcacatcatcacaccacctctcgcttgtactctctctctctctctctctttctctctggtaggtggcgctctctctctctttgtgttgtttctacacacgcgcgctctatatatatatataatatatatttgtttgtgtagtagtgtgtgtaagaacacactctctctcttctgtgtgagagcagcagagagagaatatatatcgctatatatatagtagtagtagagagagacacacaccctcctccctaccgcgcgcggagggagagaaagaagaagagagacccccaccccctccccccacacccctcggagagaaacaccccgaaacaaaaataatatataagacacacacaaaaaaagagagagagagatcaggacccccccccaccggggtttttcccccccccccttgccctctttttttttttta

SEQ ID NO: 677545 - DNA, 212 bp, Homo sapiens
ttctccaggatcttcttcagtagaactaactgctgataactctgtctgacatactctattttctcctccacccatgccagacagaataattggcttgaaatggccaagcagtccaacctttctttcttttttgggtctgatttatagataggcccagagaatatacaacaaacatgttcttaggctcaggtgagttcaacacgacccattct

SEQ ID NO: 677546 - DNA, 243 bp, Homo sapiens
gcaaaagcaactggccgggcgcggaggctcacacctgtaatcccagcactttgggaggccgaggcaggcgcatcacctgaggtcaggagtacaagaccagtttggccaacaaggtgaaactccatctctactaaaaatacaaaaatcggccagtcatgatggagcacacctgtggaccccgctactcaggaggcagaggcaagagaatcacttgaacccaggaagcagaggttgcagtgagcc

SEQ ID NO: 677547 - DNA, 282 bp, Homo sapiens
cttttttttttttgatacagaatttttttttgttgcccaggtgggtagtgtaatggcgcaatctcggctcaccgtaacctctgcctcctgggttcaagcgattctcttacctcggccttccaaatagctgggactacaggtgtgcgcccactacgcctggctaattttgtatttttagtagaaacggggtttcaccatgttggtcaggctggtctcgaactcctgacctcaggtgatccgcccacatgggctcccatgaatttttacctataaaacgaaatc

SEQ ID NO: 677548 - DNA, 267 bp, Homo sapiens
gtgactctacaggatcattaacgagccgaagacatctagactttgagcagtaggtggccatagagcgatgccggaagagctgctgatggcaattactacaatgcaaggaagatgaacatacaagcactatggtagaccccatatgacgatctttttctatgctgcgaagaaagatacctgagaatctcatacaactggagtcgtgtgataggaggcaacgaagcttgggcatgggtaaatgtcaagtgaggctgttgaggatggcac

SEQ ID NO: 677549 - DNA, 279 bp, Homo sapiens
aacggggacgcgctcatcttatatggtctgagcaggaggacagcgatagcagtgggagctgccacacacacacacacacacacacacatctctctctctctctctcttaaacacacagatctcatgagaactactcatgacaacagcaagacggacatccattcccatgatagagatcacctcccaccaggaccctcctcaaacatagggggatacaatttccacatgagaataggacagagacacaaactccaaaacactatctatcagaaccaagaa

SEQ ID NO: 677550 - DNA, 225 bp, Homo sapiens
tcctgtggaagacggacgactgggaaaagaagaagtgaggcctacgccgggacaggctgaagggcaggtagtgccaggtatgctgcagctcccggctgacgaacctgtcctgtaagagctcgtctatgatgctggacgcgcggctgacgtggtcctgcatgacatccagcatgcgcgtctgatgccggtcgatctccagcagctagactatgcggtgaccattca

SEQ ID NO: 677551 - DNA, 394 bp, Homo sapiens
  misc_feature (304)..(304): n is a, c, g, or t
  misc_feature (344)..(344): n is a, c, g, or t
  misc_feature (373)..(373): n is a, c, g, or t
  misc_feature (380)..(380): n is a, c, g, or t
atccccttggtgactctctaattggatgtcctgggtcctcccagttcttagtcctttaatacctgtttttctccttttcttatttggacttgtgtcttctgtttagtttctcaattcgtacaaaactgcatccaggccatcaccaatcattctatatgacaaatgctccaacaaccccacaatatcaccccttaccccaaaatctttcttcagtttaatctttcccactctaggttcccacactgccccaatcttcacttcaaaggcaaccctgaggaaacattggccattgatctcttccatnattcaccccccaaaatttttcggccggccccaacactttnaccaccatttttgtttttgtttttttctnatttaanataagggagggaca

SEQ ID NO: 677552 - DNA, 104 bp, Homo sapiens
tcggctcatctcaggctgttgatcggcggtgagttgtacacactcttagcggatcgacttcatggcacgtctgctgtctatatcaccacactttctgggtctgt

SEQ ID NO: 677553 - DNA, 587 bp, Homo sapiens
agcgggccgcactttcactctccgtcagccgcatgcccgctcggcgtccggcccccgacccgcgctagtccgccagggatagaaacagaagaaaaggagacagagcgacagctgagggataatcgttgcaaacgcggcaccagacaatcaaaaaacggcaaagatcactagtcagaccaacgcaaaatccgaccaggcacgcaagcacgataatctccagcaagcctaacgaacagaacagaacgaaacacaagaaggagacacacacacaaaaatcatagctgaaactgcggcacacagagcgaagtacacaattagtcacagataacaaccagatagacaaagtaacacacacaccaacacagaggctaagaaagacgacaacgtgcgagcagcacagaaccacataaacacatgaaacaaaacacagagcacattaagaccacagacagagacagaccaaaaaaaacaaaaccgcagagccaacatccaagacagacacaccgccgaaaacatgtccaagacaggcaaaagagcacaaccatgcgaacaaccacacgcaaaaccaacggcgacacacagaaaaa

SEQ ID NO: 677554 - DNA, 494 bp, Homo sapiens
acgagtcgtagtttaaggctcgatgcgtaagctagcgccgtcgtcgtctcccttcagtcggccatcatgattatctaccgggacctcattcagccacagattgagatgttctccgtacatctacaagatccgggagatcgcggacgggtcgtgactggaagtgccctggcggatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcgcaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatc

SEQ ID NO: 677555 - DNA, 729 bp, Homo sapiens
  misc_feature (648)..(648): n is a, c, g, or t
gttgtgtaaggccacccgctgactaatctggcctcgggggagatgtcgcaaaacgttgggtggggggccattctggcccaagggtggttcgcgcctgccacccattttgccgtctgtgcgggtcgcaggcgatgtttgtcgctccgcggaatttctaccttcccttggtaggcgtcggttcgccgggccaaaaggcagtggggtaataccctccgcgggcagatgattgctttcttcttgaggtgcctgcaagctttcccacctcactggaggttctactcaggtccgacgcgcgcggtacacacaccgagagagacactatctccttcctcccgcgttgttcttctggttgtgcgagtgtttgtcccccgcgcgtccttgtcttttcttgggaatcagtagtagcaggactgagtgtcgagatatagcgttcatgcaggcgaatcaaagtgtctctatgaggcgtccacataaagaacactgatacaatactcctgggtagcaataatatcacgcctcatgtcatatcccgctccccgcctatcatatcagtggctggatgaaacctccatgcagataggtgggtattggagggcactcttattgaagatggtgtctcaataggcttttctattctatgaacaatanggcatagagtcattgcagctgttccagctttataatttcggcaaacaaaaaaaccatctttctatttctgtccacatgaca

SEQ ID NO: 677556 - DNA, 993 bp, Homo sapiens
  misc_feature (630)..(630): n is a, c, g, or t
  misc_feature (670)..(670): n is a, c, g, or t
gaggggtcatgagggtcctgtgttggcaagtgtgcctgggactcagcccatgtatcggtaacatcctggcatcgtgctcctatgatccggaaacgtcattatctgtgagagaggacataacggcaccgtgggatgaagagaccaacgagcatgcggagacatgactcctctagatagagactctggctgtgcttgtggaccccccagtgagcttacggtccatgatacctggtcctgtgtggagcatcgtgatggggcgcatctctccatgctgacattgactactcggggtaaggccaatggtgaagtaacagaatgatccaacgaacgctcgcacctattcggccttgtcacatcgcctgtcacgcgtcggagccacctgcgtggtgtgtcaccctggcgcatagacctcgattaggaccacgccgagtcggaggcaggaaacacctcaattacgatcgaaggagcgttgtagcatcgatggtcgtgcatgtgacgagacgctcattcagacgctcgtggatagcgcgagagcgcgggaagggagccggccagcgtgggaagcgtgacgggatcgcaaggaaacgctgagatacgcagcatcaatagtagagcgttggagttttgagngactggttgagccgttgggcccgccatccattccgggtanctagctccggccgaggcgactctacttcgtctgcagattgggattctcacaaggtatagggatcgctaggtgtataccacttttagcgaacccttggtggacttgatcggcctacaatgccaagtgacggttgcggttacccccgtagagattgtgtgtgcaacaaggttccaaccggatgtgggtcgctggcatcgtgaggctgggtcccatcacagggcaacattcctgggctgtcgtctggtgggagacgaatacaggtggaccctgttggaacggagtcaaggttgatagggcaggtggggtgtcgcgcatccagtgag

SEQ ID NO: 677557 - DNA, 313 bp, Homo sapiens
catgccagcatctgagcagtattggaaaaacttcatacttttctctactgtgatctgtatagggggtaacatctaaatcaaggagatagattcagtaaagtcagtaatgttcagtaagatgatataattaaatatgtactatggaaggttgattagaacaaagtgggaaaacttgtaaacattgcccagattgtgaacttagggttttgggcacaattgttggtcttaccttatgcttgagcttttagtagatgttcttgtgtccatgtgtataacttggtgattatttctatagttgggattttcttggtgt

SEQ ID NO: 677558 - DNA, 897 bp, Homo sapiens
tttttttgttttttttggaggtgtaaaaagggcttattggcaggggcagcaggaatttaatcaaaagggccaaaccccaggtcatcatctgactctttcagaactcctccttcttctcatctttcttctcctcgggctgcagcaggggcagaaccagcagcaggggctgcaaagacgcctggggggcacgcaagaagacgggttacaggccccaccaggcagggtacacgtgggcaaggctggccaaattacccgggggcaatggacggtcttcaagggtgttttccccatttcaggctcactgggattaacccttgtggttgagaacgccggagctccgtcgtgtccggcgcctgcgaaatacccacggcttggggtgcccaagagatccttcctggatgtgcccctaggagcagctgggggagagaagatgttgggcccccataaaaggggcaacggcccaagaaagggtgttaagagaaggggcaaaatatggtaaagaccggggcaaattccgggggggggagagggccatgaataccatggcggccggggcgggggaggaaaacaaaaaggtccttcccaaaaacggggccggggggtggggcggagaaacccccactcgggtggtgtggccccactatttccccgaggagggggcaaacaaaactccgggggtgggaggggtccccttcttggggagaaacacgggcggccccgaaaaaaagggggggcccccctgggtgtagacaagaatgaccccccggggggttaacatccatcccgatgatagaaatttccgagttcgcgggccagaggagcccgggggaaggcaccacctttatgggaccgaggccgagaaaccccctcggtgagaaaaaccaccggggcacccag

SEQ ID NO: 677559 - DNA, 671 bp, Homo sapiens
agcggacagcgcgcggggcgagccagtgagagtgcgcgagtggcggcgctgcctgtagtcctgtagcctccgtgtcgcgccggcgagccacgtgcgcagtgcgctggttggcggctcattcgtcaaggctagtcgtggagcagactgtcactgggcccggccgtgtttagcaataccgaagatcaagagatgatagaaggcggcgattggcggaagtgccggaccacatagcatcggaccatggtgtgacccgccgaagacatcatggtgcgctgagagctgacacgacattagcttcccagaccgccaagcgtacgcgcaagctggcctaagacagatcgggaacaattggcgccattcccaagagatttgtggcatttgcgactgggtagacacaggggagtctgggagtgtgagagcccgtacttcgacacacctgtgcaagcttagttgacacataattcttctcgttcatacgtgatggggcaccttacacacgaggaacatgttgtggatttggactatgcccacgtggcggaacagcgttaccccttggcgacaaggcggatttccttcacaaggcgaggccaatatggacgaggcgtaagaaaccaagcggtggcttgtatggcgcacagcggaggaagagcaaacattgcgcagacaaaacg

SEQ ID NO: 677560 - DNA, 163 bp, Homo sapiens
gcctgcagcgtggccgaactgcttggcgaaggcgtgaaggcgtcgtcgggaaattgctgcgccggataagcgcggcgcggctggccggcgggcgcgtagccgtcggccggaccgatgcggaacagctgccaggcctcttccttggaacggaagatgggcgccg

SEQ ID NO: 677561 - DNA, 143 bp, Homo sapiens
acagaatagtatatgtgaatgcatatctgtgtaagtatatgacaagtgtatatactactactgatacagatcagacacgaaatccaactgaattacccggtagaatgaatatctgacgggatttctatatggacataacacag

SEQ ID NO: 677562 - DNA, 910 bp, Homo sapiens
  misc_feature (715)..(715): n is a, c, g, or t
ggcgggaggcagaggaaggcggcagaagatgaagagctttcgcatccagggtgacttgtttgaagaacccagctctcgtgctccccatcccgcctcctggccgggtttcagggggacagtggatggatccaggtcttggggagctcaggactgtgggcgtgtgtgtagttatattgtgcctgtttagacgaagagaaagaaatctttgccactcgtttagtttcttgattctgatgactcgtttttcttctactctggtggtcccaatttgtttataaagtgttttgtgagtgtcctatgggccggggcagggtccaagatcttttcccttccccaggccccttcggctccctcccagatcccacccgcagtgccactgattggcatatattaagatcttgccgaacaacccagtactgaccactcatcctcactgtcgcaatggtctgtgatgccgtggaagccccagataaggtttcgtagaatgggggataggggagacaggggtgcgcccatcgaatggtctcgccagatgtgctggcataggtaactgtcttgccctgcaagtcggaatgcggactgtctcctggatttgattggcaaacttgaaggtgggcccggggactccttgtgcggggaatggggcgtgatcggaggatcccatggtggctcacgccatgtttgagtagcggaacgggatcgagtgtggatcttngtctctcttgaactaccccatagctagggttgggcatgaagacggattaaaaaagttctcggaggggcctttgtagggggtggggcaaaaaggttagaaaattgctgctcgttgctcggggaccgaagcccctctttctgggaacaggggaaacttgcggtcccccaatggggctgaagtttgcacccggtaccc

SEQ ID NO: 677563 - DNA, 700 bp, Homo sapiens
agatgtggtggacgaagacagcacctgccgtggttctatatcggagatcctggaccggtcaccctttcttgaggccgcgaggtccctatctcgaacggctcagcgattcgtggtggctgcctgatgggctcattgtcaccaacgcccatgtggtggctgatcggcgcagagtccgcagtgagactgctacagcggcgacacgtatgttgccgtggtcacagcatgtggatcccgtggcagcacatcgccaactgcctagaggattcagacttaagcgagcctctccaccacgctgcctctgggcacgctcagcctgatagtacgcgccaacgggggagtcccgtacgtagacatgggaacgtccctttgcacctgccacgaacacgatgacacatccaggcactcgttacgctctgcctcagccgtccagcccacgagacctgggaactcccccaaaccaatgtgcgaataccctacaaacctgcatgcagctattgactctcttcgcgcacacctcctgcgcactgtaccacccttgggttaaacccgtcggcactgccggcaggcgtcgctcggactgtggaccacacccatacgaaaccgtcaaccccgcctgcaactctcccttcgccatccctacatgcatcgactacagcaacgtatttgcactcgttgcgggccacagaccacctcctccccc

SEQ ID NO: 677564 - DNA, 251 bp, Homo sapiens
tgtctggctaaaattattgagatccctaaagagactcaatgttatgggaatcaacaaaaccatagttcttgagttgctgccaggctcctaaggcattgaatgagcttggttctatgcctcccttgcccttcaagtacccttacagtcatgggactgggtgtgggttttgacaacagaatggaagagacagttacacagtcattcatgactaataagaaagctaaatgtatgtctccacctttagggttttc

SEQ ID NO: 677565 - DNA, 291 bp, Homo sapiens
tctagcgatcctgatttggatgcggctatttagatgtgattcattagattgtgccatgacactggtgtgaactacaagataggagagaagtgggatcgtcagtgagaaagatgtcagatgatgagctgtcacttgtcttgggaacggaaaaggagaattcaggtgtgaacctcatgaggcaacgtgttatgatgatggtaagacataccagcgtaagagaacagtggcagaagggaatatctcggatgcgcatttgctacctgtccatgcttttggaggccagcggggctg

SEQ ID NO: 677566 - DNA, 283 bp, Homo sapiens
cagtttccctttccctagtttcagttacctgtggtcacccccagtcagaaaatattaaatgggaattcccgaataacccattcataagttttggactgggcccccttttgggtggggtgataaaatctccccctgtcctgcccccccccctgctgctgctcccgctgaggggaagaaagtgggagccaagaaagaagaatccggggggtttgatgatgccctgggctttggtctttttgactaaccctcttttataacatgttcaataaaaagatgaacttta

SEQ ID NO: 677567 - DNA, 876 bp, Homo sapiens
  misc_feature (318)..(318): n is a, c, g, or t
gcccgaatgcggtaaccgcgaggtgtgtgcaggatgtgcctctaggactgtccaggagccgtatgagcgcccaggcggacagagcgggcttcatgtcttggtatgccccaaccagcggctgtgcgcttctggagcgcgggccactgtggcacacggcggtatagcaggagatcagacagtagaatgatgaagagtgtagaacacaaaatcttgatacttgtctcgagtgaaaaggacggctgtatggagaaagagcacaattcatgtcgcccactctttgtcccagtggcctaggcagtaggatgataatactactangatgattggctcttctagatcatttgatactatgtgggccatcgattacccaagtataatgggattggaagtgcagagcatgttcagccagagtggctcatggctgatctccaggtgttacgtggaagacaagcctgggggtgatgtcctgtgcgcgactacttgcatacagcagtccgtgatgatagctgtctagtacttgagatggagaacgccaagtaggacacagcggcattgtagtcccaggcagattccttccgagtatgtggacctggcagagtaggtcggagctacctcatttgttggacatccccatcctggaacgtcgggatgaactacctctcgagtcgtccggtaccttgggcacagtgcactatcgattggcagtcatcggatcattcagccatttcccccaggaaggtgtcaactccgaggatgtccgtaatgacagtcatttctgccagtaaggtgaagctggctctcatacgggtgagagcagaacatttatggatcctcctgtccttaggtcgaggagaacttccagtttccgtcaaaacg

SEQ ID NO: 677568 - DNA, 327 bp, Homo sapiens
  misc_feature (3)..(3): n is a, c, g, or t
  misc_feature (33)..(33): n is a, c, g, or t
cancggccagaaggagcccatattttgattaanaaaaagtgcagtacagctgggtgcagtggctcacacctgtaatcccgcactttgggagatgaggcaggcagatcacctgaggtccaggagttcgagcccagtgtgaccaacatggagaaaccccatctctactaaaaacacaaaattagccaggcgtggtggcgcatgcctgtaatcccagctactcgggagactgaggcaggagaatcgcttgaacctgggaggcagaggtggcggtgagccgagatggcaccattgcactccagcctgggcaacaaaagcgaaatccgtctc

SEQ ID NO: 677569 - DNA, 1670 bp, Homo sapiens
attaacatgggcagtgctggagaccctgtacacagtatccatgagaattactggaggcgactacaatgtgcctgctgcaatttgcctggtcgagataccacgaagaggtctcaggtgtcccgacgatacatctcgcagtgatgcgaacgcgccgaacattctcatctaaggatacagaagacacaaaccggcagcgcccctgacacttgtctccgtacaaggtcttccgtgccgtggcatatgcggtctcacaggtcaattggagaggatgatgtgatggagttctgtttgctgctttgaagagcaatgcgccaatagtgctagtattgtgcagcaattgaagaaagcttgccgcgtgggatgtgacatgcacgatcgaaggcaagtgcgagacccgagggtagagtagccagtgtggtgtggatagctgattcgttgcgattacgcggatatatgtagtgcgcccccatgcaccaagtgaactagcgcgttgttacccgctaccttcgtgactataattgccatctatcaagacatatcggagctcattgaataactagaccagagggactagaatattgaggacgaaatgtctcggggtgctcgcctggcatcgcttgtaactcttgactcgactccacgtgacttattttgcctgcggtgggcgacggaaactgacctgacgaataagcggttgaaccattcatcattgctggtactaggcactctctagtaagatggggtccctaattaactggatgtttactattaaagccatgttgaccacgccgagggtatcttttcccaggtactcggaacgttgggtagcgatcagatgcattaaggccaatcccagatgcaggggctgcccatggtaggcagatgaagctgttttatcatgctggccccggttgacatcttaacaggttgcggagacccagctaataaggggtacacctggaagacaaaggtgccgggaaagaaacgaacccaggtgaggtatgtggaaaaacgggggtccgtcacaaagaggaagaccgtgcaaaataacgaggccactcgacaatatggagaacaacaagtcgtatatttttttctctttctcccctcccgcctcccttctctactaacaacccacgcacgcagcagaagacacaaaagacgagacacaaacatacacaaaagaacgcaaaaacagacaacaaggcagccacgaggaagagggaaagcaagaagaaagaaagaagcacagaaaaaagcgagcgaaacagaacggaagagcgcaagacgaagagaggaggcgcgaaaagaacaagaaggacagaagacaacaaactatcgacaggaggagaacaggagcaagagagacgagagggaagcaagaccaaacgagacaacagaaaaggaaagaggaacagaggacagagaaaagaaggaacacaaggcgagcaaacgccgaggagagcacagcagcgaaagaggacggcgacaaaacggcacagagagcggcaggaaaggaagcagagaggggagaggaaagcaacaaagaggaagaggaacgaggaacgcgggggaagaaaggagagagaagagaaagagaaggggagaggaagaggaggagggccgggacgaaagaggcgacggacggagaacgcggatgggaaggacaa

SEQ ID NO: 677570 - DNA, 1347 bp, Homo sapiens
  misc_feature (238)..(238): n is a, c, g, or t
  misc_feature (310)..(310): n is a, c, g, or t
  misc_feature (347)..(347): n is a, c, g, or t
  misc_feature (371)..(371): n is a, c, g, or t
gagatggattacatgttaagtaccaggacagtgcatggcacatatgatttcacacaaagattcatcttcatgtgcagtatagcctgtcctattcgtattctagagcttgatactctctccacctatcaaccagttcctagcaccaatccgcgaggagaggaatcgtactagagactttggcagtcgtgggaacaatcacatatggaaggttaccttggagaggggcaaacacgcaagnggagaggagttcgttcggtatggatactacaacaaccagggtggttgagagtgacgtgttctcaggcacacnagccagggcattcgtctaacccgtgcgtgtgaccagnctagactctatgacagacagcaangacagaagcattcacacaaagaccaacctatgcaaggcaactagtgtcgaggagtaagttagaatatgacgatggtggtccatcgcctcagggacacaggaagggatcgaggctaggctccagcaagtagaacatacaatcttgaaaccatcgtcgtcccagtggacagcactggggtcggtcggctcttgcaggagaacgcctcgccttcagtgatgccggatgagggaagagtcgaagaacagagatcaaagctaagtaatcactcctgggaaacggacgatggtggcgagtaccagacgataggcagcctgcatgggcgccctacggaagcaaagagggcccggggctggaaactcccacctgcttgtaaaggtgaagggagcgacggttatagagaaattaggaccctggagggctcaggaagtgtaacgagtacctgaaggaaagttaaacaatccattggactttgcttcgaagggatttggggacctatagtgtacccagtgcaagaaaggcaggttggttggtcagacgttccctggcgaagcacaagaggtgtttgcatgggcgaattgctgaggaggggagggtattgctacattggggaaggaaatcgggcggtgggaactgtttgactgaatcacggggaaaaattgcgcgagcagaggaaaacctggtgggcggaggaatacgtagagaccatctttcacggttcacagatattgggcaagccaagaggtgggttttaccccacatgtaagaaggcccccgtatttgtgtgaaatcacctgggggaacccctaatgtcccaacggtcatcgagtgttgtgtacggcgccaactttgtgataattgtgtgacagtcggctagggaggtacaacacctgtctaaagaaccgcttatattgacgacatcagcacggacaatgtatccccgagcagctacttaccgcgcatagagtgcgtatgcacg

SEQ ID NO: 677571 - DNA, 269 bp, Homo sapiens
aaaacaccagccagtgctcttccaagtggaggcatgggattctcctgcctcagcctcctagtagctgggattacaggtgcccgccaccacacccggctaatttttgtatttttagtagagacagggttttgctgtatcaggtcttgatctcctgacctcgtgatccgcccaccccggcctcccaaagtgctgggattacaggtgcgagccaccgcacctggccaaatagtccataattttatcacgtgtagatttctgtatccaccagt

SEQ ID NO: 677572 - DNA, 1637 bp, Homo sapiens
  misc_feature (311)..(311): n is a, c, g, or t
  misc_feature (731)..(731): n is a, c, g, or t
ctatgactcttggggccagccacttgttcgtgctgttagccaatagatcaggacatggtgcttcccgcatagggttgcgccctcttccattaatttctcctcctcctcctggattgtgtcctttttgctgtaatatgtgtggctcctccccactcgttgtcggggagatgctactaaactgcggctctaaagggtgccccatcaggcggacagctggctccgtcctcccagaagctgtgtgggcggccaccccttttacaaggttgttcctcttctccccctccgcacatgtgtattctctccatagggcngcgcaactccaaagagacaaggtgccctttggactaatatctttggttatgtaagccctggggggtcacaccacgtttctgtggaactggcgacattcgccgcgaggccttatggggttaattccagaacataacgggaagtcgctgtaactccaatatccggaaatttccgcgccatctccctttcgcgcacatcgcgctgtatcggtaaatattcccggcttcggcataatcctttggggcccccctttttccccggaaacaccaaactttggcttcccctcttcgtggtccgaaaagttccgacagctagcggaactttcagtgtctggccggtccttcgatcggtctgtattaaccggggaaggccccatcaccatctttaaatcggctcgttgaatctatgcttccagtttccgntatctcccctccctaggcttacctaaaatgccttctaggggattctaacctaccaaaatcggggcgcaccttagccacttctcgtaacttaacataaggaggaaggggccctggtgaacaaatgtcggtacactgaccacgttcctccaataggggctttgtggcaaacgaaccacttgggaacaccatttccatcgccttcccagccggctcttctttgggcccctggactagatgctcgaatacgaccgcgaaactggagcttcacctgttggacaagcaggcccctccgccgatggtgtcacatgacacatgtccaaaaccattctgagcctttcaaacaagctgacttgtgcccatgcagacggacgggtacacctgtgcctttactgcccaacctaggtcctcttcgaagtttccccagttatcatcggacatcatgggaatgtcaagaagcgagtgtattctatcactgagtagtgacttacactgtacccgttgtagaggactgggtcgagagagtatcatgtctggcgaccgactcaggcaaatctcaggccactaagcagcgcagacgaacaagaccagggacccttcgcgacattctactccatcggaccaatggacttcacaggagcacgagcaggttgctgagcatgtcgctgcgtccaactctgactatccggattgcgcatgatggcccaggcgtcgtccacagcccgtgcacgagcccaggggcttgagcgtctcctaggcggtttcggggcatcacccacttccatctccctccctccacgcagaacgggaggttttaaggggcctgggctggggggatggggagggcaccatcgtgactgtgtttttcataactatgttttaactactgttgcattacgccaatatcag

SEQ ID NO: 677573 - DNA, 831 bp, Homo sapiens
gcgcaacccggggtgctcttcttcgccgacgatgacaacacgtacagtctggagctcttccaggagatgaggaccactcggaaggtttctgtctggacctgtgggactagttggtgggcgacgctatgaacgtccgttggtaaaaaatggcaagagttgtggctgggtacaccggatggagagaagacaggcctttgccattgacgatggctgggtttgcgttgtgagtctgcaagtcatcttgtccaatccgaaagctgtatttaagcgccgtggatcccagccaggatgcaagaatctgactttctaaagcagataacaaccagttgaagaactggaaccaaaagctagtaactgcaccaaggttctcgtgtggcacactcggacagagaaggtcaatctagccaatgagccaaagtatcacctggacacagtgaacattgaggtgtagccgccaggaccagcaggtgaggacaggaagtctggagcgtgggctgctgcccattcaggtactgttcctttgccttcagcctttccttaccgccgatggacggcgtttcgacagctacctgggatgctacaaaaaattgtgttgtcttcattgtgtctggattgtgtttctgaactggaagagtttgtaggagtgaaggccacatgtcactgaaacaggacaacgaagtatctcacactgtccttcccctccagcaagccgtctgaatgctagcttgaactggacggtaaagcaggtgatggggagctgtcagtcaatgaatatccacagtgagatgcttggcttaccagactaactattggcacagggggggcggggta

SEQ ID NO: 677574 - DNA, 121 bp, Homo sapiens
atgtaaactgacggctagtgtaaactgacggccagttaaactgacggccagtgtacactgacggccagtgtaaactgacggccagtagtaaactgacggccagtgtaaaactgacggccag

SEQ ID NO: 677575 - DNA, 438 bp, Homo sapiens
  misc_feature (99)..(99): n is a, c, g, or t
  misc_feature (120)..(120): n is a, c, g, or t
gatcctgccgtcgtagctactggtttaccgcggggaggcgccgtcgggcccaggtcgcagccatacatcctctgccagtgtgagaccggctcgctctgnttgtagtagcgcgcaggtccngcaggctctctcggtaagtctgtgtgttggtcttggagatctgtgtctcccggtcccaatactccggcccctcctgctctatccatggcgcccgcggctccttcctcggactcgtggcgtcgctgtcgaacctcacgaacagcgtgtcgtccacgtagcccacggtgatgaagcggggctccccgcggccgggccgggacatggcggtgtggaaatacctcatggagtgggagccggcccaggtctcggtcagggccagggccgccgagagcagcaggaggacggttcggggtgccgtgacccgcatctcggcgtctg

SEQ ID NO: 677576 - DNA, 264 bp, Homo sapiens
accttattaaaacctaaaaaaaagacactagggcaatgtagagtgtggactacatattaccataatatttaagttctttggatctgaccatggtatagtgggaaagtagagaaatgcatattttcttagaaaacctatgcggaagtatttatggcacactcccagtcatgtcagtagctagcattatgaatcgcccatcataacgaacaacaccataagtgcaaatatcgcaacgatgtctcaaacaccctaaatagccaaaac

SEQ ID NO: 677577 - DNA, 111 bp, Homo sapiens
cgaggattccgtgcgtatgcgacggcgctgactgcagtctacaggctgtatcaatggattccccctcccccctgtggcaagaggagaagtgtcaatgcagtgaggcaaggg

SEQ ID NO: 677578 - DNA, 658 bp, Homo sapiens
agcggtgtcctaacctgattcttacttctggatgtcatctggcttctgcagaatatatgtagtttgtagtctctcacagagtggaagagtggcttccttatttatattaatgaataggagtctaagcactacaatctgggaggaagaaacagtatgtgaaatgtttttgtgcattaagcaaggcttttgagttaaacatttgatggatttatagggcttctgttcttaaaataaactaagttggaaggtactcttaccagcagagaacatgctcagctgtgcatgcttctctctgaaccttctgtgtgtgaacagatcatcctcatacccctgcccccaagctggtgcatctcatctgggatatgggctgtatgtgaccatcttacattcatcccctttccaaggaaactgggaggagagcactcatggctgaaagtatttgcaaactggatattggatggacacccttaggaaacacttcttcccttcccttatgtagaggtcgatgacggtctaagtccgggtcatccaaggccgatctgcaatgcctgatccccactatcctaagttctgacctgagcagcaattcttctcccacgtatccgggcagaggacttctttctggccactggccaactagatccggatctcgcaccag

SEQ ID NO: 677579 - DNA, 1630 bp, Homo sapiens
gagttatcagatcgacccccggatatggaaactacgtggcgagtatagcggtgttcgcttttgccttccatcttcctggcagcctgtggcgcctgcctctcccttaggtcggagctgaccagggcaaatccacagaaacgaacaccatctcgtctctccacatggactcttatcttcgatccttatgaacctggggaggactcagcaaaatggcagggtgcacacgattgcgatcgtctggcgtggcgtccaggtcgctgaaggccgagaatgacccgtgagctgcgaaggacaaacgccgtccgatccatcgttcgaggaccccgagacagaccacatctgtgtgtcatcatgttcaccttctcggtcgttgccttactcattcgcgcacagtatgtcctcgatgtgtccatcggccctctcctggtcacgggacgtcacagggctgttccgtgacaaggaattttgccgagagactcgatgcacaggtaactcccgaaatttatacatacacctggcaggggaggaatgtagcctgggaccagttattggattcgtgaccatatggttccacgcaagatgcaccgctaagcccaatgcgtggtcccacgtagtttcctagtgtccaccgtcgttgtaaaccaccttgagtaacgacagtgtgtccctacctagcacgaggactagaaggcgccctacgacttatagattcgtttcctacactgaaaaaagttccctgtccccagtggtctggtcgccattatctcccaaatcgttccaatggggctgcgcatggctaggtatgccggtactcaccccatttaaccagtttcaatctccagcgaacaccgttgtgcgtatctgggcaagatcaccacggggcagagctacatttttcgaccgcggtaacactgccttgggcattctctaggggcctatcgcacaaaccgggggactctcccgaaagggcaacagagccgtatcctagttcacacttgcggtccccgcttgaatacggaactctagtaactagccggcttttggccctgtggtcttactttcgcaccgcaattatatggcctttgcgtgtgccaagttctggttagagtgtccccgatagtgcaatgaacactggcgcgtccgcgtggggttataccatctcccaattgcgcagtacacttggggaatccgtgaaggcgaaacgcaaaaggcacttgtctcgcgcaattggctcctcttgtggacgcaactggtttggccgtgcagcacgtgcactttgcacgacacaattggtgtgctacgggttctatccttgtttgagacctcctcccctgttaaaaaaatgaagggcttgtcgcgaggtgactggctaaacccatagcaccacttaaagcacccaatgtggcacaaagaatactagtgtctctctgcaggcaatgcaagcgtaatcacatacgtgtgcctcgagaggtaaaatatggtgcgcggctccccgtactgcgaaacacgactttccccctgtattgtgcctgtgtccatgggtcgtacactgtcacgacgacgaacaactttcacacgctccccagtgatgttactccggtagaacaccgatcacgaagctatctcatag

SEQ ID NO: 677580 - DNA, 122 bp, Homo sapiens
cgcctattaagtttgtggccaggagttgatactctcgggcagtgagagtgagtagtagaatgtttagtgagcctcagggtgttgtgagtgtaaattagtgcgtggtccgagcggaccgggta

SEQ ID NO: 677581 - DNA, 101 bp, Homo sapiens
cagcggaacggatcgacggcagatctgtgacacttgtgtgaaaatgcagctgtgcttccatcatcatcatcatcattagacccaggtttcttgtacaaagt

SEQ ID NO: 677582 - DNA, 140 bp, Homo sapiens
gaagaggtggtgtctccccatttccatgtgagtgtactaacagcctaccacccagcggaaggacaggccgtcgggaacagccatgcaaggcagggaggaagcacctcgagtcgcagatattgccagtacactatgaacca

SEQ ID NO: 677583 - DNA, 383 bp, Homo sapiens
aatctacgtcgtgcaggacggggggctaatagtagtttccttctccacccagccgccaggtgtcgcctgatgatgagtattctgacttcgtcctatacgaagatgataagagagtaggggaaggcatagaaccaccaggtaggtatgaggggatacagtcctacgagcaacaccgattccaggggagtatgacaggaaagctgtctgggctgtctcttcaaagaggcctaatatcaagatcttgttcttcatcccctgctggaatatcgaattcctcctggtcttatagataagcaagtcggcccactgcagcatcacgatagtgacgaacaatgctgtgtggcaggtgaactccacgatttttctctgcaaggaatccacgc

SEQ ID NO: 677584 - DNA, 89 bp, Homo sapiens
ggatttgctggtgcagtacaactaggcttaatagggagctcgaattcgagctcgaattcgacctcgaatttaagcttctaacgttagaa

SEQ ID NO: 677585 - DNA, 221 bp, Homo sapiens
tctgtgttcagagctagcgtgcaggggtgtgatctaggcttactgcaacctccgcctcctgagatcaagagattctcctgcctcagcctcccgagcagctgggactacaggcacaggccactgtgcttggctatttcgtgtgtgtgtgtgtatttttagtagatacagagtttcgccacgttggccagacttgcctcgaactcccggcctcaagtgatctg

SEQ ID NO: 677586 - DNA, 149 bp, Homo sapiens
atattactttaaaaccccttttcccccatgggtaatagtttatgttaatgccggttcgggtttttttcccattgtttgtgccctgaaaaagtttaaaaaagcccccgtttttttcttctataaaaataaaaaagatagaaggcccgtta

SEQ ID NO: 677587 - DNA, 144 bp, Homo sapiens
agagaaccagtatccggagagcatgttaagtaagagacgacgatatgatagaggagtcaaagccccccagggtgcactctgctctctaggaacccatgtgctgtgggaaaaaaggagcaggagaaaaagtgacagaaggaaaat

SEQ ID NO: 677588 - DNA, 147 bp, Homo sapiens
gatatgtaaaccattctgtgtatagagtactttgtctttcctaagaagatcattgtacatttggtcatatgtggttctagaatacataaacattgggcttgtctgggagctggtcctggtaagcttcagcgtgagtcccgtgttcca

SEQ ID NO: 677589 - DNA, 191 bp, Homo sapiens
cactgtggccaggatgctataaatcaccacggtctttagccatgcacaaacggtagtttgtgtgttggctgctccactgtcctctgccaggccaggagtgctgagggcctggccggttgactgtaacgatccccgggtccgggctcgatcacgtcctggcaggaggcgggtacctgcgtgtcggaagtgca

SEQ ID NO: 677590 - DNA, 106 bp, Homo sapiens
tacaaaagtgctgttattacaggcgtgagccaccgcacccagctgattgtgaatatccactaccatgtgtcctctaaaactcaatgtccccctgccataaaacaaa

SEQ ID NO: 677591 - DNA, 188 bp, Homo sapiens
  misc_feature (99)..(99): n is a, c, g, or t
  misc_feature (104)..(104): n is a, c, g, or t
taataatccccccccccccccccccctcggacccatactctactcatccttctggccaggcgaagcccacgatttgacatgccggagaccgctccgtgngtcgngtttgtacagccaggactcgactcactggcagaaaccctctaaggagacacttaccgacctggcgggcagcaggcaggcgagaa

SEQ ID NO: 677592 - DNA, 143 bp, Homo sapiens
  misc_feature (133)..(133): n is a, c, g, or t
cctgtgtgatctagagatcccccggtacgagcggtctcacacaggccacagagctggagctggatctaccatgaaagacctctgaatccaggaagagagactgactgagcaacatgttattcatgggtctccnactctgttgt

SEQ ID NO: 677593 - DNA, 134 bp, Homo sapiens
aaggaagacctgtgtacacacaaaaacctgtacactaaagttgagagcagcattattcatagtcgccaaaacttagaaataatatctgatgtcctctaattaatgaatagctaaacaaattgtgatacattcat

SEQ ID NO: 677594 - DNA, 559 bp, Homo sapiens
acgcccaccgcgtacaaataaaacactatttaatcttccagatatcactttttgtcaaactcatagagttatgaatggaccttaccatactggtgctttctgactgagctcctctctactctgaatgcgagagaccctcataggtaggcagaaatatcgcccctattcagccggaagaagttatagaggatggatcttcgtccctctgcaacccttagaattaagggttctcttataaaagggaagggggaaaatgttggaggcgtgtgacccagagctccatctttaacaggagcagggtaaaatgaggctgagacctaccatgcagcattcccagagaggaattctatgtcacaagatgagatgggaggttagcacaagatacaggtcataaagatcttgctcgataaaacaggttgcagtgaaggagctggctaaaactcgccaaaaccaagatggtgacgagagtgacctctggtcgtctttactgctgacgccccatcagcgccatgacagtttacaaatgccatgggaatgtcaggaagttacctatattgtc

SEQ ID NO: 677595 - DNA, 102 bp, Homo sapiens
ggcgggacttaaaataaccctgaaaaataacactggaattccttttctagcattatatttattcctgatttggctttgccggcgcctcttgccgccgttcct

SEQ ID NO: 677596 - DNA, 215 bp, Homo sapiens
ctgtgtctagcgcttcgctggtgatggggcctgtgtcgcgggtcgctgttctgtgtctgcgcttcgtggtgatggggccgtgtagcgggtgctgttctgtgtgtgagcttcgtggtgatggggccgtgtcgcgagtgactgttctgtgtgttagcatcgtgatgatagggacgctactcgcacgggtgctagcacccgatatgaaactcgggaga

SEQ ID NO: 677597 - DNA, 735 bp, Homo sapiens
taatgccggcgcaggctcggtgaggaggctaggtctgaggggagaggctgactggaggaatataggcccccggaggagcatgaaggagaagatctgcagtggtgtctccattgcccagtctcctgcccacactcccgcctgtagccctgagcagagtcatcatgcctcttgagcagaggagtcagcacatgaatgcgctgaagaaggccttgagtgcctgaggtgtatgaggccctggggcctggtgggtgcgcaggtcctgctactgaggagcaggaggcttgcctccatcctcttctactctaggttgaagtcaccctgggtgaggtgctgctgcggatttcacagattcgtccccaagaggtcctcatggtggatgcctccaaaacttcccccaataccatgaattatgcctctcttggagcccaatcctatgaggactccagcaaccaagaagagcgacggggcaaagcagctttctctgacctgcacgtccgagttccaaagcagaattttcaagtagcgacgcgtggcccgagttgggttcactctacttgctccatcactgtatcgcgccacggaagcacggtcaaaatggccggcactggttgtcggactgtcgtgggaaacttgccggatgcccccctcgattcttagcacagtaccagctcctgcagtggtttggcaatggagatatgacatggacccatcgccatgacctttgggagtgctgac

SEQ ID NO: 677598 - DNA, 162 bp, Homo sapiens
gcaggaactgctcctggctgaagaaactaggatgaggctgttgcacacacggagtacagcgaactgcttcactgcctagctctatgctgtaccgcctcgactcctcagcacctaccccactgctggaagcgccagactgagcgcaaaccacggcaaacgaaa

SEQ ID NO: 677599 - DNA, 167 bp, Homo sapiens
cagttcgccagggataaccctggaggatacagcatacataaggagcatagaattcacccttttaaagtatacacgtccggtggtcttacattcagagttgtgcatccgtcactaattgcagaacgttttcatcacctcaaaaaggaacccatacgcccaggtcagca

SEQ ID NO: 677600 - DNA, 417 bp, Homo sapiens
ggggtgtacgattacagaacaggctcctctagagggatatgaagcaccgccagttcttggagttttaagctggtggttcgtagtgttctgggcgagcagcttggttggatttaactggtggaggtttagggctaagcatagtggggtatctaatcccagttggggtcttagctatggtgtgtccagatatgttaaagccactttcgtagtctatttggtgtcaatgggagttttttacaactcaggtgagttttagctttatgggggagggggtgatctaaaacactctttacgccggcttctatggactggggttaatcgtgtgaccgcggtggctggcacgaaattgaccaacccgggggtaagtatagcttagttaaactttcgttcatggctaaaggttaatcactgctggtt

SEQ ID NO: 677601 - DNA, 340 bp, Homo sapiens
aggggggcccgatgtctgttacagagcgtgttggcgatatgcactgtctgtgcagcgttggtgcacagctagactcaaagtgcttgcatgccagctcttcccctgtacagcctggattaacactgatgctagcgagactcctttgcacaagtgattagctttcgtaactaccacagctttcttactgctagtcattctgtgatgggattatgctaggtgcttgaactccttaactccagttccttggctatctactgagtacatactgaataaggcaataattgacttacctcttttgttttgctcccctgtggtcgtattctaggggtactgaccgtcg

SEQ ID NO: 677602 - DNA, 225 bp, Homo sapiens
ctagaataaaaaacaagaagcaacaaaacaaaaagctaccctgtactgtgtttatcacctccttttagttccacccctgaacccccattccctggtgtccttctatagagatgaagaagtaataaggaaacatctttcatagccactttaattaagagaaactgatatacattattttttacttttgaaagatgacttataaaaaccctgaagattgtcggctgg

SEQ ID NO: 677603 - DNA, 465 bp, Homo sapiens
taaacgtgcacctcataggggtgctcggaggctcaaataaagcagagccagggcaaaaaaaaaaaaaaaaaaaaaaaaaaattttgtctgggccgccctcgggcccccgaaaaaggtttttaaaacccttctgtgttgggggggggggccccggggagggaaccggggccagtgttgtcccaagagaacatcgggcgccaggaatacattgggtgcgcgggggttctcccaccaaaaaaaaaaaaccgccgcggggggcggcacacgcggggcgttgctgtgaaacaaactcccaaaggggggcgtccggaggggcgacgcgacgggggcgtctcctcacccaagggaggtgcccacgcggagcgcccgatactcaaaactatccggccgccgcgcgaggctagctgaacaaagcacataaacaaacagcaacaagacaacaaaagcaaaaagacgaaccaaagc

SEQ ID NO: 677604 - DNA, 269 bp, Homo sapiens
  misc_feature (21)..(21): n is a, c, g, or t
  misc_feature (136)..(136): n is a, c, g, or t
  misc_feature (161)..(161): n is a, c, g, or t
agaacacagaagtataggctnaagacagagacggacgacggatcttctggtccagacatatcatgcagtagtctcccggacagctgagcctacgaagggaggcgttcacctggagtcattaaaggtagtcacgccnagaaaaaatccaagtccaagctggnagagaaaagcgaagactccatagcttggtctggtgtagaacattccactccagactttgaacccggttaagaagaatcctgggtctcaatcaagaagtttattcctgg

SEQ ID NO: 677605 - DNA, 133 bp, Homo sapiens
gtgcatcttaatatagactagcttactctatagcttgtataatgacgatccctctatacggactccacttcttactccctaaagcccatgtagaagccccccatcgctgggtcaatagtacttgccagcagta

SEQ ID NO: 677606 - DNA, 202 bp, Homo sapiens
ggggttttagccttttttaaaaaccccctttaaattaaatttggaaccaagaaactttaatcaaaaggttagccttgaaattgtgaacttttggaaaagttattagggaagtttgcaactaaaataaacctgtaaaattattatggttggttttaaaaaattaatgaaaaaaaaaaatttttgtccccctgaattatgggta

SEQ ID NO: 677607 - DNA, 936 bp, Homo sapiens
  misc_feature (26)..(26): n is a, c, g, or t
agaaaagtgtgtaaaaaaagaagganggtaaggtaaggaattaaagggatatgggttagaaaaaggaaaaagaaatgagagtaatggtgaaggaatggtatatggaagaagaaaagggagaaaagaggaaaaaaaaaagaaaagaaaaaggaagaaaagtgggaatggagaagatgaggaggataggggtgatataatggaagatggatgatgaaaaatatgagaatgataaagaattagaaaagataagaagagagaggaaataataatggatggaaataataaaaatatgaaaagataaaataaaaaattatgaagaaaagattaagatgttataagaggagaatttgaaattggaagatgagataagataaataatggatggaagtgggtaattagatgtgagggaaaaggaggaaaagtggataaggatattaatggagaagggagaaatggtgaagataaaagaggggatatataaaagattaaaggtggaagagaagaaataaaagaaggaaatgaggatgtttgtgggagaaaaggtgtggaaagagtaaaaaaggaaagatgaaaattttgaagaaagagggaagtaagtgaaatttatggaaaagaaagaatagaagtgatgaatgggaaataaaaagtgaatagtaaaggtaaaaaatgtaatgaatgagaagaaaataaataaatttatatttgattttagaggatagaattgaggatagattatatttaatttgtaagattatttgataagaatattttgtaatgaaaggatatagaaagaaaattggaagtgtaaagagtaaaattaattttatgtaaataaataaagaatggtgggtaaatggaaatgtgttagttaatgaattaagttgagtaaaaatgaaagtttaatataaagaaatgaagttaattagatgaaaatat

SEQ ID NO: 677608 - DNA, 152 bp, Homo sapiens
gacctctaaatcccttgtaaatttaactgttagtccaaagaggacagctctttggacactaggaaaaccttgtagagagagtaaaactttaacaccatagtaggcctaaggcagccaccaattaagaagcgttcagctcaacaccctaccta

SEQ ID NO: 677609 - DNA, 443 bp, Homo sapiens
taataggcacgctgtagagcagtgtgctgtatcccagccactcgggaagatgaggcagagaactgcttgaacccaggaggcgaaagctgcagtgagccaagatccagccactgctctccagcatgggacaaagagcaagaccctgtctcaaaaaataaaaataaaaaataaattagccaggcatggtgggcacacctgtagtcccagctacccaggacgcagaggtgggaggattgcttgagcccaggaggtgagggctgcagtgaggtgtttgctactgcacaccagcttgggcaagactcagtctcaaaaaaaaaaggagagtttggaaccattcttggaccccggtctctattaaaaattccaaaattaagtggggcttagggttgtgtccctgtgtccccggttaattgggaaggtggaggggggggattcgttaaggc

SEQ ID NO: 677610 - DNA, 186 bp, Homo sapiens
atccaacgctgctcacactggggcatgcagcaggttccgagatagaaatctggattccaaagcacaacagatctttggacaacaaagtgtctcaggaatacacaatgactcagcagtacagaaatttaagaaaacttttttttaggtttttaagtacaatgtcatgaagtagagtacaattctggt

SEQ ID NO: 677611 - DNA, 282 bp, Homo sapiens
ctggtctctttgtttctgtgtctttgttttttgtttttaaagacagagcctcgctcttattgcccaggctggagtacagtggcgcaatcacggctcctggcagcctgaaacttgtgggctcaagaaatcctcctgattcggcctcccgggtgcggtggtgcgtgcctgtggtcccggctgcacgggaggctggggtggggggatcccttgagcccaggttgcagtgagccgggatcgagccactgcactccagcctgggtggcagagcaaaaccctgtatca

SEQ ID NO: 677612 - DNA, 138 bp, Homo sapiens
gagcagagattacgtcactgcactgtagtctcgctcttgtcacccagactgtagtgcagtggcacgatctgggctcgatgcaacctctgcctcccgggttcaagcaattttcctgcctcggaagagacggggtttcac

SEQ ID NO: 677613 - DNA, 168 bp, Homo sapiens
cgtggtggttctgcgcctttgtgggggtgcatcctattagtggacctaagagccagaggttgtgtagcggcccctgttctcacctgccagtctcgtcagagatggggttgctgcagtgttggcgtaggggcagagggagggagcctaggtcactccaataaaaccagc

SEQ ID NO: 677614 - DNA, 125 bp, Homo sapiens
agattttttctcaagagttgtgcttttgtgttatttgttttcactcaaatatttgcctcattattcttgttttaaaagaaagaaaaacaggccgggcacagtggctcatgctgtaatccagcact

SEQ ID NO: 677615 - DNA, 174 bp, Homo sapiens
attctgatagggagagaacagaagagggattacggcccagagaattagcagcttgacatatgctgagagactagctaagcactggctgaatgaatatgtaggacaaccatgaccaggagtgtcatctccagaattattggggtcacatatgtcccttcccagtccaatgccatc

SEQ ID NO: 677616 - DNA, 332 bp, Homo sapiens
  misc_feature (318)..(318): n is a, c, g, or t
tgtgtatgcacaacctagggtcagttctgcaggttataagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctntattggttgctacc

SEQ ID NO: 677617 - DNA, 2342 bp, Homo sapiens
  misc_feature (631)..(631): n is a, c, g, or t
cggaagtccttccagaaggagcttgtgatggccctactgaagatggactgccaggcctggtggtcagactcatccaggacttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctantgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacctaaaa

SEQ ID NO: 677618 - DNA, 129 bp, Homo sapiens
tcagagtgtggcagctgggggcagcacatgcaatgtgagcagcgctgatggcagaagtgcacaactggacaccagaacgcagatctggacagatggactttacccctgacagtgagcgtggccgaggtc

SEQ ID NO: 677619 - DNA, 1466 bp, Homo sapiens
ctccctgcgtgtaagaaggtgaatcacgtgggagtgaaagaggtccaacaaccgaacgagcatctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacctaaaa

SEQ ID NO: 677620 - DNA, 2253 bp, Homo sapiens
  misc_feature (631)..(631): n is a, c, g, or t
cggaagtccttccagaaggagcttgtgatggccctactgaagatggactgccaggcctggtggtcagactcatccaggacttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctantgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagta

SEQ ID NO: 677621 - DNA, 210 bp, Homo sapiens
gatctcctagtttgagaagttcaatagcacgtgtaaccttgactcctgggctcaggtgatccccctcccacctcagcctcccgagtagctgagactacttgtgtgcaccactacacccaactgatttttttattttttgtagagatggagttttttatgttgcccaggctggttgcgaactcctgggctcaagcaatctgtctgcctcag

SEQ ID NO: 677622 - DNA, 673 bp, Homo sapiens
tccccccctattccttttttttttttggtttaaaaaccctttttggggcccccgggggggccggggccccggggggggaacccgggggggggttttgggggggggggggggcccccggtgtgagggggaaatgggggaaacaacgtcctctctttccagagaggggcgggggaccggagacaggcggaggaggtcttcaaaaggggctccaccgaggggggcccctgggcaaaatttctccggggggtatgagcgccccccggtggtcgtggtgggttcatccacacgcgaactacccgaccataagaggaaaccatttctctgacgacaccggatgtgggcaaacacaacgccgtagtggcccttgtggtgcaggagagatgtggggcgctcccccaccacaataaccccagaggggggcctgtgaccacctagaggaagaggagacaccagggggcggggctgtgcgacaaaatatttgtgttcccccccaaaaaaagcctcctgtgtggcgcgaggggaacacaagcgaaaactacttttgtggccaagtaatgatggcccccaaggagggtggggtgtgccccccccttgggagcactttaaaccccaccaaaccggaggtgtaccagtggagctccccaaaacaaagaggcctcaaccggtgagaagc

SEQ ID NO: 677623 - DNA, 2342 bp, Homo sapiens
  misc_feature (631)..(631): n is a, c, g, or t
cggaagtccttccagaaggagcttgtgatggccctactgaagatggactgccaggcctggtggtcagactcatccaggacttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctantgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcggggggggggggggggggggattattcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacctaaaa

SEQ ID NO: 677624 - DNA, 683 bp, Homo sapiens
taagtaaaacggagtttggctcttgttgcccaggctggagtgcaatggcacaatctcagctcacgggaacctccacctcccgggttcaagtgattctcctggctcagcctcccgagtagctgggactacaggcacgtgccaccacacccagtaatcttggtattttagtaagagagggggtttcaccgtgttacgcaaggatggtctcgatctcctgactttgtgatccacccgccttggcctcccaaagtgctgggattacaggcgtgagccaccacgccgggccttattatattcttgaaaattggccaagagagtagatttcaaatgttctcaggacaaaaaaattgacaacagtgaggtaacggtttatgttaagtagctcaatttagccatgggtgcaaggtgtacctatttcagaatgacatgttttacatgataacatattgtttaaattttataatttctgcacgctaaaacaaaacaaaaacaatttcccaacgggcttgaagatccggcggcaaaaaggggccaaaaacccattaaagggggggcgccggaaccacgcttttggtccccttaagagaagggtaacattcacaacgcatggagaaaaccatgagacaaaattgtccctgtggaacacttgaacacgccacaaattcacccaaaagccagaaacg

SEQ ID NO: 677625 - DNA, 428 bp, Homo sapiens
ctactgactaacacggagtgaacggcgcatcagaccagcacagaggacggcatcaccattgatattagtttggcaaaaaaaaaaacaaattgtaaaaaagaagaatcaaaagggaacacaagcaactctacaatccgattgagtgggcgcaggactcaaaactggccggcactgctcgggtcgcactgcaggaggcgcacaatgaacgggtcgactatgggctcctcgaatgacctcttccaggaagagtttcccgtctctatgggtgtccatctgacggaagaatcttttctgttcttttctctggggtaaactcatcttcaggcatttccattacagaggaaaccatcttatagatggcctgcacgatctctagcatctctgccttgatgatatagccattcccgtccaggtcgtccatgctgaag

SEQ ID NO: 677626 - DNA, 897 bp, Homo sapiens
gaagccttcatgcagatcgtgcttagcgatgcatgggtcactgtatgcccgaattcgctagtccgtcgcatcaaaaggttatgccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacctaaaa

SEQ ID NO: 677627 - DNA, 289 bp, Homo sapiens
aggcggccttgcggccgatcgactccggcgggaggtcgtcgaggtcgaggtcgtcgcgctttgcgccgtcctccttctccacgtccgcggtggcgataccgaagttgagcagcttgtgcgtgcccttcgtgaagatgatgttcgacggcttcacgttgcagtgcgtgacgcgcgcttcgtgggcagcggcgagcgcggcggcggtgtcgatgcccacctcgacggcgagggcgatccgctttgcatggcccggcggcagatcgacgatgggcttctccgcgagctgcct

SEQ ID NO: 677628 - DNA, 234 bp, Homo sapiens
cccccttgggggttttaaaaaaaaaattttgggcagatttggtcctcctcctggtccttcccctttttttacaaacaggggtccatggagggtcctggttaacctttttaaccaaaaaaaaaatagggatttggtaaacctgaggggatatttcccatggtatccctcccaaatttttcattttcatttaggacttttttaaagcctttggtggagtcctcatcctcatcttta

SEQ ID NO: 677629 - DNA, 1270 bp, Homo sapiens
  misc_feature (631)..(631): n is a, c, g, or t
cggaagtccttccagaaggagcttgtgatggccctactgaagatggactgccaggcctggtggtcagactcatccaggacttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctantgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgactaattgcacactggcaggggccctaaagactgtcaactcatggctgctttctaatctatgtcga

SEQ ID NO: 677630 - DNA, 159 bp, Homo sapiens
  misc_feature (156)..(156): n is a, c, g, or t
gttgaggctgagaaagagcgccaggtgcactccaaagcctgagcatataaaaattaaagaccggagtagagacaaatataaaaatatctcaaagaaagcaaaagcaaaaccctgacactccaaccaacctaacagaagaaataatataaataatantta

SEQ ID NO: 677631 - DNA, 260 bp, Homo sapiens
  misc_feature (35)..(35): n is a, c, g, or t
  misc_feature (69)..(69): n is a, c, g, or t
  misc_feature (92)..(92): n is a, c, g, or t
  misc_feature (98)..(98): n is a, c, g, or t
  misc_feature (101)..(102): n is a, c, g, or t
  misc_feature (106)..(106): n is a, c, g, or t
  misc_feature (110)..(110): n is a, c, g, or t
  misc_feature (115)..(115): n is a, c, g, or t
  misc_feature (118)..(118): n is a, c, g, or t
  misc_feature (133)..(133): n is a, c, g, or t
  misc_feature (140)..(140): n is a, c, g, or t
  misc_feature (164)..(164): n is a, c, g, or t
  misc_feature (166)..(166): n is a, c, g, or t
  misc_feature (227)..(227): n is a, c, g, or t
gacttgtttcaaggcggggttatgcatcagaagcnatcaagggggcggttgttggtattgatttgggtnctaccaactcctgcgtggcagtnatgggnggnnaacnagcnaaggngcnggggaatgccgaagngccaganccaccccttcagttgtggcctttncngcagagggtgagcgacttgttggaatgccggccaagcgacaggctgtcaccaaccccaacnatacattttttgctaccaagcgtgctcattggc

SEQ ID NO: 677632 - DNA, 163 bp, Homo sapiens
gcatactgcgcgcacactagtttcgctttcgaatgtctggatgggagatgaacttgaggataaccaaagcccagagaactctcatccagggagccccgccaacgtgcctatgattctgagaaattcttccacgtttgggtcggggtggaaggtctcagtgacg

SEQ ID NO: 677633 - DNA, 116 bp, Homo sapiens
cggtatgagcccgaattcgtcattcctgggcctttccttaaatctatgcttaacctcttgaggacatagctagaccgttttccaggagtgctgtgcttataggcatgagccaccac

SEQ ID NO: 677634 - DNA, 305 bp, Homo sapiens
ttacagtttccccgctcggttcccgttgcacggttgacgataactaatgctccagcccgagcaagacgtgctgtgcggccgggtagagcaatatacactatgtatagactctgcgacatcagtccgctcggcgaggcagcgtcctcgccatgtccaggcgccttaaccggggaggagggggcgccattcgggaacggcgggctggcccaccaccgttccttggcactcaaggaggcgcgtttgatgccgtgcctgaatggcaccttcccgatatataaagagtttagagaattctttaacataac

SEQ ID NO: 677635 - DNA, 375 bp, Homo sapiens
gcatggtgatgccccatgttagtactggtgcttgtgagtgtagatctgtcaggtctagcacgcctcactgaagattcggattcacctgttgggtgactcggatgatggtcgttctcctgctcgacgctttgatcttagctgctccctctttggtacaggtagagcggatccctcctatgatgtctcggatggtatgttccacatctcctttatgaggagcttccactgtctttccctctgaggctcttcaaggaggagagactgttattatcttctccttctggattccttcagcccaggaactttttcacagatcctagcattgagccccggttcaccatgcttctctgagaactgtaccatccccctctcagc

SEQ ID NO: 677636 - DNA, 341 bp, Homo sapiens
agtcttcaaaaaggaggctgggcgcagtggctcacacctgtaatcccagtttttgggaggctgaggcaggataatcgcttgaactcaggatgcggaggttgcagtgagttgagattgcgccagtgcacttcagccagattttatctaaaaaaaaaaaagggggggcaaggtcccttatgtaatttaaaacagaccttcccttttgcaaatctgaatttgtttatctgggccaggaaaccggacttctctggagagcccatcgcctgagtgtgaggctatgtcacacttagggtaccatgaatgctgcctggaggcaggcttctagtacaagcttgcactcg

SEQ ID NO: 677637 - DNA, 1283 bp, Homo sapiens
  misc_feature (534)..(534): n is a, c, g, or t
gggtttcatatataaatagaccctcctagcgcctgtcctttgtttatgtgggtgacccctcgttctctgatagttttttgcccctctgtggttgtggtgccccctcttgcttcgctcccctccttgtgttttttggtgccgcgcgtcgccatgtcgggatgtttagccaccccgctggggctcctcagtgtctcagcggctccgtctcgcgggagcattctgttatctcgcctttaggtgtgccgccgcgggcgtcagcggatttattatacaaagctgttgttgttgcaccaacacgggttgtcaagctactgctctgattttgtccgcacttttattgggtcccctcactatttttatgagggcgggatacacacctcatttaatggtggacacacatcgtggttgtgttgacactcacactagtacactccacgtcgtgcttgtgtgctcccgcttgtctcgcgtagaattttttctcccgcggggtggattgtcccacatgggtggggtgtttgtcggggttctctcttnttctctcgggagaatagagtcttacagggggctgcgtgcgtcttgtgggggtgggttagggggagcccccttctcactactcttttagtttttccgcgtcgcgtagcttcatttgatgctccccgtcgcgtgttttcgcgcgtgcaatggcggcgcggccaacggcctcgctcatatgacttcttttgaccgcgcggccgcgcatgaggcggtctggtgttttctcgctgaggtctgcccgcgtggcattttttcttctgggcccctcccatttgtctgtgccgcacgacgcttatgtgagggttgtcaccacatccccgcggaggtgaaatagagatctcaatagcccctctcatgttatagacccacacgccggtgtgtataaatgttcgtgcacccccttgttggcacgcgaggttggttttatcacaaaggcccctcggcgcacaagtgtcacacacgtgggagatcctctaattgtggcagacaataagggggggcagcgtggggagactcttgtgtccacgcacagctcggtggctggcacacacacaacacaggagaggtgtccttgcccccctcgccaccgtgcttgtctggggttccacgccttgagaggaagaaaaaaaatgggacccaaaaaaaaaaaattcccacggaggtttggaatgaagaaacacaggggtttgtgtttttttggagaaacccttttttaaaaaaggttccaatataaaaaggttgacctttta

SEQ ID NO: 677638 - DNA, 216 bp, Homo sapiens
tatctagaggatccgtatgcatctgggcagaagagtgaaactcgtctcaaacaaaaagtaaatacataaattaaaaaaaaaaaattcgccaagtgtggtggcatccacctgtggtcccagctacttgggaggctgaggtgagagaatcacttgagcctgggagattgaggctgcagtaaactgtaatcgcaccactctactccagcctgtgtgaca

SEQ ID NO: 677639 - DNA, 381 bp, Homo sapiens
  misc_feature (310)..(310): n is a, c, g, or t
ggcgcacttcttatatgtgggctattaggtttctcctagcatttggtatgatggccagactctagtattgctgaaaagatgtctgagcaatagatgctcatgcgaagggagagctgtcatcgaggcagatgccctaagaatgtctttatggagaagggaagtactaacctggcccgaggtgatgagtagtagcaaagaaggctaaaaacggaagggagagaagcccaacacaggaacctgtttcctgaatattggaacggccagagcaggacacctcttcctgaccaaacagaacagaggcttctacctngagaacatggatgtcttccaaaagatctggggatgcccacctttagggtgatttaataagaaattaagggc

SEQ ID NO: 677640 - DNA, 334 bp, Homo sapiens
atctctagcaggatccccccatattactgacctcatatgaccccttctactcttccccttgatgcttctcctcagcacgcaggacatagtactttacggagtccctcttggcgatatctaccccttggaattgctcttgcattgtctcgcgtgttgatgacttctaggatgagagagctataccttgatttctctgcacagccggttcaggaatgaattctgacaagtagaaaacactggccactagcggcacgttcaacaagctattggcacactgtgtggatagtctcagttcggattaaggcatgcaagcgtcaaggggccgcatgatcat

SEQ ID NO: 677641 - DNA, 771 bp, Homo sapiens
gtttttatactttcagaaactttttgtgttctaaaagtacaattgagccttactgtattgagtgtggcagaattaagtaacatcagtgagcaggccacgtgattacttcatgactgccacgcatttacagattggtgtcaaagacattcactatgtttttatggttcatgttatatcctcgcccaggatgacagccccttaaggccctcctgtttgccctccatgctccaggttccatgcacaggttgtagcatgtcctgcttcctgttattcataaattaatctagggtgtaagggggtcagtggggaggagaacggtcagaatcaaatgtgatcattctaagaataaactgtgaccttgagagatttgcctgctagatgctgcaatagaaatacaaaataagatccccaaggtttaaactgacccagttaggcattctgacattctaaaagccggcaaagcagtttatagtgggataaatgggaatgggaacgtgtgtgtgcctccgaaatagtctaagtatgatcggtgaggtgtatcgtaaaggaagcctcatattacagagttgcttttgcacctaaatttagaatggtattccatgaactgttcctcccttgtactctgcttgtctcctctgctgtacctctttgattaccacacgtctgttgcttggattcagtttggtctacttcctttcagctgtgtatcccagactgtgaatacagaaaaggaaacatttcagttgtgattttaccattgtttcaaattcc

SEQ ID NO: 677642 - DNA, 539 bp, Homo sapiens
  misc_feature (192)..(192): n is a, c, g, or t
ctggaccagtctggtaaggacgttggagctaaagataggcagacaggttgagctgggtctgacaagtgagggctggaaatcttgtgaatgtggtccaaggtttgaacctgtgtcctttggcgaagtttgaacaagtcttgttggttaaccttggttcccctggaaagagacaagccaaagggttgggttaanacaaagggatgacgaaaccgcatccatcagaaaggtggatgaagcctgggtctggtcgaggtaccgtagagcagatctagcaggcgaggtttcaggggttaaggtgagacacaggtatgtatttttgggtctcacaggttaaggtctgagccactgaggtcaggctctggtttgtatcccaagaccgagaagctgtgttaagcatggtgggtagagtttgtcaggtgacatctatgaaaccaggagcatgcaaagataggttgaccggaacagccatggtcaaaccaattaaactgtcctgcagttgaggtcaggcacaggtagaacggatctatcaggtgaggccc

SEQ ID NO: 677643 - DNA, 250 bp, Homo sapiens
ttagctaagattgtgcttgtgaggcgtattataccattgtccgtcctactttaaaagagtactcgcggcaagatactattgacccaccgatgggggcttcgacatggcgctttacgtgagtcataactgtagctctcgttaaaagtatctttactataaaagctattgtgtaagctagtcatattaagttgttggctcaggagtttgatagttcttgggcagtgagagtgagtagtagaatgtttagtga

SEQ ID NO: 677644 - DNA, 955 bp, Homo sapiens
  misc_feature (944)..(944): n is a, c, g, or t
ggagatgcttctagcctcccagtaggaggccccagcgcttgccttcaacctggcaggaggtgtagccacgtcctcatcctccctgagtgctgatattctctctctctctttctcttcctcttctttctctctcttctcctctctttctctcctctgtctctcttcctctcacgtctctttcacatcgtcttctatcattcctcttcctctcttctcattacctcattctactaatatatccccatccatgttcttcatccatcccctccgtcatctcatcgttccatcatcctctctcttcactacatccatctcatctaccccatccttgtcttctccatcccacatccctcctcatcatttccttcatcctcttcttcttctatctctcttaccatcgtcttcattccctttccatgttctcatctttccctcgtaccatctatacatcattccatgatcacatcctaatcattcctatccccatccatctattcatctatacctctccctactcctcatcattacatctactcttatctctcttccttattctctctctctctcctgatcatcaggcgtgtagtggcgtatgcagagttgaggctgatgatgtatgtggtacctttcccagaaaaagtgccagttagaagggagacatggacattcctgaatgctctactcttggttgttacaccaagagacaaatatttgtgcggatacttgtgaagccaaaccagaattgcagaattcttaatgttggttcccctaggaaaaaggccttaagtctctgtacctgagcagtggatttgaggccacggtcagagaaaaggggaaatacaccggatacactgtgggacaagcggtcgagtcccccctaaagtgatgtataactcgcctgggcgctactcgtttaatattcaggttgccgtggggctcctctnaatatatgtgc

SEQ ID NO: 677645 - DNA, 907 bp, Homo sapiens
gtcccttctatgttttcttcctttctttgttcttttttgtttcttcttcctctgccttttctcctcctctccgttctctctcttctctttcggttgttttttcgtgtcttcgtcttcttcccgtgcgccttttctcaccctccgttgttctcattttcgtttcctttttgtttttcttttttctctctcactcttttatcttttctctttgcttttcctctttgtcttttgttttgtttctccgttcctctctttcctctctttcctttttgtgctgttcttctcctcctgtccccctctcactcttctttgtctgcttattctgtcttctcttttttttctcttctcctgtcctccctcctgcgctgcgccgcccccccccctccctcccgtctttttcttcacccgctgcccctcttgtcttcctccctcctttccggctttcttcctccctcctctcgctttctcttctgtcctcccccgcgttcctcttgtccgtcttcctcttcttctttgctctcctccttttctcctccctacttcgcttctgcttctccctctctccccctttacctctccctgtttgtttttttcttcttttgtttctctttctcctctcttctgtctcctctccttgtctgtgttgtctcttgcttctgctttttcctttcctgtttcttttctcttttgttcttgttcttgttggcttcctcgccccctgcctttctttcttgtgttgtttgttttgctcccctttctcttcttcttccggtttcttgaccccctaacccaactcatacaacataacaaacaaatccaacactccacccaatacaactactatagacaaacatatgaatcactaataacataaatataaatataacgacttaaatacacaaataaa

SEQ ID NO: 677646 - DNA, 480 bp, Homo sapiens
  misc_feature (125)..(125): n is a, c, g, or t
  misc_feature (167)..(167): n is a, c, g, or t
  misc_feature (170)..(170): n is a, c, g, or t
  misc_feature (258)..(259): n is a, c, g, or t
  misc_feature (263)..(265): n is a, c, g, or t
  misc_feature (282)..(282): n is a, c, g, or t
cccaggattatcgctctccacccaccccctctgcgcgtatgtgaggctgcctggagccgactgcatagggcccacctgcccagcagtgccttgggggacagtcctcgggcagaacgcgaagcccnaagagcctctctggccccagctcttgtagacctggagtctgnacncatcgcccggagcacagccctgcaggctgtgtagacacccctccctctttagggagaccaggatgcgtcccgtccccacctggctctnnccgnnntgtgctcactcccccancctgcccctgcttaaccagcaggttccccttgtgtccctgtgatgtgcacgaaggtcccattgtagaagcttggatctgccatccctgcagacactgtgggtatcgaggactgtgtcatctgtccggaaattcacagttaggtgactgctaccccccaagaccactgcacggtggaggcgtgccacaaaggaaggtcc

SEQ ID NO: 677647 - DNA, 313 bp, Homo sapiens
agctctgaattcgatctgggcggtcaccatccattacgcaaccatggtggtccccgctacgagaggtcaacatattgatgccagaactgggggcggacacccgatcggcatagcgcactacagacacagaactcctgggatcaagtgatctgcctgtctcagcctcccaaagatgccgggattacagtcattattcttcacaagccctcaattttcattagaaatgaagtctcgctctgtcgcccaggctggagtgcagtggcgtgatctcggctcactgcacgctccacctcctgggttcacgccattctcg

SEQ ID NO: 677648 - DNA, 174 bp, Homo sapiens
actctgcgatggctgtgagtacgggtctgtaacctctgacttgtcttgttgccatggatgaaccagcacactttccccatatctggtttgcttcttctatcacggttaacagacattatctgatatttactagggaccctgaagatgcttggtggccctgaagattgttggtgg

SEQ ID NO: 677649 - DNA, 102 bp, Homo sapiens
tcatgtatacttataataactaacacaaacacacaaaatgtgtattgcatctgacaagtaggaataggagataacaccagtaaaatatactttacagtttat

SEQ ID NO: 677650 - DNA, 408 bp, Homo sapiens
tcctgaccacgcatcaggctattctctccacattactaattaagaaagatcactcaaatccttcctgcaatggagaagacttgcttgcttcctggtgactttccctaatttatttttaaaccacgtcaagcatcctgttggctcctgcacagggatcctactgcattcacatttttcacatggaactttgtgtggacttagaagacagaaactcgtacataaataattcacaaagaaagacgataggatctagtaatgtgggcaaattctgtgaaatggttacctgaattataaattataagggtctataaagtctcagttttcagaaggcttttaccaaatccaataattaagtgcattgccagaactttctagattctgagctgctttccagcagggacccactcg

SEQ ID NO: 677651 - DNA, 409 bp, Homo sapiens
catagataagagtgtgcacatactatacttttcagttataaaagaagaagtacccacaccaagataaactaatgaaagaccggttggtctccatctctggtaaatgaggaaagggccaaagtgattcttggattccaattcgaaagggtgtccgtgggccaatgcccagggtctccaattgggagcagtcaagctgagcatttctcggacgtggtgctcctaggacagggcggtcagtaataggtcttaagtgactgctgggggaggttgaaggcatctggcaatggcacatgccatttcatacttagtcatcggttcatggccagaccagtgaagggttcccttaatggagggatccagcattctcttctcggctagctgcgggcacacaggggccacatcttccaag

SEQ ID NO: 677652 - DNA, 644 bp, Homo sapiens
cacgatacaacggagacagagaaaagaaacagaagaaaaaaagataaaataaaaaaaaacacaaaaaaaaaagaaacagaaaaaaacaagaaacaagacaaaacaaaaaaaaaacaaaacaaaaagaacaaaaaaacaaaaagaaagaaaaataaaggagagaaggagagacagaaaaagagaaggaagacaaaaacagaagaagagaaaaagaaagaaagaacgaaagagaaatggaaacgaaggaaagagaacgcgaaaacacagaaaagagaggaaaaggagaaaaaggaaagcaaaaaagagatagagagaagagagaggagaaaacaggaacagaagagagacacagaagaaagaaagagaaagaagaacgaaagagagagatagaagaaaaaagagagaagaaacaaagcaaaaaaaaaaaaaagcaaaaaaagagagagcaagagaaacagaaggaaaacaaaacaagacaaaaaaataaaaaaaaaagaaaaaaaaaaaaacaaagaaagaacaaagaaaggaagaaagaaaagagaaaaagaaaagaacagaaaagaagaagaacgaaaaagagagacaaaatgaacaaagaagacaagaaaggacaaataagaacaagaaaacgagcaaaacaa

SEQ ID NO: 677653 - DNA, 1294 bp, Homo sapiens
tgtggtggctcacacctataatcccagcactttgggaggccaaggtaggtggatcacctgaggtcaggagttcgagaccagcctggccaacatgcatgaaactccatctccacttaaagaaacaaacacaaacaaaacagacagcaacagaaaattaagactggggctataggggagtgtgacacggcgcggccaatatcctaaggcacacccacggaggagacggcgtgaagacgcggcacgagacagacatccccaggttgagacacccgtggagacgcgcagagaactgttcggccgcgtggtgggcccacagagatctggggccccatggggagacatcccaggaaccccgggcggaacacacaaaaccgcaaaaaataggccaatgcttccacaacacacaaacaacacaaccacaaagaaagatagacaaaataagacaagacccattttgtttgatacagcgagagacgtgtggtatttgatggcaaaggtgggaaacaccagagagaggattgaccgtaacgtccatgtttaatgagccttccctagtgtgcagatgaagaggcccgattattacatcaggttctacagagaggatctgtgtgaacacaacacgttactgtggacggaggtaagattcacaagcgacaaacttccacagtgacagaatccgcgccaacagcgaataacaaaaggggagatagcgacaaagtatgcgaccacacacacgctgtgtgacaagacagagggactacaaccacaagagtacagtggaggaggcatgtggacaaacctatcagaaaaccactacagggcaagaagcgaaaacacacatgacgggggatcgccatgtgtgagagattaaagcgcgtcaccaccaacaagtgtatacgccaagacatccgccacacgctacgtggacacgctgcacgaaaaacaccatgacgacaacaacaaggagcacatacacaacaagccacacaggactacatgaggaccggagagcacacggggagacagcgtgacacgacgcgggactgagcccccacaaacaaatcggaggaagagccaaaaaaaatggagaaggcacaccacaaaatgaggaggcacacgacagtatacgacaaaccaggcgagggaccaaaacaagcagagagacgcccccggggcagagagacaaacagaacaacgaagcattaaacacggcgaagatgagatggaagcacagcccagtggcacacaccaaccgagagccaacaccacacgacgcacatcgaaggacacagaa

SEQ ID NO: 677654 - DNA, 123 bp, Homo sapiens
  misc_feature (32)..(32): n is a, c, g, or t
  misc_feature (75)..(76): n is a, c, g, or t
  misc_feature (79)..(79): n is a, c, g, or t
  misc_feature (85)..(85): n is a, c, g, or t
  misc_feature (93)..(93): n is a, c, g, or t
  misc_feature (105)..(105): n is a, c, g, or t
aaaagtgtgtattttttggtttcctaagattntcatttttatcttcttttacaaccagtggtccacaggttcctnngtntgtctntatcggtnagcttgtgttantctagtagccttcccacc

SEQ ID NO: 677655 - DNA, 247 bp, Homo sapiens
ggttttgatatgttcaaacttgtcatttatttacgttgttagatatggggagtagtgtgattgagtgtggagtagattaggctgtagtgtagaattagagtgttaagtgagggtgattggttggctatgatttgttggggatgatagattgctatttgtttttttgtgaattcttcggataattgacatcattaatcttgtgtgcccgaagccgtgctgggtacctgagcatctaattctgtaatca

SEQ ID NO: 677656 - DNA, 332 bp, Homo sapiens
taactacaaaagtcgtacagaatacacagagtccgggtaatatggccatatatcggaggtttaaagctgatgcccatggtgctgtgagcaaaaatacacatttagccaggcgggggagctcaggccatataatcccagcacttagggaggtcaaagcaggaggatcacttgaggccaagagttcaagaccagcctagccaacatggtgaaaccctgtctgtgaggtctacctggtatcgaagaattcaccaaaaacaatagcctcatcatccccaccatcatagccaccatcagcctccttaacctctacttctacctggggtaggtcacct

SEQ ID NO: 677657 - DNA, 183 bp, Homo sapiens
cgcatgtttccccattgaatagatcttgtgtatctactcaaaaagcagttgaccataggttgtacggtttgatttctggactttcaatgctgttccagtatgatctatatgtcttatgccggtaccatactgttttgattaccattgcgtttgtagtatacttttgaaattcaggaagcattt

SEQ ID NO: 677658 - DNA, 161 bp, Homo sapiens
  misc_feature (3)..(3): n is a, c, g, or t
  misc_feature (74)..(74): n is a, c, g, or t
  misc_feature (92)..(92): n is a, c, g, or t
  misc_feature (117)..(117): n is a, c, g, or t
ggnaaccaactgccgaaggcatacggaccaccagtgcggaaactacagtaccggccagggtgtaaccgataganggtgccgacgaacagcanaacgtctgaaccttcgacacggaancttctcagccatggacaggcccggtcagcactaccgcgcagacg

SEQ ID NO: 677659 - DNA, 188 bp, Homo sapiens
tatacctaatgctaaatgaggagttaatgggtgcagcacaccagcatggcacatgtatacatatgtgactaacctgcacactgtcacatgtaccctaaaacttaaggttaagacaaggggggtatcacacattcaggtatcaagcagtcgcacctcaatgcaaattataactcatctagctctggggg

SEQ ID NO: 677660 - DNA, 414 bp, Homo sapiens
  misc_feature (89)..(89): n is a, c, g, or t
  misc_feature (302)..(302): n is a, c, g, or t
  misc_feature (308)..(308): n is a, c, g, or t
  misc_feature (335)..(335): n is a, c, g, or t
  misc_feature (345)..(345): n is a, c, g, or t
  misc_feature (361)..(361): n is a, c, g, or t
  misc_feature (392)..(392): n is a, c, g, or t
agctaaaataacctagaacaaaaatttactcttacgtagtttatagtattgtagaaataattaaaatttaaaaagttaaattacatgtnatattttgcaatatctcttcctaatttacagttgtattaattacctcttgtgtggaaaaatatgaaagtttagtttttaatagtaccttatttaactgggtttgcattgaaatagtataggttgtttctattctgaacggcaaaaagctaagtataaataattgtataaattctgcttcttcccaagaaacagagaaaaaaagaagtaaatcntggagnagggcaatgattggttaatggaaatcntacatagccnctaaattaggaaaccngtaaaataaaatatggccgaccaattgaggncaggcaatgcccctaaaaaggc

SEQ ID NO: 677661 - DNA, 213 bp, Homo sapiens
ggccgacctacagcatgaaggcccccacgaagatgagggcgaccagacccagcagcagcagcttgaagccggcgtaagtgatgttactcagaggcagcgggctctgctggaggccggagaccaggacaaggcccaccaggacggagctaaggagcgccagggtcaacacgaagtgaactgggagcagtagagttttttaggcaggaactacgc

SEQ ID NO: 677662 - DNA, 286 bp, Homo sapiens
  misc_feature (216)..(217): n is a, c, g, or t
aggatcccggagggcgcggaacaaaaggaggcaactgtagggaatgaaacttaggggtctgggaaagcgctgtaaaaggagagaggacctggagatccgctttatcctcatccagaaccgggcaggcaagacgcgcctggaccagagtggtacatgcatgtttgagtgatgatgagcaaacagacagctggatcgaggagagtgctatgcctgtgnngtcaccgtccgatgacgccaatacacaccatactttgtgcgagttccggatactttaagactcatttac

SEQ ID NO: 677663 - DNA, 802 bp, Homo sapiens
cccgtatgtttagacctaacatactgcactatacaccgtgctgtgaaaaagctcctcgtacactgtacatgatccttgacgcgaagccttctacacctccaaacgcgacaatcacgttaaatatccttgtgaacatattctattcgcacatcacgtatttccatgccatacgtcaattgtaaccaacacacgtcattctctatgattccagcgcaatacgtattatcatcatcggccagggccattgaaccagtgggacatccttatcgattacgtctacctggtagcctgtaacagtcctcaaggccaccatctcggtggcaacgtgcaacgaagcctcacaccaaaagtcttaattgtataacgattcgcacgcgatcccttgtgttagtctgagacaccagggttttcctcacttgatatgttgaccctaacacggtgacagattaattcccatgacggcaaaaatatactccaatgtgtctataccctatctgccacttggggggatattggttaccagccgttaagctccgaatcgggtagatgatgcacccaacacaagttagtgtccatgtagttggtcctcacaatcgatacttggtaacccccatgtatgacgcaggatatgcacttttcggtcatgccagtgaggatctgccgggactctagaaacgcatggtgcgaaacaaagttgaagataagagagcattctactggagccacaatctcagagagggtcactcatcagtgcgtaggtccacctatatgtggtgtacagacctgtaatgggtcatagacg

SEQ ID NO: 677664 - DNA, 1227 bp, Homo sapiens
ggggcccacatgccatggacaatattaccaggcagaaccaattctagcgatacccaagtcatcgaacaagaaaagcgagtcaggctacgatgaggagaccactggaaatggagcagcagcgaggcgctatcggtcgcatgaaattgaagacagagatgatagcaaggagcgacccaccagcttcctcccgcctgaagcttctcaatgtcaagccagacaggcatgcaattccagagtcgaaagaggccttatgaagaataactcggggatcgggggtactttgaggcacctgagaggataggacggggccgctctccttcagactcctgctgtacgaggatgaagatgactttgatggatacccttgttgctatgtgacacctagtagactgcgaagctccagttcaaggtgggccgagatcggaggtagtggctatccgttcacaattgagggctttgcatagctgtggtcaggagcccgtgccagctatgggggtcacgagaggggccgtgtactgcttcgagcatgaagatcaatgaggatatctccggtgaagcaggcttccgtctacagaggcctgagccatcaagtggtccgtatccggctggtgccctggatgtcctgtggacacccagtgaggcgaagagccttgatcctatgggtatggaggcactgggaacgaagttcagcaataggcgggttgaaagactagggagacgaggttggaggagaacgatgtgatgggtgctttgcggatttgatgtggaaatgacgggggaacgtgtgtttcaccaagaaatgtagaagtagattggcatggtgtcgatgtcaaagagaaacctagggggagctaggcaccacacgagcaaagcacgtgctgaacacacgccaacagtcgggagcaactgaagacttggagggggagatcgacgaagaaagaggccttgaaacacccaggggcgaaacgtagaagctagcagacaactcgcagagaagtgaccggaaacagagggcacgttagagcagcaacaacaagagaccacgcggaacctaaaagtgaagcagtagaaacggaagagacagaaaggaaaaaagaagactcgaccagaggaacaaaagagcaaagcacagaccaaggtgagcacacacgagagagagaagtgcaactaacaacagagcaagcagctagtaccactgagccagattagattagaaaaagaagacaa

SEQ ID NO: 677665 - DNA, 617 bp, Homo sapiens
ggccaatcgggaggcactgagactgctcacctgcccggctggtcgcggaggccctggcgccaatgggcctcgcgctcgtgcctcccgccccctgcgcggcttcccgggctggcgccggcctccgctcccgcagatgtggatgttcctgagcatgacctgggctccgctgctgctccagctgtggaggggagctgggatggcttagcaggcggctctgggcaggcgggtcccccaatgggcacgagacgcgctggttcccagcccaatggagctctgcgccccccagccccgcgctttacctgcgctgaggcctctggacatgacaaacggactgccagactgcctaggcaggaggaggcctcagcctgagcccgcggccccttggcgctgccctgaactggcctgggagggggtgacgggggcgcgcccgcggtagctgggcccagtcgggcgcccccggagcctgagtgtgaccgagggctttctccctcctcggattattaacagagttcatttcctggcgaatcgggtgacgtcaggggctcggcgtcgcggtggcggggccgcctggccggagaaagcccgctccagttacccaattaccgactgtcatgccg

SEQ ID NO: 677666 - DNA, 299 bp, Homo sapiens
  misc_feature (189)..(189): n is a, c, g, or t
  misc_feature (299)..(299): n is a, c, g, or t
cacacgctgactcttcccaggggcaattctcgagcttgacttgtagggaagggagggggcctgaaaaatccctgaggagtagtggaatagcagatggaacactaagaattgatttccttgaggatagatttccatggtgtgaaagaaaatcgagaggttttaacgaggcaggctaccagcttgtaaccntacatgataagacgttatgaaactgacaacagtaatagaatgacgcctatagaggctggaagggagatccttggggtccaagaacaagtttgccttggttgtgggaagtn

SEQ ID NO: 677667 - DNA, 151 bp, Homo sapiens
cacgtactcgctcatacatgtgcgtcaaagaacatccgcagcagtggggggaggctgttctaatggtcactacaagggcctggagggcagtagagcgcctgtagctccttctagctcgtcacacagtgtatatcatgcagcacgcttcgct

SEQ ID NO: 677668 - DNA, 90 bp, Homo sapiens
acgacagccactttgggctttggagccccccaggccccagtagcagataatctcagtgataccttgaagaagctgaagataacagctgtt

SEQ ID NO: 677669 - DNA, 873 bp, Homo sapiens
  misc_feature (600)..(600): n is a, c, g, or t
tcgcccacggtgtgagggcctggcagttgctgcgccctcgctttcttgaccattcccaggtcttctagtggctctctatacccgcgaggctcagcccctagcagcacatgttgtgccagggacctttgcgcgtgatcaagatccaatctacgggacatcacatggggctcggatcgatggagaaagcttcggagatgatgtcgacaaagctgctgtcctccaccacttggaaactgatcgaatgtctctgaagttagtgacctggaacagggaggagcgtcaaccattggtagaagttgtcgtatgctcactagaaggggatgcatgtgcacttgtcgtacagctgtaggtgggtggtaacgcacacgatcactactattcgcactgagagaaaagatctggtatccaacgagatgtgacacgcctgatgggttcctgatccgtagatgcttcatggccaaaccgttagactagactagtgggcacatcatggcgtgcatcggaagcaaaacgttggctagcggaggcagcgatgcatctttggatggcgtgccttggtgacatgggtgcatgcacccacatgattaggtcatgccttcnagggtaccagtagatggcgcagaccatcatgattgccatgttctctcagagtggcgagacacatgacgccccatgttaggcccactatggaagttgcgagcccatgtaccacaagctgacgcatgcgtcaccgtcaaggcctgaaggtgcaatgggggcttctacttgtgctgccaaactttaccacggaccactctgtgggcgcgactgcgaaaacaagttcctcttccaccctttcaatatgctccaacttggtcctgggaattcagcaag

SEQ ID NO: 677670 - DNA, 455 bp, Homo sapiens
tgtggttgggggaatagaaaaacccgggtttatatttcaaaaaaaaaaaaaaaacccggggggtggggggttgtccctcaccccacctctcccagataaaaaacagacggggtggctggggacaacaacacacgtggcggcgggcgtccccacgaggcgaaacttgtggaataacaccccgacggcacgtcgtggtagtggataaaagagacaggtggtgtgtttttcccgcggatgcaatgaggatatttctcccctgtgaagatatgggggaccacaaatgtggagaggggggagggacgaaagtctgcgggtgggaacagaaaaaaaaaatgtttgtggtgggggaccattttgaagagagacgcgggggcatatttatcaagagggattggagaatatgtggttctattgaagggtgctaattttgggacgggggaaaatttaagaaaaaa

SEQ ID NO: 677671 - DNA, 564 bp, Homo sapiens
ttttttttgacggggtctcactttgtcacccaggctgagggcagtggcgcatcattgctcactgtcagtccccgtctcctgggctccagtgatactttcaccttggcctctcaagtagctgggactacaggtgcatgccaccacacccggctatttttgtatgttttgtagagacggggtttcaccatattgcctgggctggtctcaaactcctgggctcaaatgatctgcttgccctggactcccaaagtgctgggattccaggcatgagccaccgcacctggctacaactctttttttttttttttttttggaaatggagtctctctctgtggtggcccaggaggcggaggttgcagtgagtttgagcgcgccatggcaccccagccgtgggttggcgccaaagcccggttgcccccagggggcccagaaggtgccgtgggagtgcatgtgttggagaaagtgcagttcttacagattccttcccctgtgcccacgagggtgcatctcagagaacctggccgtggcaaaaggtgtgatctcccggttcgtggacactcttca

SEQ ID NO: 677672 - DNA, 278 bp, Homo sapiens
tattggacagaagcccaaagcagcaaattgtcacaattgtggaccccacattggcctgagatccaaaacgcttcgaggcacccaaattacctgcccattcgtcaggacacccaccacaccagtgttatattctgcctcgccggagtgggtgtcccgggggcacttgccgaacagcaccttgcgtccccaggtttgcagctctcccctgggcaactaaccatcctggcccgggctgcctgtctgacatccgtgcctagtcgtggatctacatcttgcct

SEQ ID NO: 677673 - DNA, 149 bp, Homo sapiens
gccagcctcagtgacagagcaagaccctgtctctcacaatacattaattaattaattaaacagaatgtacattgtttataggggacatatatacgacataaggacacacaaggtgacatttaacagatggacaagcatgatcacaatga

SEQ ID NO: 677674 - DNA, 281 bp, Homo sapiens
gatcaaagtagtaataagagtaattatgacaaatatattaaatctctgtcggagttttctaatactaaaaatgggatttttgctctaagaaaaagtatgttaggagacctaaatatgttatttaagatgttctccatactactttctgatgagtgatgaggaaagatctgagtgtagcttttttagtccgatgggtatcggtgatcagcctagtcaatgtgacctgtactaatggatacctctgtgttatttgctaatcgtgagtctgtattaactgcttg

SEQ ID NO: 677675 - DNA, 1419 bp, Homo sapiens
  misc_feature (1412)..(1412): n is a, c, g, or t
tgtaagaaacgtggtctggctatgttgtccaggttggtctcaaactcctgggctcaactgatcctcccacttcaacctctgccatagccaggaccctcgaggtgtgttcagccaccacacccacgagcataagttgtttttatcttagtgtaaaaagtgggagctctggcctcgtgttgctcaggcgtggtgtgatagataggggcacagttcattagcctcacgtgtaacctttcaagtgccgtgggccttgaagcaatttcttcccggccctcgagtcttctcccaagtataacgtgggaagtatattagggtgttacaccacaccaagtgcccagctataatataattatagatagcataaataggagcgagatatatagtgttggacaatggagctcttcgcctcgtgtcgcccgaggcttggagttgcagtggccgcagtcttcaggcttcactgtgcaaccttctgtgcctcccgggtttcaacgcagttctgtgtgcctttcagcctcacgtgaagagtggacgtgggaattatacaggcgacccgcacacgcgaaggcccgtggatataacattgtggataatttataaccgcagaagaagtggaggtttacaccaagtgtttgccccagggcgtgggatcttgaacctccccgaccatcaggttagatccaatccgaatagaggcctccccaaaagtgctgggattgaacaggcattagacgccacttggttgcccaagcaccgcccgaactattcgcttcaaacatacactgttcaagaggaacagggaggtcatataacatggtacacccccagaggtatgaaaagggaagaatcgtaacagcacaataggcctctaacagtgacaggccctttcaaaccctcgaggagagacctaaaacgggaaaaccatactaaaagattaagaccctcccccagtagagaacagagagacatactacgaggggaaaacaaccccccaatagtagtggaaaacactataagaggacatacggcaaaaaagctacaggcgtctacgcacacatatgagacagaactagtgactcaacataagctgaggagtacccaaagaaaccacaccacaaacatgtggtaaccaaaaagagcgcgatcacaaagagaggaaccacaaaatccacaggaagaagaaacaattatcgaagaacaggtctgtggtaatatagatgacagggaggactacaacggcggcaaaggaataccacgaacatactaagagacggacaaaaatagtagttgaaacaacatagccgagcaagtcgacgagaaacaatcaaccactcgagacacagacgtgctgattgctgtatggctgtctgtctacctagttgactagctcatgctgtctagtagtagaggggggntaggggc

SEQ ID NO: 677676 - DNA, 228 bp, Homo sapiens
ctgtggctggttgctgacttggaggagtgacttgcagcaggttcttagctcttgaagctcttcctgggaggaggaggtggtggagacaaatttgacgctggagctgctaccccgcgccagtgccaaaggccacccccagccctcggccactgcttgcactgaagccggagccccccacactgagcccaccactttatgccgacacccccactgatgctaggagtagta

SEQ ID NO: 677677 - DNA, 269 bp, Homo sapiens
aagctcgcgtaccgctctttgggtggctcgtggatgcggctcttggcgtggctcgttgtgtggctccttgtgtggctctttgtgcggcccgtcgggtggctcatggtggggctctttgcgaggctctttgggtggcgcgtcgggtggctcttcgcgtggcgcctggtgccggcacttggaggggctcttcgtgtggctccttgtgtggctctttgtgcttctcttcagccccttccctgtgtccacctttctctcctctccccaacgag

SEQ ID NO: 677678 - DNA, 226 bp, Homo sapiens
tgtttaaagagacagggacttgctgtgttacccaggctggagtgcagtgtctattcacaggcacgatcattgtgcactgcagccttgaactcctggactcaaccagtcctcccacctcagtgtctcaagtagctgggactatagacacacaccactgctcctggtgtgatgtttgttttgttttgttttgttttgtttttattgagacggagaaaacctgggcact

SEQ ID NO: 677679 - DNA, 160 bp, Homo sapiens
gatggtggcatggtgagtgcgataggaaaaacatcttcccctgctgtagtgctactgaactggaagcgctggtgtgtgagtgaagctcagactgtgtactccagtgccctgagaacagtgaagagtgtagatggaagtatgactagtgcccagtgctggc

SEQ ID NO: 677680 - DNA, 879 bp, Homo sapiens
gatggtgctgatggaccctagcggagggctgacatgctgagggggaggggggctagaggaatccgattgataaggtccatgcctcattttgtggttgggtagagattgatgtacgaaagtacttggaagagtatagtcagcaggtgtggtagagatttggcagccagcgattggttagaattggtaatctaagtcagcgtgaagattgtgaggagagcacatatgatgatttagaatcgcataaagctgatggagggcctggataaaagtgttctaagatgtcaggagagttgatatgaagctgctcacatgtgtagaaggctgttctttaagtggatccgttggcaggatgggatgaggaagtgggcgaaaattgttaggcagataagaaagtgggaaaggtgggggagatcaaaggatgaaggtgtgtttgaagcagctaagcatgttaacgtttctgcatagctggttgggggatctaagttagatgtggttggcggaactattgtgatggagtaggatagcccgtactggtgtttctaatagaacttgaaaataccaatgcaggtgctggggccgtaccattgcagggtactattttcacaatgccataggtttaacggagtatattctaggagtgttataacgcatgagtggacttcttacttggccattatgataggagtgaggcaatattgggggaagtgtgaatggttgattgtgtgacagttgtaagcctgatgtatgcaagtgtgggaaagatagaaatgtaggggtggaagaggataacaatttagttaatggacaaagacgctgaagtgatgggaagagataatatcaatttgatggaaagtatgctatggccaatgtaaataaaga

SEQ ID NO: 677681 - DNA, 182 bp, Homo sapiens
ttttagaaaagttctaaagttataaaaatgttttttgcagtaaaaaaaaagttttttgggccgggggtggtggctcacacctgtaatcccagccccttgggaggattaggtgggaggatcattttaggccaggagttttagacctgcctgggcaacataatgaaacttccttttcagggaga

SEQ ID NO: 677682 - DNA, 694 bp, Homo sapiens
  misc_feature (138)..(138): n is a, c, g, or t
gaagagaaccaagcctcagtctccattgtggttggctcacacatgggtcttcaggttggcaaggaagtaggaagtccgggttctcagtgtgatggacccccagggtggtcttaagatgaggtaaattctggtcatcantgtgaagtgcctcgggggtctccggggtcctgagtagaagcaaggtctgtttgtcactgtggattcccccctgccaagggtccccaggtcagtcctgaggagaaggcagctcagtctttactgtgatgcagcctctagtgatccccaggtcctgagtagaaggaaggcctggtcctctgtggattcaacccagaggtctgtgagcagaatgcaggtactgcaagcaggctagacaaggtgtgtgcttgcaccccttccttactacctaggcacagtgttggatggtcagtgcttcctgttttgtgatggccatgtgccccctcttgcagtcccagtgaacccctgaaattcaatcttacgattttccatgccataattttggaaaacgaaactgaaatagagtccatcattccatgccttaattggaatggatagagataataaaaggcaaagtagatggccatagacaaaagtcaagtgatttcctatatatttgaaataatgtatagcaataattggaatttgtaatgaataaaatcattcaaaaaaatctgaa

SEQ ID NO: 677683 - DNA, 207 bp, Homo sapiens
cgccggagtgcaatggctcatgtttgtaatcccaacactttgggaggccgaggctagagaatcacttgaggccaggggttggagagcaccctgggaaacatacaacgattccatctctacaaaaaaatttagccccagtgtggtggctcacacctgttatcccagcaactcgggagggtgaggcgggagaatcgcctgagcctggga

SEQ ID NO: 677684 - DNA, 886 bp, Homo sapiens
tatttatgtaacgcaggtacattggataaaatgtaagccctgactgtaaggtttagcactgggtgtacttaatttataaaaaattattattataatcaatctattataaaaatggcctatcactgaacacttcatggattgatgttcgaagtaaggattagaaacatagagctcccaagtatttaaacacctaaactgtgaatagacccatatatacatagcaaagttgtctgccatctagcttcttgaagtctatgggggtctaatactcaagtactatggtaagtatctaagcttgccatcatgaattgagctataatttttagcgttatgcccatttataacgtagttgtatgactcactagttgtgagttcagaaacaaacttaaaatttggggtatagaaccccctcaacaggattacgtaatgcatggaatttcgtatgatgagcagagtaagtgtataaaccagagagtgatttcatttacacctcatagttagggtatgccagagagatacatttccctcttgagggcccctgtgggagacagagcaggcttagattttccctacgtggcgaagggtttttaaaaaagtgaggtaaatgcccgtactattcatcaattgacctctacattgtgtcgtaggaatagatgcgttcaggtgtcatagagggtatccgtctgctagaacacttgtcgagaaataacagcgtcaatcaaagatacctatgccttatggagataccccctcccctttattgcggccggttgaaattctggcaatggagaaagccaaatttactgtaaccgattaaagtaattaaaagccgggttcacaatctaaaacttctggatctttctctttaaaaactgggctcccacag

SEQ ID NO: 677685 - DNA, 160 bp, Homo sapiens
cttcaactattcgagagtccttcattatacatcatctggactcgtcacctgacatgatgttaaggtcttcaacacctgatgcagtagtattaacatagggtgatgaatattatttttctagggacggctcttaagaggaggtgtactcctataatcgccg

SEQ ID NO: 677686 - DNA, 970 bp, Homo sapiens
gggtgtggtgcaggttgagaatgaaaatcattgcgattttgtgaaacttcgagagatgctgatccgcgtgaacatggaggacttgcgagagcagactcactcccgccactatgaacttgtaccgacgcgttgtagagcgtgtgagagagatggggttcacggcacactgaccctgacgagcgaaacccttctggtcttcaggcagacatatgaagcggtagaaggaatgacattcctggggagaactgcagaccgaactggaaggacgaaatgagacaaatgttgttatgagagtgaaggagaaagaagctgaacttacggaggcagagaaagagcttcacgagaagttggaccttctaaagcggacacatccaccgaatgaacaagaagaaagtggagagactaataatgaaggacgcttgaggaggaggtgaaacaaccttccagaagaggaaagcagcggctcagtagactacagtcccaggcccagcaactctggggcccagcaaaccagagaaggaccaggataagaaacacacttcttctttatgttaccatcctgttgaacgagccctactctctcctactggtcatgagcattaccagagcaggagcgtctgttcgcacgtgtcggggaagagttcacctcattcagccatcgactcctgtttctcttaaagtctgggtcacgatcttgtcgctgtggtgtgtacttgtcaacggctgcctagtgcttctggaagtgacttacagtaccagaatggctttcatatctcatcaagcagcgcgctgtgacacgaacgtggccgaccacgcttgtcgggccctgtgacttctgtccgaggcgccgacggggtgagcagggccacatgggccccggccatgtctgggctcttgctgctgagccgcccgggagccacttggtgtgggggaccttcggcgctcttttcccgcgtctgtcgttcggggt

SEQ ID NO: 677687 - DNA, 162 bp, Homo sapiens
taggtcggaccttacattgctctaatggtcagtgatgttgaacttctgtttcaacgcttattggctgcatgtatgtcttctttcaatgaagtgtttctgtgtgtcctttggccaatttttaataatggttgtttgtatactcgtgtaaatttatgttcctta

SEQ ID NO: 677688 - DNA, 451 bp, Homo sapiens
caacaggagcccgagggtctactgcaaccagatattcataaacaatgaatggcacgatgccgtcagaaggaaaacattccccagcgtcaatcctgtccacttggagaggtcatctgtcaggtagctgatggggacactgcagatgtgcacaagggcagtgaagtgcgcccggtgccgcctaccagctggtctcacctttggagcctaatggacgctatcacacatgggcctgtcttgatgaacctgccctggtcgatctgatcgagcgggacctgtatactatctggcggccttggagaccctggacaaatggacagcgctatgtcatctcctacctggtggactttggacatgtgtcctcacatgtctccgggaataaatggcggcttgtgttgatactgtaaccacgggacaacccatccccattgacggagactacttcagggtacac

SEQ ID NO: 677689 - DNA, 680 bp, Homo sapiens
gagaactgggcatcagccaaaactcaagccttgccttttaggaggccaccagcagagggacttggtcctacttgactggtctagagacatgccggcgacctgaggactccactcacactggcgagcaaaaagggagcagtgattctcttttctctccccaccccctgccctttgtgaccaacaccagtttcccagggggtacatgagtttctaaatttttaaaaaatgttttgggttaggtttttctggggactgataagtgctttaagcaatgcccataccccgtcaagactcccagcttagtcattttcttgaatatgtactggcacagtattctgtgtgtgtgcttgttttggcagctgattgtggctggattatatattgagtgatgaatagatcctcttttttccctaagggatatgaactgcctttcttgcgttatattctgcttacgaatagctggagccctcgcgctgtctcgcgtaagctaaggctcgcaagcgagaagagagccggtggaatggacttgtccctgacaggctgaactacctgagtctctgatcttttcagtacaatcttcgcaaggctttaatgccacatcctatcctcttttaccccttctgatgggagggacccggtccacactatatgctgctgtgcttcacccctccattgccggg

SEQ ID NO: 677690 - DNA, 430 bp, Homo sapiens
  misc_feature (150)..(150): n is a, c, g, or t
cctacgtgctactactaaattcgcgggcgggttcgacccttgaaaacattctttttggtgaacctgccaagtggatatttagctggctttgacgatttcgttggaaacgggaatacatataaaaagcagacagcagcgttctgagaaacntacttggtgatgtttgcattcaagtcacagaatggaacgttccctttcacagaacaggtttgaaacactccttttgtcgtatctggaagtgtccatttggagcgcattcaggcttgtgttggaaaaggaaatatcttcccataaaaaccagacagaagccttctcggcaacttgtttgtgatgtgtgccctctactaacagagtcgaacctttctattcatagagcagttttgaaacactctttttgtagaatctgcagtcgacgcggccgcgaatttag

SEQ ID NO: 677691 - DNA, 316 bp, Homo sapiens
  misc_feature (58)..(58): n is a, c, g, or t
  misc_feature (210)..(210): n is a, c, g, or t
aagaaaaccaaagaaaatattgacatcatcacttccattttcattggaagtgaaagtnatcagagaagaaagacaaaagaatatttcattatcacaacttctaagcacagtgaaagaggaaattttctattccttactaaagaataaagaaaaataggacaagtcattactcagcttaagaaataaagagaaacaaaataaacctaaaanaacaggaagaaggaattaataaagataaaagctgaaattaaagggatagaataatggataaataaatccgaaagctgtttctttggaaagaccagtaaaatatata

SEQ ID NO: 677692 - DNA, 193 bp, Homo sapiens
tggacaagcagaataaaaggaggctctcaagaaacatagtggggttttgatttgggatgactggaaggatgatggtgtcatttaaaaaatattttaaagagttaaatatatatatgtatatgtatatacacacacacactacaggcacacatgcaaacatataaacaaactttgaggagaagctgctggaaag

SEQ ID NO: 677693 - DNA, 299 bp, Homo sapiens
gtgatgtatccttttccagaaagcaaatctgcagcagtatttctataataatgctacccttttatttagaatcttttaaaatatgctttattaatgtcaattttaaaaatatttgaccactacaaggatttttatataccccactaattaagacaggattttgtacttgttgatgctctatttacacaggttcattggaaactgctcttcattgccttactgtgatgctgacaatgccttgtgagcggatgctgaggacaggctccctccattcaacccggagggagtatctaaccacc

SEQ ID NO: 677694 - DNA, 645 bp, Homo sapiens
gttctatacttacaattttgtgattcttagtacatgagtacaggctatgctgtgcttgttttgcaatgccagttttaacactatgttacatttttgtttacagtaagttaaaccttatataacattaatgacatttgatttctggatttttcccatgataaaaattagggggataaataaaattgtcactggaatttctctgcttttcttttccccccagtgttatactttattagaattataattgatagaactttaaaatcatcaacagtttgtttcctttgacattttaggtgataattgccctttgagatccattacatagcataatggcagcataatattaagagtgactcatggctaatcagtaggaaataaagatcagttactatcctgtattctgtattgctggctattaaacagtaaggtaattaacaaattgaactacagtttacacacaatggggcaaatggggtagtaagagcaaggaagaaagtttaccaaactaaatatttaggttattgtatgataatattgagactacatttctaaattattttgagaatttcaactttttattctacccaaagtaatctgaacttggacttgttccacgcttactttcttgaagaatggttaaaacct

SEQ ID NO: 677695 - DNA, 898 bp, Homo sapiens
gttcccgcttgctggtgactcaagtggttagtaggttgttatgcttagctgtcctgtggtcttcatcctcctccccttgtaatgaaactatcatctattctgagagcgtatgccatagccgatgaaggtcccagagtgttgggctgtagatttaggtacatatattgcgtgcgtagtatgaattgaaatcaaagtaactgtgagctactactgggaagggatagaggcatgctgagcacatggacttcacctcctgacatactgaatttgaaccgcagtgcctctaaggtaggggtccgatacgctggagtgtccaaggaaggctggtcggctgcagaggattgtggagcctctccggggacaggttaggtaatatctaagtgggtccacggaaccaagctagaccatgtgggggtgtctgaatgtggcatttgcgctgaggaatggcacttgtagtttagctaagaatatactcaacacgatgatgtggacactcttcccaatacataggaatcgtcattgaagcttgattcactcgagttctcagtatccctgtgttccttttggagtggtctactgctatttgctggagagatcctggttaatgggtcttggggactggaaagttggccataaagggattctctgggtccttttttatgttaagacctacttactattgactagacaatgaatggtgcattgcagagtgacagcgcctgtaataggcaagttggggaggctaggcgaggagctcacaaggcagacagggggacaccgggcaactggtggaacccgtcttggagagggaagactgcggacaggggcggaatttggacggcaaaggggggcaaaatgttacggcggaggatcggaaacaaaacagggggcaaaaccc

SEQ ID NO: 677696 - DNA, 161 bp, Homo sapiens
aggggggcgcaagagagaagaacttcacacttcttattgctcagcctagatagcagcagctgggaatacgtaggacaaacaggacgtcgaacaaattactccactatattaaattcactacaccacttattctttcttgaattgtaaacactaagtgtagt

SEQ ID NO: 677697 - DNA, 204 bp, Homo sapiens
gcagatatctgacgtgccaagtcgtcccatgctcgtgtcctccttatctgggatcccgattgcctgcgaacatagactcgcaccatcctcgggctgctgggccttggccagtgccgtgtgttggtgatctcgatcacggatcgcttcatgttgaagagttcgtccttggagatgatgcctttctcatccaggatcatacattgg

SEQ ID NO: 677698 - DNA, 718 bp, Homo sapiens
  misc_feature (36)..(36): n is a, c, g, or t
  misc_feature (64)..(64): n is a, c, g, or t
  misc_feature (74)..(74): n is a, c, g, or t
  misc_feature (109)..(109): n is a, c, g, or t
  misc_feature (111)..(113): n is a, c, g, or t
  misc_feature (125)..(125): n is a, c, g, or t
  misc_feature (129)..(132): n is a, c, g, or t
  misc_feature (139)..(139): n is a, c, g, or t
  misc_feature (145)..(145): n is a, c, g, or t
  misc_feature (167)..(167): n is a, c, g, or t
  misc_feature (183)..(183): n is a, c, g, or t
  misc_feature (200)..(200): n is a, c, g, or t
  misc_feature (212)..(212): n is a, c, g, or t
  misc_feature (238)..(238): n is a, c, g, or t
  misc_feature (246)..(246): n is a, c, g, or t
  misc_feature (261)..(261): n is a, c, g, or t
  misc_feature (263)..(263): n is a, c, g, or t
  misc_feature (266)..(267): n is a, c, g, or t
  misc_feature (281)..(281): n is a, c, g, or t
  misc_feature (284)..(284): n is a, c, g, or t
  misc_feature (296)..(296): n is a, c, g, or t
  misc_feature (303)..(303): n is a, c, g, or t
  misc_feature (314)..(314): n is a, c, g, or t
  misc_feature (330)..(330): n is a, c, g, or t
  misc_feature (348)..(348): n is a, c, g, or t
  misc_feature (353)..(353): n is a, c, g, or t
  misc_feature (379)..(379): n is a, c, g, or t
  misc_feature (381)..(381): n is a, c, g, or t
  misc_feature (384)..(384): n is a, c, g, or t
  misc_feature (394)..(394): n is a, c, g, or t
  misc_feature (401)..(402): n is a, c, g, or t
  misc_feature (405)..(407): n is a, c, g, or t
  misc_feature (429)..(430): n is a, c, g, or t
  misc_feature (442)..(442): n is a, c, g, or t
  misc_feature (445)..(445): n is a, c, g, or t
  misc_feature (449)..(451): n is a, c, g, or t
  misc_feature (453)..(455): n is a, c, g, or t
  misc_feature (459)..(459): n is a, c, g, or t
  misc_feature (465)..(465): n is a, c, g, or t
  misc_feature (468)..(469): n is a, c, g, or t
  misc_feature (476)..(476): n is a, c, g, or t
  misc_feature (478)..(478): n is a, c, g, or t
  misc_feature (480)..(482): n is a, c, g, or t
  misc_feature (502)..(502): n is a, c, g, or t
  misc_feature (509)..(511): n is a, c, g, or t
  misc_feature (532)..(532): n is a, c, g, or t
  misc_feature (535)..(536): n is a, c, g, or t
  misc_feature (565)..(566): n is a, c, g, or t
  misc_feature (568)..(568): n is a, c, g, or t
  misc_feature (642)..(642): n is a, c, g, or t
  misc_feature (650)..(650): n is a, c, g, or t
  misc_feature (698)..(698): n is a, c, g, or t
ttctacatttatctttttatatcttttttaacatantatttctgccgttttttaatacccaganttttatcttntccatcttcatccccacttcccatagcccaaacanannnacataaaaattnaatnnnnagcacanatcatnctccaacaatacaaattccctnctaccaaaccaccatnatccactcttacttttntcacaaactctnctaaaaacaattctctacgttcactnttcccaanggtcattctaaacantngtnnccaccaccccttanaancaagaaaaaaanaaaaaangcaaataaatncagaaggcaaccaaancctcccaaatgcccctanctcangacccattccccgcagcttagcagtngncantcaaggcttngccacanncannncttttctcaatatcctttcagnngcaatatccaanctntctnnnannntctngggatncannaaagatntntnnnaatcactcattccatttctncattttnnnttacatgcttattcttccaanccnnatggagcccttatgcctcatcctcactgnngntcctattcctttaatattatcttaatgtcaactcccaggcctcctcttccagcaataaggaagccatgtctganaggggaanggcaagatgtgccctcagcctcactcaatgagctccacgtattggcanggaacatgccaaaatggcca

SEQ ID NO: 677699 - DNA, 217 bp, Homo sapiens
gtcgtgcagccttcaactccctggctagaaccgatcctcctgcctcaacctcaagtagctgggactacaggctcacaccttgacgcttggctggctttttttttgtggagatggggtcttgccatgttgcccaggctggtctcaaactcctatgctcaggcgatccaccctcctcggcctcccattagtgctggggttataggcaagagccactata

SEQ ID NO: 677700 - DNA, 123 bp, Homo sapiens
gccaatcgctagtaaactgttgaccgctgtgcatgtctgatctaggtgccagtgtaggtagaaaatatcaccatatctcaatgggccacaggtggtctcacctctctgtacttctgtcaccat

SEQ ID NO: 677701 - DNA, 173 bp, Homo sapiens
ctatgccggtctatctgaggatccccccttccccacagttaggggggcacgtcggcctcccaaagtgctgggattacaggcgtgagccgctcacccagcctaagactaattttattttttgggagatggcgtctcgttgtcacccaggctgttgtgcagtcgcgcgacctctt

SEQ ID NO: 677702 - DNA, 324 bp, Homo sapiens
  misc_feature (292)..(292): n is a, c, g, or t
  misc_feature (306)..(306): n is a, c, g, or t
ggggctcttggggttcggctcagctcaacatggcttgacatggtgggcacactggcgcccagtaagagagagagagagccaaagctgtccgttttgcagatggacaggaaggagccaggacacagctcagcttgctcacgcccagagagagaaaaagttaagctgctgaccctgaaggcaagggagagcaggctgcacagtgtgtgtggaagccacgggttcaagcagccaaggcagggcggaacagtgttgagagagctagtgttaagctgtttgatggagagctgtttgntggaattaaaaccntatttcaccttgccaaaa

SEQ ID NO: 677703 - DNA, 507 bp, Homo sapiens
cgtaccttgttcggctctaccttgatccctcggctctaccttgtttctcggctctaccttgtgtctcttcttcaaatctccttagagctaacatggatgggtttgaaggaagagagactataagaagaaaatataagaagatcaaagcatgagtagcaggagcagctgcagctcgcgtgtgcgtaggattagcattagtaacaacagcagtgataatcagcagcaacgagcagctcagtatagggcagttcatatcctggctttcacccattgatgcagtgaattgctatattatccttttggccagatagctacgtttctggttcccccacagtaggtgttttcacataagattagggtccttttggaaagaatagttgcagtgtatatagagatagttgtggtaagaatctagtttattttgcatttggctaattggtctgtgctgcatggttatatactcctggattatatattaaaagtctctgtagacgaggtagagccgag

SEQ ID NO: 677704 - DNA, 438 bp, Homo sapiens
ggcttactagatatgtgcgttactaactaagaaatacaatgcagtgtgcgtgcagggatggattagcgatacgggcctatccggccaacgccaagggcccatgagctcaggggggccctaaaccagagcctctgcgtgaagtcgctgttattaactttgcttgctgtcaattgtttttagactttgtatttgttaatatcagaggtggcttaaatgtatctcttatttgtggttggaagcggtgtattttgttacatgtcctgacccatggtttccataacaacaatacactacaacatgaaacatgaaatcactccaagcaatatgcattagctgacctaaataagatgctatttgttattactttgtttgttatttcaataattgacaattttaatgtcgcctaccattttatgggagcgatgagggacaggtggg

SEQ ID NO: 677705 - DNA, 398 bp, Homo sapiens
gacaaactgcactgactggaatacaacagcagaacactgtctcaagaagccgaagacctaaataagcgggggtggaaagtcccagattggcggctcaggagacacagtgagtgtacgacagctacaccctcacagatgactcgtggtgagtcaccgcaccagctatcagagttctaactagcttgtttgagaagtgatccaaaattctagatggagatgttaacctcttacatactacatcttacagagctatacaactttttcttaaaacttttttgcagagtagaaaagacataattaacatgtctaggggccgtggtggtggctcacgcctgtaatcacagcactttaggaggccgaggcgggaggatcacttgatgtcaggagtttgagaccag

SEQ ID NO: 677706 - DNA, 690 bp, Homo sapiens
  misc_feature (7)..(7): n is a, c, g, or t
  misc_feature (66)..(66): n is a, c, g, or t
  misc_feature (72)..(73): n is a, c, g, or t
  misc_feature (77)..(78): n is a, c, g, or t
  misc_feature (80)..(80): n is a, c, g, or t
  misc_feature (84)..(84): n is a, c, g, or t
  misc_feature (88)..(90): n is a, c, g, or t
  misc_feature (99)..(99): n is a, c, g, or t
  misc_feature (101)..(102): n is a, c, g, or t
  misc_feature (107)..(107): n is a, c, g, or t
  misc_feature (110)..(110): n is a, c, g, or t
  misc_feature (116)..(118): n is a, c, g, or t
  misc_feature (120)..(120): n is a, c, g, or t
  misc_feature (123)..(123): n is a, c, g, or t
  misc_feature (127)..(127): n is a, c, g, or t
  misc_feature (147)..(147): n is a, c, g, or t
  misc_feature (152)..(152): n is a, c, g, or t
  misc_feature (155)..(155): n is a, c, g, or t
  misc_feature (165)..(166): n is a, c, g, or t
  misc_feature (172)..(173): n is a, c, g, or t
  misc_feature (177)..(177): n is a, c, g, or t
  misc_feature (199)..(200): n is a, c, g, or t
  misc_feature (234)..(234): n is a, c, g, or t
  misc_feature (259)..(259): n is a, c, g, or t
  misc_feature (261)..(262): n is a, c, g, or t
  misc_feature (270)..(270): n is a, c, g, or t
  misc_feature (316)..(316): n is a, c, g, or t
  misc_feature (327)..(327): n is a, c, g, or t
  misc_feature (348)..(348): n is a, c, g, or t
  misc_feature (352)..(352): n is a, c, g, or t
  misc_feature (364)..(365): n is a, c, g, or t
  misc_feature (384)..(384): n is a, c, g, or t
  misc_feature (391)..(391): n is a, c, g, or t
  misc_feature (393)..(393): n is a, c, g, or t
  misc_feature (395)..(395): n is a, c, g, or t
  misc_feature (409)..(409): n is a, c, g, or t
  misc_feature (416)..(416): n is a, c, g, or t
  misc_feature (471)..(471): n is a, c, g, or t
  misc_feature (496)..(496): n is a, c, g, or t
  misc_feature (603)..(604): n is a, c, g, or t
  misc_feature (613)..(613): n is a, c, g, or t
  misc_feature (626)..(626): n is a, c, g, or t
  misc_feature (683)..(683): n is a, c, g, or t
agacagnctttccagaccccatcttttatacccaccccaacagtctaactctaaagaggataaagngaatgnntttnntnagangagnnnaggggtaangnnggttnggnatgggnnngngtntttntggtgggttatgagaattgngaaangantcaaatattnncagggnngggngggcaagggggggggtgatcgnntattcagcaacagcgagaactgcatccaaaaatntcatcccaggaattaaataaggggngnnacattcangggcatctcctccactgtagtattgtagaaagtgtcaatgtcacgnagaatcctctngggttcttcagtaacaaagtntatngccacacctttnntcccaaatggggcccctcngcgaatngngnggtttggttttgangattggngggtagatcataatttataaccaaagttacttgttgcacatcaatcccgcgagcnaacaagtcagtagtgatcagaacangacttgaccctgaccggaattccctcatgataacatctctctccttctggtacatgttaccatgcagagcagaaactgtgaagtctctggcatgcatcttctcagtnngccagttcnacttgcgcctcgnattgagaaaataacagcctgtgtaatggtcagtgctcgtacaagtcacaagtgtatncaacttc

SEQ ID NO: 677707 - DNA, 346 bp, Homo sapiens
gcggccgctactactactaaattcgcggccgctcgaccagcctcccaagtggctgagactacaagcgcatcagccatgcacggctaattttttttgtatttttagtagagatggagtttcaccatgttggccaggctggtctcgaactcctgacctcaaatgatccgccctttttggcctcccaaagtgctgggattacaggcgtgacgtaccgcgcccagccaaatttctaacttgttttgttgttgttgagacagggtctcagtctgacaccaaggctggtgtgcagtactgcgatcacggctcactgcagtctcgacctcctgagctcaagtgatcgtcgacg

SEQ ID NO: 677708 - DNA, 201 bp, Homo sapiens
catgtacgtgaggtcatgataggggtcattgatggcatcactatccagctttaccagagttaaaagcagccctagtgactcaggcgcccaatacgaccaaatccgttgactccgaccttcaccttccccatggtgtctcagcgatgtggctcggctggcgacgcagaacaagatgcggctgactgtcgaacaggaagagca

SEQ ID NO: 677709 - DNA, 1122 bp, Homo sapiens
  misc_feature (286)..(286): n is a, c, g, or t
  misc_feature (454)..(454): n is a, c, g, or t
  misc_feature (457)..(457): n is a, c, g, or t
gacgagagaattagtctcgagtttgtttgcacgccagtgagtatgagatacctgacatcgccttgtcttccttcacccaagctaccgatgactgaggcatctgtctctgcagcgctcatcaagtggccacggggcagtcttctatgcaagtcgacgtcgatgcagtcatagtgtgcttgcgctgcttgcgcgtgcgttgcgttccgtatcacacggaatacatgcgttgtacctttcctgccttcgaaacgccatgctatgcaagagcgaccgtgggatgaagaanatacactgagaaagtcagcgcttaccagtgcgtatcacgtcaagcgtgcgagtcgctcgtggcacgcgtacaggaggcgtatggtgtgtcaaaagaactgtacgaatagtgcagtacacatctcgcagagcagtcgtgggaagcaggacgccggcttggtgcgcttcnatntaccatggcgtagagggagatgtcgcgcacgcccgtgtggagaaggcggcacgtacagaccggtacgttggggtgtcagaggtcaagaagtcacgggcaatccgacgtgttgggcaccatacgtacacggtgtgccccgcacgggtcccacgaaggaccctgaggacgctcactcaaacttctcggaggactccgactcctaacggggatcgcctggaagcggcaatccattcaatgctgtgcgttcatgaatgacatgcatggtaaacaacataagtgcgctacacgttgcagtgtccctttccccaagaattgtagacaccaagttgtacctttctgccccgtattgcttacttttaatcaaacctagataccgttgtccatggaaccgttgcgaaaattgtatctcaggaaacaaagagacaggcaattggccacggatgggcaagccgcatggatgcttgtattgcgccaaggaaaatccgcgaaatggagttgccacagttgcttgcccatacgcgcgaggaaccgtggtccccattgtcgtagtgcgaaaccaacacgaaattttatttcggggcaacagaaaaagttggccgagggcatggaagaggccaacgataacgaaattacggctgggcgttccgtatacctgggacaaggaa

SEQ ID NO: 677710 - DNA, 237 bp, Homo sapiens
ccagggacagtcaattagattaaaatggtaagcaatatgaaggctatcaaaggagaaagaacaggatggagataacgagcaacattcaagacctaagtcacgtaggcatcctcagtttccccaggtgcttaggtcgagtttatgccaggattgtctaattcatttccctaagttgggaataagttctggagagaagctcaaaagcgagaacctttctcccccaggcttcagagtcct

SEQ ID NO: 677711 - DNA, 125 bp, Homo sapiens
cacacttcccactcacgttccaccttcctccacctccttggtgactccaaatactcacacagtcatcacccatacccatgcacagatgtccagtcgacgcggccgcgaatttagtagtagtaggc

SEQ ID NO: 677712 - DNA, 433 bp, Homo sapiens
tatggccggggggggcctgcggtgggagtgggaatgaaggcggagggaaccatgcgaggttctgagaattgcgtttagggtcgcctagagagacggcttctgagcaggaattctgaaatcctcaccacttactcccttctggggattagatcccctatggtcaccgctaacagcattatagtgctggatgatgatgacgaacatgaaccatctgtttagccatggtctctatatccatttctggccgtcttattcaggtcgtaacctctatatatttgagcctctatttgctcctacttaatcatttatccccactcaatggaacttttgctcgttcttttcctcctgatagattatttcattttatctgtttttctattcttgctcttatacttcgtgtatccattttcttcctctctccttgtccctttct

SEQ ID NO: 677713 - DNA, 176 bp, Homo sapiens
  misc_feature (85)..(85): n is a, c, g, or t
  misc_feature (130)..(130): n is a, c, g, or t
cgggaagctttagctagcatgggcaacacagggtagatcctggcgctaaaaaaaaaaaagcttgcgcaagcttttttttttttanagatgcttacaagcgtgcatcactatgcccggctaattttttgtntttttaacagaaacgggatctcaccatgctagctaaagcttcccga

SEQ ID NO: 677714 - DNA, 775 bp, Homo sapiens
ggagctcgctgtggcccggatgtcggtgcagctgccagatccgtgatctagtgcttctcgaaaaaaaccttcaggcggcccatggtgtcgatattcaaccagcatgccttggccttcatgtgggaagaccctattatttacaactggctcaactgagaaatctatggagaactgtggggtatgcccaagagggacagaggaacgaatgcccaggaatatttggcacggcctggaaaagaatctctcgtgaattttatgaggcggctctatcgtgggattgatggcgatgcttcctctggttttacgatggtccttcatatgaatggtactcggggaaaaagagttccagcgcactttttccaacacatcactgcatatttgaatgcagcatggcagctattatcaccttacttgtgagtgatccagttggtgtgctcaatattcgtcacatgtcgagtatggatgctttctgactgttagcacgatgctttacaacccgaagtccagattacggtagcaccagtaacactgtactcatgaaagcctgtatagccattatattaccatttgtagttatctattaacgcattcctgttggaataaattgatgctggtcgaactcttttggtggaaacgattgctgtgggtaaggggaatctgattcgattaaagtttttttggggcttaacttcttccaatttaaccggccaaggcgtggggagctttaaattaggttcccattattagggactggacctgcggcagttggttggaa

SEQ ID NO: 677715 - DNA, 569 bp, Homo sapiens
tacttctacaaatgaaatctacctttgaaaagaagatgcaaaggcaacatgaactcagtgagagttgtagtgcaagtgctctacaggcaagattgaaagtagctgcacacgaagctgaggaagaatcggataatattgctgaagacttcttggagggaaaaactgaaatagatgattttctcaatagcttcaaggaaaagagaacaatttgccactgtagaagagctaaagaagagaagcttcaccaggtgatagcaatgcacagccaatttcatgctcctctctagattttcctgaaaccatgaactaccaagagagaaatgggacacaggcctaagcacattgtttctatttatgacttagggatgggcacttgaaaccatggctgaggtccagatgcgctgtagattgtctatcacctgagactgattccggtacagattagaatgactgctatatttgacaaaattctctgcactgtttgcactaaagaggtttattgttgacaagccgtgtgttaaggtcctctgttctgagtaaacatctatgcgtgtgggggggggggggga

SEQ ID NO: 677716 - DNA, 859 bp, Homo sapiens
agctgtacggcccggattacgggatcgctgctgcgcggaagacgatctccagtaccgcgcgcgtcaccgcagtctgccgtgtctcctcccacccctagtccggaccccctcgcggagggatcagctgagcggcaaacggcacggtcgggggagccccgagtccgcagctgcagctggggcctgagaccagagttggcgagggcaaggaaggagcggcccgggcagtggggcggtgcgggcgggcccgaaacagcgaattgggcgagcgctgccgaggaggagtcagaggcgctggggccaggcggagcccgacttacgggagccgagcgggccgcccggtggcggcgaaaaagaacggaagcggggccggcaggccggcgggttgcggcaagcaagggaagtgaaggccggacttcgcgggttccaagaaccgaaggcaacccggcgggggcggggggccggttggccggggtcccgggcccccgcgggcggcggtcacgccggcggcggcgggccggcaagggattgatccaagcactggttcttcgccttggaaggccaggcgggaagcaagggaggggagggaattcggcggcggggccgtggcaacccacagggacagccacgcaaggaagggcgttcggcggggcacagcttggcgggattcccggaaagggcatttaaacgaggccttgaaacccttgcccaaggacggtgttgaatatcacggttctcaagaattcagaacgaacctcccttcaatttcaaggctggtcatctgtcctgatgaggggttctaccagaagtgggaagtttggggtccgttttagggtgggccagggtttacccgatgatcccc

SEQ ID NO: 677717 - DNA, 118 bp, Homo sapiens
gacctgactgccttccgcaatcttgtcctagagcacaggccattgaggcgctgggaacagcctagtgccatcatcactatctttgctttggttacccgattaggaagggcagcattca

SEQ ID NO: 677718 - DNA, 330 bp, Homo sapiens
  misc_feature (280)..(280): n is a, c, g, or t
gaccttttggcccgcccctcccctgtcacttgttgggcatccagggccccgacctgtgcctaaccgccagggttacaaaaggcaaaacttaaacggggtttgggccacgggccaggccactgccttttgtcctcagtgaccatacctccgccaccggccgctgttggggatgccacagccttccacggttgcaaccaaacgttagcttggcatttaagttgcaaaacggcccctggccgggcttgccgtccctgtccagggccgttgtccggtgctgtgnctgtaaaagctgtaggaccctttttaataaatagagaattattaataaaa

SEQ ID NO: 677719 - DNA, 161 bp, Homo sapiens
tatactgcacaccatcatgccgcaggctgcgcttgccgaacgcagactggatttctcactttcctcgatgacgaatcttcctgatccagcagccaattcaacctcgcgcagaacaggggatcgacacctactgtcatacattacacgggggtgtacgtcgt

SEQ ID NO: 677720 - DNA, 397 bp, Homo sapiens
ccctcctgggttttagcaattctcctgcatcagacttctgagtagctgagattacaggtgcatgccaccatgcccagctaatatttgtagttttagtagagacagggtttcaccatgttggccaggctggtctcgaactgctgacctcaggtgatccgcctgcctcggcctcccaaagtgctgggattacaggcgtattccactgtgcccagcctgagtttctgtttagaaacaacagtctatgatagtataatcctctctttttttgtacacagagtaaagaggacaaataggtgaaagaataaatgaaaggctggaatcccacttcccccgctgtcccaggacataggatattgacggataggaggcagcaaaccactcacatggacactcaata

SEQ ID NO: 677721 - DNA, 367 bp, Homo sapiens
cagggagatgatctgaggtcaggagttcgagaccagcctggccaacatagtgaaaccccatctctactaaaaatacagaaattagccaggcatagtggcacacacctgtagtcccagctactcggaggcccaggtgggaggatcccttgagtctggaaggttgaaactgcagtgagccaagattgtgccactgcactccagcctgagcgacagagaaagaccccgtctcaggaaaaataaaaataaaaaagtaggccgggccccgtggctcatgcctcggcctcccaaagtgctgggattacaggcatgaaccaccgcgcccggccactagtgtctaattttcattccgctggccggggccccagaa

SEQ ID NO: 677722 - DNA, 119 bp, Homo sapiens
  misc_feature (81)..(81): n is a, c, g, or t
ctaacttgatcatcaagtcgggatgggggtggtgggagaattgtctttaaaggaaaggcagtttggctcactgagtgaatnagaagggtgaggtgtgagtaatgagagaggtcgggact

SEQ ID NO: 677723 - DNA, 944 bp, Homo sapiens
  misc_feature (307)..(307): n is a, c, g, or t
  misc_feature (800)..(800): n is a, c, g, or t
agcggagtgtggcatcgaggagaaatggagaccaaaactgtgataacctgtctcaaaagcctcctcatcatctactcactcgttttctggatcactggggtgatcctgctggtggcctcggcagtctgcggcaacaacgttactctggggcaccgtagtactcgtccctctaattgatcgagaacatcaaggaaatgtctaccgcatatgtggctcatcgtgaagtggcaacacacatatgagtaggatcattcgagtcatgacaggatgcgtgtgctagcgatagtcgtggttagaccgcaatggnatgcgtggaaaaaactagtaatgaccatggttgtctagtagctcgtggatagctccccatgcgtttgcagtcctccggtaagttgtcgggccaattgtcggaatggatatctgttggctattctgaatcgcatgtagcatcaaccaggacacaactcgttcacgtagaatgaacgtgtacacagactggatagcgccgtattgcacacggatctttgaaccataggtggccacaatgccattggaggacgagacgccccgtgtgctacgttcggcactcgaatgctagacacgacggacgatgtccttgcacgtcatgctggtagtgatgatgacaagaaacttagcaacgcaaagcatggccagaacactcacgtctggcgcgtaaacttcttgtggagagtcactgtgaacatatggcccacgcacagactagtttgggccatgcagacagaaccaactggattgtgtcaccattgccccaggggattctnacaaccaaatgctggaactagttgggccaggtcagacaagatgggtttgaaaacacaggaaagcgggtgagctaactggactcctcgcgatacaggctaagatttttctactggcacgaacattaaatgattgtgggaaattca

SEQ ID NO: 677724 - DNA, 2037 bp, Homo sapiens
agatatgctttctttttctccaaaaggggaggaaatagaaactgagtggcccacgatgtggaagaggggaaagcccagcgtgtacaggaggcctctgtggtgaaggcagaggctaacatggggttcaggagcgaacttgagccgattggcctgaacatctattgtagcagttctgtcgtcactatcatcatctgcttcaactgctcctgactgctgcacatatatacaagacgtgccgccgaccacagtccggttgatcaacaccaccacatccaccactgtggtgcatgccccttatcctcagcctccaagtgtgccgccaggtaccctggaccaagctaacagggctaccacaccatgacgcactacagacagggatgccagcagcaccctagccaatgcagtagccaccaccttacccaggccagcccatgggacccaccgggactaacacagagaacctggctggaggagaagaccgcgaccaaaagacgacagacagccagtccttaaaagccggaactacattggtctgccccgaaggcgggcctactgagaattcactggactctctggctgccactagagaatgtcgagagtgtagagtgatatggtgtgcagcgccggcacgcataagaggcccaggtgagcagagagagatacaggccaggaaacagtacgaacccaagaaaggccgacgcggagacccgacaggaaaccaggggaaacaccgacagctgacaacgatgggagacaaccagacgacgagaaggaacaaacgtgagccgcgacaggacagacgcaagaccaagcaacacaacagcgagaagaacccacaagacaacacggagccacaacaaggagacccaccagaccaacgaccgcggcaggaagcaataggaaggagagacgaagagcgagcaagtacacgttcgcgcgggtctcacgaccgagagagagggatagacagggagcggagagagagggagagagaagagaagggagaaaagagagagaggaagcgaggagagaggagaggagacgagaagaagaggagggataagaagagagagaggaagaggagagagcaacgaggagaagagaagagaacgagcgcaggcaggaggaggaggacgggagaaaggagaggatggagagacggaggagagcacgcgaaacaagagaaggaggcacagaacgaccaagaaaaggacacagacagacagcgacagaaaagagggagagtgaaacggcgcgaagggcgcaaggggcaaagagcaagacacagaaaaacacgaaacacgagacaaggcacagaacagagagacaggaaaggaaaggaaaaagaaacacggagcgcgcacgagacagagaagagcaagagaaagggcacgaagcaagggacagagagaagaacggaaagagagcaagagacggaagcaaccaggagacaggcaggaagaacaagaaacaagaaaagaaacaaagagacgaagaacaaagagaagaacgagagagaaagaaagagagaagaagcaagaaagaaaaggacagcaaacaaaagcaaaaggcacaaggacaaaagaggagaggatagaggaagcagaaagacgagacaaacaggcagcagaaaacgggagaagagagacaaaagaagaaaaacgacgaggaacgacaagaagaacagcgaaacacgagagaaagagcgacagagacagagaacagaagaagagaaagaggaggagagggacaaaacgcgagaacgacagaccggtcaacgagaagcacataggcaaggagggaagcgagagagagaggcgggaacagagagacggaggagagccaagcaaagcagagacgcaggcgagagaggaaacgcagcacagcaaaaaaaggacacacgcagagcaagcaacgaagagcgagagacagcacagagaaagagccgtcaaccgcgacgcaacagagggaagaaacaggacagcgaagacgcaaacaacgaagcacgagccgaccacagcgccaagacgccgagcg

SEQ ID NO: 677725 - DNA, 185 bp, Homo sapiens
  misc_feature (99)..(99): n is a, c, g, or t
tgaaggaaatgactaccttgcactacatgaaaaggatatcgttgccattgtggcgtaattttcgtgccgagtgaatgtggcgcaaacaactatatatcnaaaccgtatatttaaaatgaattactagagagggaatgtaatcatggcaaaagaaattaagttttaagaagatgctagtgctaagc

SEQ ID NO: 677726 - DNA, 318 bp, Homo sapiens
atgtgctaatctttagtacacctctggaataaaccatagtacttacactgttaaaaaataagaccttttctgtcacaaatggacggtgatacattatacaggactattatgtatgatcactcagtttcaaaccattggggcttacgaacacacagtaaataccttgcactaatccgaactattaatatagtcaaaatgtacttatataattgcttgctttatgtctggctcacgcgatggagataaccttcttgacagcaggactgtgtgtgtgctattcgtcccatattgccagagcctacacatgcgcctgccaca

SEQ ID NO: 677727 - DNA, 666 bp, Homo sapiens
agcctgtgggccaggtgttgctctcaggtccgtggatatagcaccgattgaaacacagcgcctctccgtgatgggtacagagattagtcgctattcctggagcgcgaaggttcgtctctcgagtcagagtagtcagtggggatcgattcctcaaagggcaagttatgcgtatataaagtgacagttcatcaaagatagtgagttccttctgcataagtcgcgcgcacgttaatggtagatcgtactatagtcattatatcatagttaccgtgtgtgactacgttataaccgatggtggaagtttgtgtgcagcatacagcaaggtactctgagggcactatctgggtcagtaaatgagatctgcccggagtgttaggcatggtgactgagagcaccagtgaaatatggggcagatagcgtgtgaggatcaggtagggtgtctcagacatacgcaaacccctctggcagggtcccacgtggtaaacaggctagtggcaaagttagtgttagggcacaatacagcagcagccgtaaagacagcagtctgatgcttgagaggtaggcatgggttcaatggcgcaggcattgcagaatgcagcggcccaggcagctggggcaggagcacgggtaccgtcacgccgatagactctgcggtgagtgttacgc

SEQ ID NO: 677728 - DNA, 636 bp, Homo sapiens
gtttgaaagtatgtagccaggcatggtagctcatgcctgtaatcccggcagttgggcaggccaaggcgtttgagcttgaccttgcaactgtgagctcaggagtttgagaccagccttggcaacatggagcaacatccatctgtacaaaaaaatacaaaaattcaattggcatgtgttggcatacacctgtagtctcagctattcaggcaggctgaggtggggaagatggcttgaacctgggaggcggaatttgcagtgagctgagatcacgccattgcactccagcctggacaacaaagccagaccctgtctcaaaaaatacaataaataaataaaacttaccatatcaaataaataaagtatatgacgcctctccccattctcttgctcctctcaccattatgacatgtctgctcccacttcactaccatcatgattgtgagcttcctgaggccctcacagaagctgagcagatgctggcaacacgctttctgtatagccggcagaaccatgagcccaattaaagcttcttttctcgaaagaacaaaaaaatcaaaacacaaaaaaaacaccattgttgaggaccgacttacaccctcagaaaaactttcaagacacacattagtgagggaacga

SEQ ID NO: 677729 - DNA, 747 bp, Homo sapiens
cgcccagtggtaggctgtcctgcccaatcatccaggccgtgctgctgcccaagaagatcagcgccaccgtgtgggcctgaaggcgccctcgggcggcaatgaaggcacccaggtctcccaggagtactaagagggcccgcgccgcggccggccggcaggcctcccctatgctcgaccgacaaaggcccattttaatggggcaccgacgcgccctcgatggtaaagagtcgtgagcctgctttcgagcactgctggtggcaagacgggctcagcggcatcctctttctcacatcatgcatgccatgataagggactgccggtatggcccttctatgaatgcaaccgtatgacgaccacagggagagcacagaaggacggactctggttgttatatccttctgtggccccgcgaggtctgcagcccccttaacgagcaaacatgactttagtgccagtctccaaggtacgtccatcaagacagaacgctgcacagggactcagagcatgcaattgcagagcaaaactgcatacgaaggacggtcaatggacacgcgtgcgacccctggcaggagcaagcctgggcgggcacgtgcccgtcgatcttcccctgtgagggtgcaacgcccttttgttgcagcgcccgtatcttgtgccgcccatgccctggcaggcattctgggcatgcccccacagcctggcccattggggcggttgccagggctggcccgcttccttgccatgaccggg

SEQ ID NO: 677730 - DNA, 129 bp, Homo sapiens
tatgagtacaaatcccccttcacactctgctctatagtataacgtgtacctatcctaactacccttatggagtcaagaggactaagcagacttcctgttatatagattatatttagtagacaagttcga

SEQ ID NO: 677731 - DNA, 150 bp, Homo sapiens
aatgcagcaggaggcgggacccgggcaaggtgcagcaccaagcaggcccacgtggttcttcaacgtcttttcatgtttgacaagccagatcaggagtcaaagaggcttcagctgtatcgccagatcgtgatggcatcatctgcaggcaga

SEQ ID NO: 677732 - DNA, 115 bp, Homo sapiens
catttcatgtcctgaggtctaagagcccaatgaatcaggattgtgattccaatagaaaggaggtcagcatatggaccgtgcaccccgcatgtttatcaccagcgccactcacata

SEQ ID NO: 677733 - DNA, 826 bp, Homo sapiens
gacgccgagaccggtcgcccggagcacagagcctcgctttgccgatccgcgccgtccaacccgccgccagtcaccatggatgatgatatcgccgcgctcgtcgtcgacaacggctccggcatgtgcaaggccggcttcgcgggcgacgatgccccccgggccgtcttcccctccatcgtgggcgccccaggcaccaggccgtgattggtgggcatgggtcagaaggattcctatgtgggcgacgaggcccaggagcaaagagaggcaatcctcacccttgaaagtaccccaatcgagcacggattccgtcaccaaagtgggacgacctggaggaaaatttgtggcaccacacctttctacaatgaggctgcgtgtggctccgaggagcacccggtgttggatgacctgagggccccttggaacccaagggccaacggcgagaaggattgaccaaatcatgtttgagaccttaaaaaaccccaagcaatgtacgtggctatccaggggtgtgttatccttgtacgcctcgtggcaggaaccactggcatcgtgaagggctccggtgagggttcacccaaacttgtgccatctacgagggggtatccctccccaaggcattctggttggacttggtggcggactggtgagcactcaggaaatctcaccgaagcgggaaagtcacaccggcgcgggcgaaccggcgggaataggaagcgtggaggcccccgcatcagcaagaaggcggcggtcaacccccgagagacaaactcagagataccagggcgcggccggccgcagcaccacccgcggtcggccccccacaagg

SEQ ID NO: 677734 - DNA, 199 bp, Homo sapiens
tttggtggcggtgtcgtttcctgggaagtttgctgctgcggcgggaacccccaaagacacacgtagaccatcaccccgtctcgtgacatgaggccaccctgaggtgctgagcctgggcttctaccctgcggaaatcacactgacctggcagcgggatggcgaggaccaaactcaggacactgaccttgtggagaccaga

SEQ ID NO: 677735 - DNA, 187 bp, Homo sapiens
  misc_feature (57)..(57): n is a, c, g, or t
ttattacttaataagatgcaatgaaataacctgtatggcaaggattgcattacctantaaaataggccaaacccaaattgatggacagcatacagtttaacattgcctctaatctttttttttttttttaaaaaggggctatcgcaattattttacccttatgtgggggaaattttgatcatattga

SEQ ID NO: 677736 - DNA, 361 bp, Homo sapiens
taatcagaggctactactttagatgaggcaaaggaaataagcgccttgagccagtttatggtgcagcccactccagaagccatgctacgtcgggcaaagccaatggccagtgatgagcagactcccttggtgaactgtcatactccccacagcaatgtcatcttacatagtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatggtgaggactggtaatgattttaaggcaatttgtctccttactcaattgtaa

SEQ ID NO: 677737 - DNA, 150 bp, Homo sapiens
gctcgtaccagatatgcagagaaccctagtgtcctgccacaacctggccttgtatcactgtacattttttcataacattttgaacaaggtttatattgactcaagtttaaaagcgaaaaagtgcgactgaaaaatttttacagatgtcta

SEQ ID NO: 677738 - DNA, 445 bp, Homo sapiens
ttaacccagtgcctgtgtgtagtaaagagaacgatatcaagatgcctgactttagaatgtaaacgtgtctggtgttttctctgtgtgtgtgtgtatgtgtttataaagagaacaatatcaaggccttctcaatacaaaagcatccccctggcaattacattcctgtgttaggataagtaagggaagcagacctgccagtgtttgctttggggcttaccacaagataccatccagtccctgtttgaaaatcatgttcatctgccccaactagcttgacagttaccagaattctccatgtacattgtgtttatacaaacatcatttttctctttctaatcagaagtctaatttcaatgaagcaaaatggcttttaaagattttgtgtttctgactcaaaccagttctcatatagtcctgagacatgaactggcttactctgattatc

SEQ ID NO: 677739 - DNA, 347 bp, Homo sapiens
  misc_feature (167)..(169): n is a, c, g, or t
acgctggttactagtgaattaaaacattttggctgtgtatcagttgataaaactgctttgagatctgtaatcattgggatagtctaatctttaagtacaatggagacagataattaaaacattttgctgtgtatcagttgataaactgctttgagatctgacacatnnnccattgtccttaaagattagactatctcaatgattgtttcctttgtgaatgggaaatattgctggcacataaactagtgatgaaaggcctaaaaatgtcctgttttgtttttcatctttaaagctcctccttcctatgtcctaactgggaagtactcttactaactagatatcaaggt

SEQ ID NO: 677740 - DNA, 148 bp, Homo sapiens
tccaatctcaagccatttttatttgccatttccagggaatgtgaaatgggactaatttacctctgattcttctttatactgaggatataaattttggtctagctttagggtagagctcctgtgtgatgctctatcttggaaaacctag

SEQ ID NO: 677741 - DNA, 169 bp, Homo sapiens
gctactacagtacgccatattggtagcagccaggctctcttatcacgcatctagcagtcacgagtcatggcaatgaccattagaataaattcgagtcataaaccgtatcttacacatacgtctatctataaattactgttgcaactatggaagacccaagtagtgttgc

SEQ ID NO: 677742 - DNA, 174 bp, Homo sapiens
tcatactacttcttgagatcttgatggacgaagttgtgcgcaacaacttcgtccatcgagacttttctgcgagtttggatcttcggcgtgtgcagtatggttattcggcgtgtgcaacacgccgaagctccaaacgactcgagctccgaggattccgacgctgaaacagatgga

SEQ ID NO: 677743 - DNA, 353 bp, Homo sapiens
gaaccttccacattttaatttaagatttgcaggctttcaatggaacctccaccacagtagcaagctgcaagctgcacataaagctattacagaagagattgcttttaagaaacaaattggcaggcgatggctatgtacttaaggtatctttggcttaggaagacgagaatatcgattataggccaaacaatccccacaatgcaaattgccatttggattctgcccgatttcttttcgttgaggtattggcctaggaatgctcgactgggcctggaagcttgggggctttagatggaggctggatgatattccctagccgtaaattcgagcttaagagtccataaaccgtatga

SEQ ID NO: 677744 - DNA, 237 bp, Homo sapiens
accccgcgactagcccgacaggtaagaggaagaaccactgcgatgatgagcactggcaacagagagccgggggtagcccccgtggattatggtctgactcaggacgaagctgtgccccgatacccagggcaatcagtcccattgcacaggcgcaaaaggccagcaggaggacgtaaagcgagaacttcacacattgcattcgtccttccaccgacatggctgtcgggcgagtcgggg

SEQ ID NO: 677745 - DNA, 225 bp, Homo sapiens
gttattatacctctcaacgcttctacttcgtaacgcttatacttctcaacgctttatacctctcaacgctttatacttctcaacgctttatacttcctcaacgctttatacttcctcaacgctttatacttcctcatctgcctccttcggccttcttcctcttctcctttgatttttgggcgatactcagagcagaagaggaagaagatgaggaagtataaagcg

SEQ ID NO: 677746 - DNA, 438 bp, Homo sapiens
ttacggtatctctgaatcacaggcctcttctgattctgctgctaccttcgaggtgctgagacagtgccccactgcagaatacacctgaagcatgagcatacagcatataatatgccatcattgatatcctccactccttccatgtccagccactacatcattgtcgttagcagctagatcctgtgaatatctcaaaaaacaccaaaacaaattttgtttccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccactccttagcac

SEQ ID NO: 677747 - DNA, 294 bp, Homo sapiens
cgagagaccgcccgtccccccctctctttaggcgccgcacgagctcggacgcccccgggccctctcctcctcatccctttctcgtgtcctcatcggcacgtggctggctggcttgtgtccaccaaccccacttctgttacacattctcctctgcagaccacaggagagacaggttaggccaccacgggcgatctctgtgaaaggggggatatggggcccgagagaggactttttgccagggtttttcgttaaacgcaccttgattctttattttcacattatcaataaacaaaa

SEQ ID NO: 677748 - DNA, 176 bp, Homo sapiens
  misc_feature (33)..(33): n is a, c, g, or t
  misc_feature (166)..(166): n is a, c, g, or t
tgggaaacgggtctgggggacagggaggctgtncgcgccgggccctgcgcgaggagaaggctcgggggacacagctgccaggagcactccaagttctggtttcctctggaagagcgattagggcgtcctgcaccgggtccttttcaccagacaccttccaagtccntttagacaag

SEQ ID NO: 677749 - DNA, 120 bp, Homo sapiens
taacgggaaaaggaaagattctaacatactggcacttaggatagacggaaaggacctcctgtactcctggtaaacccccatactttccaagtcagattgtcttctctgctggatatctga

SEQ ID NO: 677750 - DNA, 126 bp, Homo sapiens
tgagggggcaggacagcaaagccagtagtcatggtgcatatcgcagattaaacttactccatttcttctgcctgcatttcctcatctcggagaataaaaatcattctacctgccggatgaacctct

SEQ ID NO: 677751 - DNA, 960 bp, Homo sapiens
  misc_feature (493)..(493): n is a, c, g, or t
cgtagatcgtacacactgcacaaaaagatagcaggagaatctactctaacagctaaggcaacagaagccacacaaatggccatttgcaatcatttctcttttgattccatagtttaacacgctcaactttgtgatactctcctcagaaaatgaatgcaactaaagctgtctttccacacaacagccctagcaccctcactgcttcctttcatataaagcacgtgcctttaggagtaaagcacatgaatgggccctgctgcagcaggatttggggagagccactcaaactctgcacctctgcttcccttccccagctgccctgttatccaaactgctgaaaagtctctacaaccctgcacgtagctcatggtgttacgaagcagatgttttgcacttgtcaccacagcttcatatggctgcaaaggttcattaaaagcttgttcagaagcccaagtctatcaggtgacaggtgtctactgccttaatgaagaanggcataaagctgctgctaacaccagtggcagtgacctccaactgagggctttaccatgcaccaaagcttatgctggcctagagccaattctggttttagccacctattcagagacctctcctcagactaatttgcccccatcccactgttcttaatcatgttccctgactcattttcctcattacctataacaacctgatataattttgtttcctgtgaactgtatgcccacctctctagaatggaacagccaccagagtggaaccttcacgtatcttgctcaacactgtgtcctcagcagctaaaacagtgtctagcacagagaaggtccctcaagaaacacatgctaaaccaaaagaatgaatgcactgcaacaatcagtaaaggaacgctatacccctaagaaactgaggcaaaggatttaatctgcgtgaggcagcaccgaaatgccagaatcctctagcgtc

SEQ ID NO: 677752 - DNA, 207 bp, Homo sapiens
  misc_feature (21)..(21): n is a, c, g, or t
  misc_feature (40)..(40): n is a, c, g, or t
  misc_feature (58)..(58): n is a, c, g, or t
  misc_feature (77)..(77): n is a, c, g, or t
  misc_feature (83)..(83): n is a, c, g, or t
cccagaggttgcgagggagantttgttgctagatcatagngatgcgtgatatatgttngcaggaggatgcccgatgngcttgntgccatctagcattttccatgcctgagagatgaggatagatccccgaagatctagatctccatatataaaataatcatatatcatatatcatatatcatatatcatatatatatatatccccta

SEQ ID NO: 677753 - DNA, 340 bp, Homo sapiens
  misc_feature (211)..(211): n is a, c, g, or t
gcaggagaatcgcttgaacccaggaggtggaggttgcagtgagatgagattgcaccattgaattccaccttgaacaacaacagctaacctccatctcaaaaacaaaacaaaacagacctctatcattccttataactgctacaaaatatgccacagaatatatcgttagggctgggcacggtggctcacgcctgtaatcacaacaccttgngaggccgaggcaagcagatcatttgaggtcaggagctcgagaccagcctggccaacgtagtgaaaccctgtcctactgaaaatacaaaaattagcctagtatggaggcaggcgcctataatctcagcta

SEQ ID NO: 677754 - DNA, 467 bp, Homo sapiens
  misc_feature (1)..(1): n is a, c, g, or t
  misc_feature (19)..(19): n is a, c, g, or t
  misc_feature (236)..(236): n is a, c, g, or t
ntcggaccatcattaaaanttacaaactttaggtgatgccacggtggcctcacgtctgtaatcccccagcattttgggaggtcaaggagggaggatcaccttaagccccgggagtttgagacccagcctcaacaacacagaaagaccccgtctctacaaaaatttaaaaattagctggctgtggtggtgcacacctgtggtcccagttactcaggaggctgaacccaggaagattngctaagccccggaggtagaggctgcagtaggccatgattacgccattgcactccatcatgggtaacagagcgagactctattaaaaaacaacaacaacaacaacaactttgtacatgaaaggacaccatcgagagaatgaaaagacaactcacagaatgggggaaaatatctgcatatcatatatttgataagggttcaatatccagaatatataaaactcttaccactca

SEQ ID NO: 677755 - DNA, 746 bp, Homo sapiens
cggggggagtgggagagaaaagatgcgtgtgtcgatagtctcgtaatttgtcccatgtgggaagacgacttgtagtgtccctcatcgggttgcatgcacaaagcaaggtggtcgtcttctacggggtagaggtgtgctcgtcgtggagatgtatatttctccctcgtcgtaggaatacagtctctgcgacccgtcgaggatgtgcgttcgccagcaggatataatgatgagagcccccccctgccgcggagccccgtctcttgttataaagaatttataattctgctccgttgggtaacacccaagaggggagatttgttcacacggcaccaaattggagtacaccatcataggggagatgattataggggccatcgtattgttccctgccggctacaacttcaccgcgccgctccaccacagtggggctattttcctagcgccccacagatatgcccccccctctccagaggagatttttgtggggcccacacactgggggccctcaacgcacacaggggttgctgggcacacacacaggccacacgtgtgtctgagagataatagtgtcggccgcgtggcacgctttctttgtagcgaacaatatattgggcccaagcagttttgttggggggggcatagtcttagacacgtcacgccccccacgatggcccacacattcttaaggaaggttagaaaccccactgagcctttcttgatataaactgcccaccaatgatacgcaa

SEQ ID NO: 677756 - DNA, 519 bp, Homo sapiens
  misc_feature (8)..(8): n is a, c, g, or t
tccccganagtgccaaggtccagtgagggaagccgagctgtccctcccagcgtcagaggaggacgccccatagggtgttgttttccccagacccctttgattggatggatgataagtatccaagggtaggagaaaaataggatcccctgagcaagtttcctcaccctagcttgtccattcccatttatatttagacaagaagtatagcacctaggtaacaggccggctatgtgttaaatgcttagtgaatgatagtgtattactttttattatgctgataatgagtgaaaaggaaggaagtggggaagtgattcacctcactggaatgacccgttgcagtctgcctttccttctggagagaagtagatgaaaacaccccagagccactgcctgtcatgcccagacacagcgtggtcatggctggtctgaaacaccaatgtaatttataatgtgatggttctagtaccttgataatttattttgtatacattctttaaagatagctatgattagtgaaaa

SEQ ID NO: 677757 - DNA, 492 bp, Homo sapiens
  misc_feature (2)..(4): n is a, c, g, or t
  misc_feature (7)..(7): n is a, c, g, or t
  misc_feature (14)..(14): n is a, c, g, or t
  misc_feature (215)..(215): n is a, c, g, or t
  misc_feature (431)..(431): n is a, c, g, or t
  misc_feature (437)..(437): n is a, c, g, or t
  misc_feature (469)..(469): n is a, c, g, or t
  misc_feature (480)..(480): n is a, c, g, or t
tnnncangctgagnaatgaggcgtcggatgttattacccaagacaacagggtaaaatgtctccaggtcatgtcagaggttttcacggcagcccctcccatcacaggcccagaggcctaggaggaaaaagcagtttcatgggctgggcccagggtccccatgctgtgtgcagcctagggacttggtgccctgaggcccagctgctccagccatggntaaaaggggccaacacagagctcaggccgtggcttcagagggtgcaagcctcaagctttggcagcttccacgtggtgttgagtctgtgagtacacagatgtcaagaattgaggtttgggaacctccacctagatttcagaagatgtatggaaatgcctggatgtccaagcagaggtcttctgcaagggcagggttctttgtggagaacccttctgntagtgnagaagggaaatgtgggattgggggtcccacanaagagtccctncttgggaaattg

SEQ ID NO: 677758 - DNA, 420 bp, Homo sapiens
ggctttgggcaagtcacctaagctcaacaaagccccattgtcttatctgtaaaagtgggagtactattacctatctcataggatgaggattgggtgagttatatgaaaagcacttagaggctggacgcgttggctcacgcctgtaatctcagcactttgggaggctgaggcaggcagatcacttgaggtcaggagttcgagaccagcctgaccaatgtggtgaaaccctgtctctactaaaaatacaaaaattagccgggtatggtggcacacgcctgtaatcccagctactcgggaggctgaggcaggagaatcacttgaacccgggaggtggaggttgcagtgagctgagatcatgccattgcactccagcctaggcaacaagagtgaaactccatctcaacaaaaaaagggcggccg

SEQ ID NO: 677759 - DNA, 1645 bp, Homo sapiens
gcctgcgcctgcgcggagctggatgtctggctgggccgctgccgctgggagaccgtgcggttgccgtggggaccggtcgggcccctccctcctccggtcccccggcccatggtccttccccaccgagactgcgccggcggaccgcgtggcgagtgcagccggtgaccctggcagagaggcggcgccggtcccaagatgtcgctagacggccatgtccgaaacctacgatttctttgtttaagttcttggcttattggaaatgcagggaactggcaaacatcttgcttacttcatcagatatattgaaaaaaaattcaaagatgactcaaatcatacaataggagtggaattaggtacaaagataataaatgtgcgtggtaaatatgtaaagttacaaatatgggatacaggaatggacaagaaagatacagagtccgtgacgagaaagttataaccggaggccggcggcagggagctcctcctcgtactattgatatcaccagtccgagacacctacaatgccgcttactaataggattcacagactgcccgaatgctagcgagcagaagcatgtgatcatcctagtggaaaaagaaggaacctggaagcagatcgacgaagataaccaacatagaaggcaccaaaaatgctccagaacacgagcggcagtacggcaacaagggccccaccggggcacacctacacagcgcagagaccggggccgccacagacgacacgaaccgagacggccccaaaaaggcaggaaagagggaacgtcgtaaagcagtggtctcagcgacgaagcaaacaaaagagatgagaagcgaccagtacggaccgcacacgcgacggcaccagtactgtcatcagcctaacgaatgtaagcaagaagcgaacatctcctgtgtggccggggcgacaaggggagaaggcgaaagaagcagcgaaaaaccacagagaacatcgagaaaagacaaggaaagaggagaaaacaaaacaggagagaacagaaaagaagaagggcgaagagccggcacggcagaaacgagacacaagggaaagtaaagcaggaggaaggaagagggagaaaaagaaaagagaaagagggagaaaagccacagaaaaagaagagaccacagagagaacaagagacaaaaggaggaccgagagaaaggacagaggacacggaagaagacgaaaagaaaaaagacggacagaaagagaaccaaaaacaaccagagagaagaaagacagaaaagagaaaggagaaaggagacgacagcaaagagaagcagccaagagaaaaaatagaaggaacaaagagaagagaaggagacagaaacagacaaacaagcacagaaccgaagaacgacgatagagacaaagacaacgagaagagaagaagaaaacaagcagagacgacagagacaggaaaagacgagggaaaggaagagaaagagcaagagagagagcagcgtgaggaggagaacgatcaagacagaggagacagaggaccagacagcaagaagcaagaaaaccgaaaacgaaacgaaagaagagaagaagaagcagacggacagaagacgacaagcaaacaccagaagaaagaaagagaaaggagacacacaacacgaagacgaagag

SEQ ID NO: 677760 - DNA, 493 bp, Homo sapiens
ggtgctgtctagaggtccccgccagaaggtggtgccaggtgaaaggatctctaccgacgaaagacggtaaaacattgatgcagaaaatcgaagaagacacacagaaaaggaaaagttacgtctgtgttcatggatgggaagaatcaatattaaaatgtctgtactacccaaagcaatctacaggttcaaggtaatccctatcaaaataccaatgacattcttcacagaaatagaaaaaaaaatcctgaaattggtatggaatcacaagagacagaatagccaaagccatcctgagcaaaaaacaaaactggagaaatggcattatctgacttaaaattatactacagtcacttcctggtctttttgggcttagatcaagtgcaaagtttactagaaaggtataccaaaacagcatggtactggtataaaaacagacacctagaccaagggaacagaatagagaacccagaaacagatctatacatctacagtg

SEQ ID NO: 677761 - DNA, 129 bp, Homo sapiens
aggagaccaggctgagtggggagggtcagccaggttcaagcccagcttcttgccccttttcctcttttttttgtttgagacagagtctctctctgtcacccaggctggagtgcagtggcgcgatctcgg

SEQ ID NO: 677762 - DNA, 603 bp, Homo sapiens
cccccacccgccctcattttgggggaaaaaaaaaaaaaaacggggtgtcccgcccctttttgggcaaccgcccgcccgaaaaataataacccccccttcccccaaatagttatatgtgtggggagggaatttttcaaaaaaaaatttttttaaatccccttaaacaagccaaattccaaaaaaaaaacccccaccgcaccctttatttccccttgaaataaaatcttgggcaaattttcacacccaaaggttcaaagaatcccacccccatccagggtgcccagccaatcccattgttttttaacccgtatagggccctttatagtacacactttgggttttcaaagagacccccgtttaacctccagaccagacggattttttttgggcgcggtcccttcaaaagtggcaaagatctgggcccccggtcttaaatccctttcttggggaaaaagcccccccggcccctcaggatgaaaattccccccaagggattctccagctgtcccagaatttccccaattttccacctgggagaaattctttacaacacacactctgaaattcttaaattgtgcaaaacgcttattttctccccgggcc

SEQ ID NO: 677763 - DNA, 1025 bp, Homo sapiens
agcaaaagacaaaataggctaggaggaggcccgctggttaatgcaggcagaggctttccaatgggagttgttgtgtgatcgccatctatagtggaaaagatgtactcgtcctgtggcgcacctggcagcgggctgaaccccttcaacacgccacatctgcagctggtgcacgatggtctcgtgtggacctccgcagcagctccccagtggcccacgtggccaggcccctgcccgacctcgcaaccctggacagcctgccgcctgtggaacgagtaacagtttgtgaatatttgcgctacctgcgaagtattattgcacttgtgttggctatatgtgttgtggtgtcttaagtttgttggtactatgacacacacttgctagtgtgttcccctggaatatttatgtgaaattgcctgtcattgcagtgtgtgagcccccaaatatgtacaatggtgcactatattaacctgtgatatcatacatgtttacaacatataaaagatggatagcgtagttctgttgcgtctctgtggctaccctgtgatgtgtgctcacagacctttaccctatgtgacataactccacattgcaaggggacctcttgcacacggtttcatggcctacctactagcacagcatccttctcacacaggtcctctgtaactagacccaattactggccatgcgccgacgggaggacatacttacttctactttagccggccaccataccactaattattctgggctatggcctacctggccagttgcattgacatttcttttatgcgtggacatttgccacctggattccctaattggcagcatgactaaagggatcccgagaatacacaaaccccaggcgcacgggtactgaccaacaactcttgacgggaatgcacgctcccccccattgtctcacgggcgacacggcctaaacagccttactaacggtgggtgcgtcccccttgattacgcagataccctcaacaatagcggtaggctggtgacagtatggtaatcat

SEQ ID NO: 677764 - DNA, 435 bp, Homo sapiens
tgtgtaaagaaataagagacaaaaatataaaacaaaaaatctgacaagcaatttaaatatccacgccaatcttccggagatgaaatgcatcatggctggcctgtggaccttagcagacagatctgacggccgatcacacacggcagagaacgccaagctggagacactgcaaatagcatccaaacctgagaggcgggaccctggcagcagccgataagaaacaagggggcttggactgagttccaagaagagaacagaggaaggggagaaacagtgtttgaagaggctctggtggctgaggaatttctaaagccagcaagaccccaaagcccaagaagtgccaggcaggtaaacactcacccggccaacaggcaggtaaacaaacactcatctggccgactcccggccaaaccagagtgaaaccgcagaacccca

SEQ ID NO: 677765 - DNA, 942 bp, Homo sapiens
  misc_feature (286)..(286): n is a, c, g, or t
agcgggttcccgctagttcccacatgcgacaaagtggggcctggagatggggctgtcttttttctccaaacacgtgccccatccaggaaggccagcgcgtgggtgcattgaagactccaggctgagcatcatctctaccggttggaggttcagcacacagcgggagagctgcgtggccgacaggttgataagggcgggcgggtcgctcatcttccagcgggaatcagagagtgtaaaaatgcagcccacacagtcccagggctgaagatacgactgctgtatcgangcatcgttgtcctcgagctcgacggagtccggagtttagagctactgctcaaaggatgcctgcgatgcatagaaggatcaatgatcgtcgggatcaagtggctcccacagcatgaacgccgaccactcactccgtgtccaccgaagcggatacaaacgtatcaaagtaactggaagattaccgaacgacgataccaaggcccgaaggagtacaacctgagggagtgaagaggggaaactgagcggaccgtgtccacggtgacgtcagctgcgaggtgccagtgctgaacgcccagggatctgatggtggaaggtgagccctcggaggatctttgccagtgggcacaactaccacatcaactccatctccgtcaacagtgactgcgagacctactatgtcggcggatgacctgcgcatcaagctctgggcagctggtcatcaccgaactaggagcttcaacatcgtggacatcaagcctggccaagaatggagggaccttagggagcgtgatcaccaggtatctgaggtttccatgccggaaccactggaaccctcttggtgtacacgcagccagcaggggcccctgggggtctgggacatgtgggcaggctgcctgtgtgacacggcttccagggctttgagagctgtggagcccg

SEQ ID NO: 677766 - DNA, 951 bp, Homo sapiens
cccggtgcgcccgagtgcactgaagatggggtgtgtaggacggttgctcggagcgtcgttgcccgaatgtgagtgcatccttgggcattctgccatgagccctcaggctgtgatgtgaagacgagttgaaaatttatgtgtgttctgtccagtcaagcaaacatttattccagcaccagttcctcatgcatgaccttgttgtcaccaagtaatgaccctatttaaggggtacagccgtgtgtcagtggagagttacaaagaccttaagctttgatggacttcaaggggaaatatggggggctttctctatccttggggaattccaccttttgtgtgtcctacaagaaattgtggttgtttttaggttgacaaaggctaacagcgatattccacgatgtgaccgtggtggaagtttggtccgcaggtctcaggtggattccccaaattttacgccattctttgcctggaattaagttacaccaagaaaaagaagtggtggcttgtgcggccacattgaacattcggcactctttgtacaagacttaactaagcaagatttccccgagactacggtggtgctgcaaaagggttctggtcttgcacaaagaggtctcttcataaatttgccccaagtgggcgtcatcaagccatgtgaggcgaaaagactccccggttgggcggagcgtggaaaaacctcccgttgtgagggaggtgtccattttttcacccttggaagtctgccccgcgactggagaccgattctctaaagacaaggcaatccaggtggtccaaaaaggagcttagagggaaacgtgaggccccgttttttgcctctcctcgggagaagcagcgggacccggtcactcaacggtgcttgtagggggcctcgttctagatcacctggtgcgtgtggggaccacacgtggggaacaacttctatggtggggcaca

SEQ ID NO: 677767 - DNA, 540 bp, Homo sapiens
  misc_feature (17)..(17): n is a, c, g, or t
  misc_feature (22)..(22): n is a, c, g, or t
ggttcttgcttacaaanaatcntacattgccactgaaacatcaatgttttactggctctgccccttagtggtcctggtgaccctacctcaacaatgcatttgggcaaagatcttactggctgggtggtacaaagccaaatcagtaaaattgtcatcttggtattgtcctgaaaatagtcccgaagaatccaatgccggtaaagtactgtaatagtgatgtcaccccttgtgagctcccagtactagtgattgggtctgcattcccagtgaccaaaatcagctatgtggccaggtaattcactgctgagggctttggattttcctttatgaactactgaaatgaggtcaacttgactattactaagggacattttgctacaaagaatgttagttttgccaattccctttccaaatctaaaatttattttaaccaggattttagatgtaaacatcaagtagttttggttgtttcaatgaagtaacatgtttaagctcacattatttgaagtacttcagttcctattgccatgaaaattgtat

SEQ ID NO: 677768 - DNA, 639 bp, Homo sapiens
  misc_feature (43)..(43): n is a, c, g, or t
  misc_feature (112)..(112): n is a, c, g, or t
  misc_feature (197)..(197): n is a, c, g, or t
  misc_feature (199)..(199): n is a, c, g, or t
  misc_feature (224)..(224): n is a, c, g, or t
  misc_feature (241)..(241): n is a, c, g, or t
  misc_feature (331)..(331): n is a, c, g, or t
  misc_feature (387)..(387): n is a, c, g, or t
  misc_feature (454)..(454): n is a, c, g, or t
  misc_feature (530)..(530): n is a, c, g, or t
  misc_feature (536)..(536): n is a, c, g, or t
  misc_feature (553)..(553): n is a, c, g, or t
  misc_feature (560)..(560): n is a, c, g, or t
  misc_feature (565)..(565): n is a, c, g, or t
  misc_feature (616)..(616): n is a, c, g, or t
ttcagtgtaaaatttcaaatcttccaaaggatggagtcattcngggaggatgaataaggataaacaacaaaaggtggcccaaaaaaccacaccagaaaccctgtattccccngggtagagccgaacaaggttgggaaagccccaacaggtaggcagtagccattggctttttaacaaatgggcaacaaccctcccancncaacatgtcagaacaaaggccagcnagtcagcaacatgtacnaaaaaccaaagcaaaaaaccaaaaaacaacaacaatataacaaaaacccccaacccaaaaaacaaccaaccctaaaaaaatcaaaactcnaaggtgattaaaaagtagaaacccatcccaaggccacaggcaagcaaaaggaaaanaccaaggcaaaggaaaaaaaaattgtgggtataacactcagtatgtaaatccctggacctcacaganagacactaatcattaatcagaccatcagtcatgtcacaagagaaccaataccaacattcctcccgtcgagcacagncataangagattttttatttatntgtttantatanaaaggggtgggtagagaggagaggaggcagggaggtgaatgtattatgtanaaagagaaatgagagagagcatc

SEQ ID NO: 677769 - DNA, 229 bp, Homo sapiens
  misc_feature (33)..(33): n is a, c, g, or t
  misc_feature (42)..(42): n is a, c, g, or t
tgcactccttcccatctgcaagtagctagtgcngtagtgcantttcccattatatcactccactagtagtctgacctctcctgtcagagtgctccaggctaccacatagcctttctttccataacatacagctaagatgtttatttccccattgtgcctatgctatggtctgaatgtttgtgtcccttcaaaattcatatgttaaaatcttaacctgccaaggtgatgc

SEQ ID NO: 677770 - DNA, 2043 bp, Homo sapiens
  misc_feature (1756)..(1756): n is a, c, g, or t
  misc_feature (1884)..(1884): n is a, c, g, or t
tggtttcgtacgtcgggtgcgtggtctgggttctgggcgtccttgcgctaggctggcttggtgggagtggcctgagctattgttgtggtgcgtggcttggattgtatttggggtgcttgtgtgctgcgcgcgcctcttcgtgtgggccgttggcgtgtgcgggtggtggtggtggtggtatgtcaccactctgtgtgtggtgcgttgcctgcttgcgctggtgtgttgtatcttcgtcctcatcttctgtgtggggtggggtgtagcacctactcttggcgtgcttgggtgcttctgtcatgctcgtgcacctcttgtggattgttggttcgcggtggtttgttttttgtttgttgcggcctctgcgtgtttttgtggtgggtggacggttgtctgtccctcgtcgtcttgtcgttgttgtgtgtgggtctgtgtgtggggtctatttttctctctgtggtgtgttggttggtggtttcctctctctcactgtggttgggtgggggggccgtctggtggtgtcgtgcgatgctaggcggtggtgttggtggtgtcgtgtggtggttgtggtggttgggtcgtgctgtggtgttctcggtggccgtgagtggtgggttggtgggggtggcgtccggggtgatgtgtgggtggcgtgttggggtgtcgtgttttttgtacgttgtggttgttgtgtcctagcgtctgtgtgtggtgttgctcgtggttcctggtgtgtttgtgttggttttgtttgtggtttggtgcttctgtcttatgtctgtgggtggtgtggttgttgtctcgcttctggtttggtctggggctcttgtgttgtgttgttgggtgtgtgggtgttggtgtttgtgagtggttggtctttagttgtggtgtgtgtggtgtggtcactgtgttggtgtgtgttggttggtttttgtgcgtcgctgtgtgttgcttgcgcgttgcgtcggctgtggtgctgttttggttggtgctgcgctcgcttccttttactggtgtcgggtgtgtgcggtgtgtgtgtgtgtggtgttcggtgggtaggtgtgtatgctggttcgtctcttctctactcctgtgctgtgtgtgcgtgcactgcgcgcgtctcgctgcgtcatgtggttgtcctcgtccctcgctctgagtctgtggcgtgtgtggtgtggtgctctctctggtgtagttgttttgctcggcttggcgggtcatcgcgctctgctcgctgctgtgctttgctcgactcgctctgcgggttgcgtgttgtgtggtcgtcgctgcgttgcgtgtgtcgcttctctcagcctcttctctctcgcctgcgtgctgtgttgtgttgtgggtgtgtggtgatgtcgggggtgctttgcgtgctgtgggtgctcagcacgctcgctgcgcgctgtcactacctacctacatcgctgttgcgtcacacctcactctgctcgctcgccccctgccctcgtccgtccgtgcgcgcgtggggtgtgattgttcgcgtgtcggcgagtgtcgattgtacgtgacatcgcgctccctgcgctgcggcgctccgcgcgcgcgcactggtgtctctactgctgtgcagagagagctgcagctcctgctccgtccccgtcgcgcgtgtgtgtgtgtgtgtgtgtgtgtgacatccgcacgtcgattcacttcgcttgtgtctttttgatgtgcgtgtgccgcggcagagaccgcttcaccaccgtcgcggtctgtctgtgtnctaggtgttgtgtgtaggtgctccacgccacctgtctcttgtcgctctctctccgggcgtgctagcccaccgcacgtcgtcggtttcgacgtgcatctgtgtctgtgtggtctggagtcggtgatgcngtttgttgtgttgtgcggtgcgccccacctgtcgtcctgtctgtctatttccatcaccttcccactacgacagagtaaaaaataaataacaaaataaataagaaacataatatgcaataataataaacaaaatcaattatacaataaattagagattta

SEQ ID NO: 677771 - DNA, 871 bp, Homo sapiens
tctctctgcctagcgtgcttgctcgctctattgctttccttccctccctcgtgtcttccttcgcacgctgtttggtgattgtggctgctcgcgacagacatgggaggctggtgtgcatgaggacacttgtcatggcctgcctctaaacctgtggatgtgcagctggtggtctgcagcctgctgtacctgatgactccgtgagagtgtgtggtggtgctgtgctgtgctgtgtgacgttgctgtgttgccctgtgtgcactggtggtggtgcgttgcctgctgatgtgcatgcttgtgttctgtgcgtgtctgtgtgtgcaccccgtgctgcttgtgtgctgctggtgtgccatataccttgtggagtctgtgcagcaactgtgcgcctgtggatgtgccatgatgtgccgggggcggactgccagctggcctgaagctgcaacatgcgaactgtgaagacccctgtgagtggcatgggacagtcctggcccctgggcagcggacaccctgaatggtccctggtgctcacttggacatgaactctcttgatagagcccaagcagccaagaataaaggcaataaatattttacaaggcaaggaaaatatgaacaagctattcagtgctatactgaggctattagctttgtgccctacatgagaagaatgttgacctttctacattttatcaaaacagagctgctggcctttgaacatgttgcgaaaattggaaagaatgtggcacaaggactgtacaaaaatctgttgaacttaatcccaatatgtgaagctctcttaagacgtgcaaagcccatgaaagctgacataagaggcatgttaaagagtcctggcgggggatatagaagtgtccaa

SEQ ID NO: 677772 - DNA, 682 bp, Homo sapiens
ccttccggtgtgtgggttgtttgttctttcgctcttcgcagtaaattttgctgctgctcagtccttgggtctgcactacctttatgagctgtaagactgactgtgcaggtctgcggcttcatttctgaagtcagcaagaccatgaacccaccagaaggaagaaacaaactctggacacatctgaacatctgaaggaaaaaattccggacacaccatctttaagaactgtgacactcaccgcaagggtctgtggcttcattcttgaagcaatgagacgaagaacccaccagaaggaaccaattccggacacattttggcgaccacaaagggaaaatcgactatcaccaagcggtggtctaatactcaacatttgtcagtgcccactggaaaccattctgagactccctgcagctgaggatcacagcttttcattgtaatgatgtgaattattgctgaactgatgacctcaaactcctgcaaacaacttggatatcagtgaccccatgagaatctgtaatatcactggacatgaaaagaagcctggtcccttctacaaccatgacatatatttgtatttatggtcctctggagaatcttgccttttcccaccaatttttattttactctatctatagtattgtaatttcagaagaagaaaataaactacattccattcattgcc

SEQ ID NO: 677773 - DNA, 602 bp, Homo sapiens
aggtctgagctgttcctgtgtatccctgtacttggtagatcgcatcacattgttggactagaaaacagcagtttcacgtggttcaacgtgatagctgttcaacaggacattggggggtttcctatttcttgccattataaacaattcagcaggtcaggtgcagtggctcatgcctgtaatcccagcactttgggagaccgaggcgggcagatcacctgaggtcaggagttcgagaacagcctggccaacatggtgaaaccccgtttctactaaacatacaaaaattagctggccctggtggtaggtgcctgtaatcccagctacttgggaggctgaggcaggagaaccacttgaacctgagaggcggaggttgcagtgagccaagattgcatcactgcactccagcctgagcgacagagtgagaccctgtctcaaacaaacaaaaaaaaaaattcagcggtgaatgtccttgtatgtccttaacggagtttaaccatcgtacccccaaagcatgacacctctttggggcatctagaagagtcaggaggatggagctgcccatttgcatggcacggggagaccagcagagactgatacataac

SEQ ID NO: 677774 - DNA, 915 bp, Homo sapiens
ctcaagatgtcctctaccttcatctgggatggcctgcctggggcgggatgtcacacactggccccgcggcctcaaagatgtcctccaccttcatctgtggaacatgcactggccatccatgtgagctgttcaatgctgcatctccgagcatgttcacggccatgttcctgtgcgcaaggccttcctgcactgggtacacggtgctgagtggtgcatgtgactgatgatgtgatgttcacctgaggcctgagatgcaacatgaactgacctgtgtgtcctgatgtaccagcagtaccatgtgaacgccactgtgcctgatgtggaatgatgtgtgctggagatgtactgaatgactgaccgatggaatgtgagtctgtgagttgcccagtggcccccaatgatgaatgcttgctctgcagcattggcacgttgcatgagtgcagtgttgtgcctgtgacctgtgtgtgcctgaacgcacaagacaagttagtactaacacccaccacgtgaagaccatactacgactgcactgacaaccctagctattaccccatcgcccatattgagctcccacatttgcaccgacacccattcacttgactatgtactataaatagtgccctacattcacatacccccaaacacataaacaggcacaaccgtatcttgcaacccttagccatcaccttgataccttccatgcatcactttaattttgccaagccctccctatgatgaccttggacacgtataccaaacgtcgcaattaggtccaaacaaccgaaccttgcggatcacgacaggttcactacattcatcaccgacggagataactactccactacaaactcctcattacggctttgtccacaacaaagaacaacacacacagaaaacacacacacacacacgccc

SEQ ID NO: 677775 - DNA, 205 bp, Homo sapiens
aacagctccatcggagggtcacactgcgcatatgcaaatggcaggatccgaggggctgtatatcttcggaggaacagaaatagatagggaaaacggagtcataaaattagcacagaaacctaaaacctaaaagacgtaccaaggaggaaacagtgactagtgatctgggtctcttgcggaatccattttcttatctttactttct

SEQ ID NO: 677776 - DNA, 555 bp, Homo sapiens
ggaggaggagaaggagaagaagaagaagaagaagaccacaaaagacatgactatccaatttttattgacaaccggcaaggatataagaggaagaataatgtccagtgtacgtgtaccacaagaagttctgtactgcatcttaggacctagaacgttgatccattatcacgcttgatcaagagacgtttttgaactctattatcacttagcagtttaagcaacgaacagacactatttgtatgtagatgctttgtatcttaactgggtctcaacaacaaaactcttttccttactaacagcacgcatacgagtagaaacttcagtcgaagctccttgtgggatacctattgtaccacgactacaaggcatactacgacttctcttgctgtccgaactacttaacaaacagcaaggcatgtctaaccacttaagcatctatccaacagtcatggctgggccgcacgtggctcactgcctagtaatcaccagccagctttcgaggaagcggagcaattaagggcttggagaacacacgggaggcaacatttcacaacc

SEQ ID NO: 677777 - DNA, 274 bp, Homo sapiens
gcatccccctttgttgctaaccaccattaggcttccttccccaagggttaaatggaaacctgcccttttgaaagacatgctccattctctgagatcaaccagctgtctgatgctgccccttccttttgcaggttcgacacaaccgaccagcattccttcctgataagaaacccctgaccatggagtggctctgactagcctatggaggctggacacagacaggcttcgcatccttggcttcaccctttgacatatagggcctactggaatccat

SEQ ID NO: 677778 - DNA, 148 bp, Homo sapiens
cctctccgtgaggacagggcagtcttggtgcgcagcccctctcctctctgtcccctgacactccacagtgcgcctgcaacccaggcggccttatccgcgcagtggcggcagttcagaaataaagggcccatttgcgggatgccgcatt

SEQ ID NO: 677779 - DNA, 193 bp, Homo sapiens
ctgccgaatagcatacaccgcagttcgccgaacagtgcgtctctgcgcccagtactgcaccgccagttgtgcaggcggacatggttgtcgaagtactgcacacaacgcaggtttgaggccggctttctcattggcctcgtatccacgccagcaggactttttcctggttggtgccggagccgacgcatgatct

SEQ ID NO: 677780 - DNA, 449 bp, Homo sapiens
ttagaaaaggaattaggttttagatggcatagtggcttaactggactgaatgcaactattctttcaacttcatctcaatagtgatttttgtatcagaatcttggccaagttgtttcattgatttactagatgttgtgcttccaacatctttcattttaagaagttcctagtgtctgatttggcccttgaggttctggtaattgtcgacctgtatcctaagatgtgtaattcagaaatccttgtatctaataaatgcttgttgtacataactgataattttaaaatgttttctttgtgtgcttttggtcatgattcatgtcagcatccttaagcatactatgtgtggctgtcccatttggaatttaaagacaaaaatacctcaacgagtcatgctgacataatcatacggggaaatgctgtattccagaataaatttctatggtaccata

SEQ ID NO: 677781 - DNA, 281 bp, Homo sapiens
tctaaaaaaaaaaaaaaaccccccttttttaaaaaaaacccccccccaaaaaaaagttttccccccccaaagggggggggggccccccccccccccccttaatttgtgagaaaaaaaacttttccctcaagggaaattgggggaaaaaattttcccaaaaccccccggagggggggtaaaaaccaaaaatttttaaggagaaaggggggggcccccgggggggagggcccccccctttaaaaaagacgaacgaaaaggggttcccaaaaactgtccggggg

SEQ ID NO: 677782 - DNA, 408 bp, Homo sapiens
  misc_feature (25)..(25): n is a, c, g, or t
  misc_feature (33)..(33): n is a, c, g, or t
  misc_feature (356)..(356): n is a, c, g, or t
aattgtgatgttagggtgtcaattntagatttntcctgctttctcttgtggacatttagtgctataatttccctctacacactgcttgaatggtcccagagattctgctatgttgtgtctatgttctcgttggtttcaaagaacatcttatttctgccttcatttcgttatgacccagagtcatcagacaggtgtcagttccagtagtagtggtttagtagttctaatctgagtctagttgatgcctatgtctgaggagagtttgttataattctgtctttacattgctgagagtgcttactcccactaagtggtcaaatttgggaataaagtgcagtgtggtgcatgaaaagaantgtatattctgttgatttgggcgtggagagtttcctcggtgcccgaaattcc

SEQ ID NO: 677783 - DNA, 110 bp, Homo sapiens
agtttccctgatacactacctgtatcacctgaaccacacgctgtacaatgtgcagagatgggcaccaacagccacgggatcctcagcggcttcaacaatgacggttctgc

SEQ ID NO: 677784 - DNA, 982 bp, Homo sapiens
  misc_feature (779)..(779): n is a, c, g, or t
tactacagatatcagatgtgtgttcataatggtatctaccgatagtcgcggaagccgcagtggagtacgagctcgatgagtggctatagttttatccccgcggccacagttaaaatggtttaaaccaacaagggggagtgcgcccaataccggggagcgtgaacccgccacttcaaacggagatattcgaccacgtatctgccaggggtcttcggggccgtaaaacacaccgttgtgaccaactgggtccccaagagcagcgctcggtgaagtcgtgtgtgccccccgcatgccaactaatgataatcggttcatttgccgcacccaccagtgccggggtgttggtttggaatgtagccgcacgcatattgtggagagggtcagtgccgccgcctccgcggcctcaattgttgataacccggggaacaatacacacacggtctgttaacagaccccggcgcaagctcaatattggaaacgcccccggctagtgcacgctcacgctcgtcagacccgcgccccaaaacaatggaataagggacacaacaaaagggggcctcgcggtgaagaggacacgcgggggtaaaaaaaacggaaatgaagccgcgcgaaaaaaatcgattctttggtaacgccccatgtggggcacccaagccaccagcccggtcccccgacatctcgcgaaccagccacactgaaacacctggttcagacggggaatttacaggcaccgcataagtgcccaccacccacgccactggggacaaaaggcgttagantgcacccccctccacgcgccccctgctagagagaactaaaggactctccgtgcccccgggagggtcccaaccatctgcgcgagagaccacgggcaaataccccacgcgcgatccagagggaggaaaaagaccaacgaagaacaaaagcacgtctcaataaaaacctgaacccaaggaggtttttcaaaaggcaccacaagaca

SEQ ID NO: 677785 - DNA, 886 bp, Homo sapiens
tctgtccggggcgtgcgatatgccagcctgggaaattcgccaaggtccatcttgggatgccatttctaagacctactggtaccgtgacccccgacctcatgtggaggcagactgtgattcaccaagtctccctagttcagcgatttcactgaccacctcgttgagacaatgccagattctccgtgcagcggattcaggttccaggtgtggctcacaagcatagggttcttctgcatgatccagtctgtgtaagttacgcgtgtaactgttgacactctgcaaatacctatgagaaaaaggttattggaaatctgtacgggtttaggccgcagcaatgccaagatctgaagttgggtacggcttgtattgtgtggcaagcggtcccaatcttaataaactacagtaatggaatatcacccaggataatatgtcacttgtgcgttttgggtctgcaaaggtagatagactccgaggtgtatccttagtcctcagttagaaggaacacctcggggacgagtcctcttgacaggagaaggcacttgaacacggatactggcatatgaactaatttccccgcggggggggttaatttccacccttatggtcaccagtccttacagaccatttgagggcttcctcattcgaattaaagaccgtatcgcattattgggatcccgagaatgtgaggaaacaaggtggatggcttcttatagaatgcttggcggatgctacttttataacacttccaaatgctgatgccattattaatgcccgggggatacttggaacgttcacgacgactggctcgaaaaaaattctcgcacgtaatattgaaggagagctaatagcccatgttgtgtccacaggggcttcagggcacaaaaag

SEQ ID NO: 677786 - DNA, 512 bp, Homo sapiens
aatggctgacagcatcattgtgcccaccaagggctcaatgatttggtttggctgtgtccccaccctaatctcatcttgaattgtagctcccataattcccacgcgttggggaaggacccggtaggagatgcttgaattttgggggcagtttcccgcatactgctctcttggtagtgaatcagtctcacaagatctgatggttttataaggggcttcccatttcacatggctctcattctctcttatctgccgacatggaagacatgccttttgccctccaccatgattgtgaggcctccccagcaacctggaactgtgagtccattaaacctctttttctttataagttacccagtctcaggtatggctttatcagcaacatgaaaatggactaatacactcaggaagctgggtggtgcccaggtcagagagaagggaacctgggataagaaaggctctgagatgaggtgcctctgtgcagccgtcccggaaacaaagcagccagaaaaaaa

SEQ ID NO: 677787 - DNA, 112 bp, Homo sapiens
gtccaacctggcttgagtctctttgctgtagtgggggctcagagcgcttcatcttgcgccaaggtattttgcgcaaacatattatccctgtgattgccacctgcgcgctcat

SEQ ID NO: 677788 - DNA, 286 bp, Homo sapiens
gagcatggacggaactgaaaagctactggataagtcttgggaagagatcagggctcacactaaggcagtgaggatgggaatgagaggacggctgacaagagtagaagacaggtcttgagaccatctgcctggatgtgaaagactggagaagtaccagatcagtgagggactccgtgaaatgccatggctcggtgaacacgagacatggaattcttttgcttgttggaagaacggagtctcagctcggtcgacccgcccaggtgggcgtccgggggctgtgatcaca

SEQ ID NO: 677789 - DNA, 850 bp, Homo sapiens
ggaggaaacggttcagtgtcccagcaggtttcaggttcttatcatcatctgtgttggcggttctggatgcgcctcctggtgcttgctggaagctcatccatggtagcctgaaagatcatccagtccgaatgtagaataagctgatgctggccaattggtgtcccagtagatgagcatcactcggtcttggtcttttacatgagtggacgatcatctgttcattatttggtgttcccgcctgtgagttctttcaccacaagttggaccatcctgggagtgcctgtctgtggtggtggtctcattcagtcctcgacattgtcctcctgttccgggacgcgccagtgatgatggctctgggcctgctgattctgctccggctgtggcgggtggcccggatcatcactgggaattatcatctcacttaagacacgttcagaacggcaactcttaaggttacacaacatgatgaatgtcacaattggtccagccgaagattcatacaccttgagttcgagctgctctgagaaggaacacagacattgaacatgacttaacagaactattgcgacacgcatggacttctgggtcgaagtgaactaggacccgggaccagttcccctcaggtaggaagatcactgtctcatgggcctgtgctgtcacgagaggaacagtgccctcctggaccgttggatgagagggtcggttagatactatgctccctcctgcagcatggatctgggtggaacagctgtgtggaagtccgtaccacaagagctgccatacattcacccacatgatcaatgttccatttctcagtgacattacctaatgaatgggacaacgggatggc

SEQ ID NO: 677790 - DNA, 600 bp, Homo sapiens
  misc_feature (1)..(1): n is a, c, g, or t
  misc_feature (7)..(7): n is a, c, g, or t
  misc_feature (63)..(64): n is a, c, g, or t
  misc_feature (67)..(69): n is a, c, g, or t
  misc_feature (71)..(72): n is a, c, g, or t
  misc_feature (74)..(74): n is a, c, g, or t
  misc_feature (574)..(574): n is a, c, g, or t
  misc_feature (599)..(600): n is a, c, g, or t
ngggggnacccgggaatgcggccattatggctcggggcttccttttcttcagcgaggggggcnnctnnntnntnagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctgggtgttgcgcctgcgaggtggcattattgagccttctctccgaccagcttgcccagaaaatacaactgcgacaagatgatctgccgcaagtgctatgctcgccttcaccctcgtgctgtcaactgccgcaagaagaagtgtggtcacaccaacaacctgcgtcccaagaagaaggtcagataaggtggttctttccttgaagggcagcctcctgcccaggccccggtggccctgggagcctcaataaagtgtccctttcattggctngagttgtccccttggaaaaaattann

SEQ ID NO: 677791 - DNA, 610 bp, Homo sapiens
  misc_feature (1)..(1): n is a, c, g, or t
  misc_feature (7)..(7): n is a, c, g, or t
  misc_feature (63)..(64): n is a, c, g, or t
  misc_feature (67)..(69): n is a, c, g, or t
  misc_feature (71)..(72): n is a, c, g, or t
  misc_feature (74)..(74): n is a, c, g, or t
  misc_feature (610)..(610): n is a, c, g, or t
ngggggnacccgggaatgcggccattatggctcggggcttccttttcttcagcgaggggggcnnctnnntnntnagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctgggtgttgcgcctgcgaggtggcattattgagccttctctccgaccagcttgcccagaaaatacaactgcgacaagatgatctgccgcaagtgctatgctcgccttcaccctcgtgctgtcaactgccgcaagaagaagtgtggtcacaccaacaacctgcgtcccaagaagaaggtcagataaggtggttctttccttgaagggcagcctcctgcccaggccccggtggccctggagacctgacgaccttttacaatactcctcggtcccccccctattgcccttacattataacaccaacan

SEQ ID NO: 677792 - DNA, 328 bp, Homo sapiens
tcacgggagaagtcttgctctgtcaccaggctagagtgtgggtggcatgatctcagctcactgcagcctctgcctcctgggcttaaaagattcttgtgcctcagcctcccgagtagctgggattacgggtgtgtgtcaccacgcccagctaattttttgtatttttagtagagatggggtctcgatatgttgcccgggctggtctcaaactcccagcttcaaatgatccacctgtcttggcctctcagggtgctgagattgcaggcatgagccacggcacccagccctagtatgtacatatttatacaaacataaaacgcattttgtg

SEQ ID NO: 677793 - DNA, 689 bp, Homo sapiens
tacaaggcgtgcgtggacagcttcctccagcagcagcatgtgctggtggtgcctggggtgtggtcctgtgccctgactcaaaggtggagtgaacatgccaccccagcccccgctgtgacccccagaacctgtgcaagacctgccatgcccctgcccagactgaggctctttcccaactgttctgctcagtgagtgacactgactgccaaggaggagctatctgcagaccctgctgtgacccacctgatcctccacagtgtgccctgagcccacggcatactccaaggtcatgactggggacagctgcacactgcttgtgctatcaagctcatgaccaacctggcgctgggtcgaggtgtgccttcctggcctggtgatactggtgcttctcggatgagctggcacgtgggacgtggtggtatgtgctggcccatgcgggaccacaccctgaaggaggtacgctttctacaaccgcactgtactccgttccttctgtcttcacacacagccgtacgacaccaaggcccctgaaaatggccagcatccaccggctgatggaggccttcatcctcagtgctgcagacccagttcccctccactgtcagcactgtgtactggacaagtgagaagctggtgaaggggccccgggattgccctgctgctggcgactccggccccgctgcctctct

SEQ ID NO: 677794 - DNA, 683 bp, Homo sapiens
ttaggggtcattgggccccccaacgggcctactcccccgtctttaaccgcccgttgtatgtcgccccccccgtttacacaccgcccgcgctgttttgctcgcgcccacccgggtggtatctcactcaccccctggcgcgtgccccccacattgtgttgttatatataggagaccctacccgccgtagtgaccgctccgcactatataatatgttgcgcatagccgcggcgtgtgtggctttatcgtctcgcaccaccaacttgttatttcagcgtgcggtgtctcctttaatgtggtaacacccccctctctggcacacaacgccccccagagagtctccattttcacagtttttctccctcaacccacaccttttctcctgccggcgaccttttcggtagcggcagcacacatcttcttgtggttagaccccagggcgcttctccccggggcatctctccgcctccctttttgtgtggcgcctacctatctccctacgctaatcgtggttcaatctccccccccctgtaaatttgctccccatcaccacccccacaacacacgctctggtattagaacactcgccccccctctaatatcgtgcccttttcgttagaactggtttttacaatactgataggctactcccactttatgagattaagggtcttccccacaaaaca

SEQ ID NO: 677795 - DNA, 867 bp, Homo sapiens
  misc_feature (41)..(41): n is a, c, g, or t
  misc_feature (74)..(75): n is a, c, g, or t
  misc_feature (93)..(93): n is a, c, g, or t
  misc_feature (378)..(378): n is a, c, g, or t
gcactgtagattatgattcagaaagttcatcctctgggctnggacacagtagtgatgacagcagttcacatganntaaagtaaatacagctcngcaggaatcctgaaaaataattctaatgttagtatcttaggaatagcaaataatgtgcaggtcaatagagaagaaagcttcggtaagtaatacatgcttacctaaaagcttcactgtcatgatgtgaggtatgtaaattcgttaaagatgtgggtgtaatataagtggtattgtagagtgtcgtcgtcattttagggtaagactgctgtgtaaagctaaaaatcctgtgaatacaatactattgcttttacaggcagatcatgtattgtgtaaacaagatcttgntcctccaatgaaatgacttacatgtttataaaaagaccgagtcggtgttattgaatttgacaaagataggtgaagtaagtagcatttaaaatcaaagatgagagcattccttcttgtatcagtgggggaggttaccataaacacgggtatatgtggttaaacctatgaagagtaacagtgtagaagcagactggctgtctcagatatgtgctgatattttgggatacctcccctgtagctggaaagcattatgttgggtgttagagggagtattttaaaagtatttagctttcagatctggacgctaatgggaagttctttgaggtggagcatcacaggtggtgttttaagaaatgattggcggaataattggcggagaaaatgaaaattttttcaaacacgccagggtggggaaaacgtggcgcgataaggaagatgaagggggccaaacaacggggggaagaagaaaaaattaaaaaagggggaggg

SEQ ID NO: 677796 - DNA, 251 bp, Homo sapiens
ctgaccatttatggataatacgcctgcattgaagtcgcctactgcttctgctaccaggacatttaggtagaaggtggctcggtcccttacttacattgtcatcatccatcacacacctcttacagcaacaccaatgatactagggtaacattctctatacatcctagggctccaacagttcgccagagttactcacatgcacctgcccaggacctacctcatgctccaaagaccactcaggttaatagatg

SEQ ID NO: 677797 - DNA, 474 bp, Homo sapiens
ctcggctcactgcaacctccacctcccaggttcaaacgattctcctgcctcaacctctcaagcaactgggaccacaggcgtgcaccaccacgcctggctaatttttgtattcttagtagagatggggtttcaccatgttagccaggctggtcttcagctcctgacctcaggtgatgcacctgcctcggccttccagagtgctgggattacaggtgtgagccaccgtgcccggcctatcatatatgtttttaattatttattttctttttagagacagggtcttactctgttgcccaggctggagtgcagtggtgtgatcacagctcactgaaggctcgaactccagggctcaagcaattctactgcctcagccttccaagaagctgggatcacaggtatgcacccacgattcccacgctaatttttaaaatttttggttcgacgcgggcgcgaatttatatgaagtggtagtga

SEQ ID NO: 677798 - DNA, 252 bp, Homo sapiens
tataaaggatagccaaagataaacacgcagatgaacagaacgcgaggtaagctcaaggagaaatatgacgaaggagatcgcggcatatcgtgccaagggcacaagtgaagcaggagagaagggccctggcaggccaacaggctcacagaagaagcacacgcaccagaagatgaggcaggcaggcaggcaggcaagaagaagcatgcaagatgcaggcaggaagcaggcatgtagcatatagcaagagtgcag

SEQ ID NO: 677799 - DNA, 407 bp, Homo sapiens
ctccgtaatgtgtgtccactctctcccagggggctggcgctgaggtcctgagggcaggcaaggctgtgtctgctggcagtgctaggcccatggtccagccctgaagcctcttcaccccacatgtttttttgtttgtttgtttgagataggatctcactgtgccctagactggagtgcagtggtgcgatcttggctcactgcaacctctgcctcgcaggctcaagcaatcctcctgcctccatctcctgagtagctgggattacaggcgtgcactatcacacccagctaattttcgtattttttgtagagatgaggtttcgtcatgttgcccaggttggcctcaaactcctgggctcaagcattctaccagccttgctctctcaaagtgctgggcacacattatggag

SEQ ID NO: 677800 - DNA, 443 bp, Homo sapiens
  misc_feature (27)..(27): n is a, c, g, or t
  misc_feature (59)..(59): n is a, c, g, or t
  misc_feature (437)..(437): n is a, c, g, or t
ataaccttagtttgatttgggataaancccctgtatttgagccctcagttcctcctatnagatgccctgtaaaatgaactcaaaaacgctttccttcagaaaattgctcaagtatcaaatgagataacatataagaaagtaattgtgggctgggcatggtggctcacacctataatcccaatactttgggaggctggagtgggaggatcgcttgaggccaggagttcaagaccagcctgggtaacatggcaaaacctcatctctacaaaaaataaaaaacctagcccagcatggtggcatgtgattgtggtcccagctacttgggaggctgagatgagagtatcacttgagcccaggaggttgaagctactgtgaaccacatgccacttcacttcactcctgccttccagcctgggagacagattgataccctgccnaaaaaa

SEQ ID NO: 677801 - DNA, 497 bp, Homo sapiens
  misc_feature (491)..(491): n is a, c, g, or t
ggaaaaaaaaaaaaaaaataaaagaacttgttaattacaaagctttgtttatggtggcagttttatggtagaggggtaaatcctgtggacagattgttgtgtttggccagaaaagtgttttttttttagttgaatgggaatgcctccagtttgtcacagactttatcgctcttatcttaattcacctgcctggctgctgaagacagatatgtttgtgtaccttgcaaaaatgaggagtgcaatgcatagtaacacaactatgttactgagcatagcctatgtagtaggcactatgtactaggtactatgctagatgctagctgatgtggttcctatccctgggagctctcagtcagcacataaattacagctacttgggaggctgagatgagagtatcacttgagcccaggaggttgaagctactgtgaaccacatgccacttcacttcactcctgccttccagcctgggagacagattgataccctgccnaaaaaa

SEQ ID NO: 677802 - DNA, 1354 bp, Homo sapiens
  misc_feature (464)..(464): n is a, c, g, or t
gccaagattgcacagctggaggagcagctggacaacgagaccaaggtagcgccaggccagccatgcaagacaggtgctgtcgtgacctgagaagaagctgaacggatgtgctgcttgcaaggtggactgacgatgctggaggatacgccgatgcatgtacaagggacgcaaggctcgagcgagatggctagtctacctcgcctgaaggctatgctcgaatgctggacagactgggagtgaggctcgaagtagggaggcccgagcggtgccagacggacctcgcgcgtccgcgaaacgtgtcgacgactgcagagcctggagggacagccaactgcagatcgggcacgagtagcgcatgaatcgcagcgaaagtcaagtcatccacgtagacaggaagcaacgtctctaggacgctgcggggaacctagtcctgctctgtgtaccgtagcacgcctgccggaganttggctccagtgaagatgggtcaggcctggcggactagagcgtccggaccgaacgacgagtaggaatcggcataacgcgggactaggtggctagacgtgccaaaactcgtcgcgcagtacagtaaagtgcacctcctgtcataccgtggtcgagactccctgaaggaatcgggcatgggactcgaggaacacgagcatcccaagagagcatacccgcatattccgcaagaaagcgcccgaaggcacagcccttcgtgccacccaaaccctacactttgagaggacctgggtctgcgggacaaccaaattggcaatgttcccgtgtgcacgggctagcaataacgtggcatggcaaacgaaatgcgcacaccggcccaggctacagcccccgggaactacagacgctaatacaccacaagggacatggatctccgacacacagatacgcgcacgcgcacctctacaggccgcacatctacacctcccatcaccattgggacagattcgctcgccactcacctccacacgcactaccaacaccccagccacatcggccaagaaacgcatacggctcaccacgcacgcttaaccccaaacaaccacaacaacagacgaacacacacacagaacagccgcacgacgcaccacgcacacaaagcacgcacaacaaagacaggaaccaccactcaaaaagaaccagacaacaaaaggcagcacacacaacaaacaccaacaaagacaagcactgcaaccgaggcaaagacaaggatccacagacacacccacagcagacaacggcgctacaacacagaaactcacacaaacagcaacagagaaaacacatacatacacgaaaggcgacgagcaaaaaagcgaagaaacaacgagca

SEQ ID NO: 677803 - DNA, 1310 bp, Homo sapiens
aatgatgtggaagtcccagccgagatagtttttttaagatagctctcttttttctgcaaataaatacatttttgaatgagaataaaaattaaggcactccttttttgtagggtgaaggatcataatgatctttgttttgtgtgaggaagagatgtcgatattttttcttgctggaggaatggccattacttattcttgtatgttttagaataacgcacctctgtcgctgggagaaataatttcttcttgtggttaaatacatcagagaggatatatatacttgctcccccctagactatagtttgttgtttggtctgaagaatattgaaatatgtatattccggcctttttgtttgcgtgatattaaacacccaactcgggtgggttttttctatggatgggtgtttgttgagaaaacaaaacactttttgtttttcttctctctcctcgctgatgattatttgctttttgtgataatgggtttcttctctctccacagagtaggttatttgttatttataaccacgcgacttttattaggggtgtgttgcgttggtagtcccccttttgggtgagattactctctctgttgtttttgtctttgttgtggggctctccctctacgcgcgcgtgatactctccttctttttttctctctccccctcgttggtgagtagtagattacactctgttctttgtttgtctgttgtggtgctcacacacacgcacttttgtttgtttcttctctctctctctctctctctttctttcactctctctgttttcgctctcttctcttgggggggggggtgcgacacacagatatatgtttgttatatatatagaccacctctctatgggtgctctctgcgtgtgattacacacacagagaatgataatatatatagtgagagcgcgtgcggagcctcacatctctccacacacacactctgctgttattcttcctctccacctctctcgcatgctttatatgaatagacacaccttggggattctattgcgccacacacacccctgttggatactttaagaacacaccctgtggagagagtttaggggcgggttttttcccctcttctcccaggagtttatttataaaaaagagaaagaaaataatcccccacacaaccctgcccatcatgtgttagcacaccatgaaaacactatttgtggttttggttttctttgtggtgggacccacacacacagtggttgtggtgcccccccccccccggtgtttttttaggggggcccggccccccttccccctttatcacataccgggggga

SEQ ID NO: 677804 - DNA, 298 bp, Homo sapiens
  misc_feature (37)..(37): n is a, c, g, or t
  misc_feature (203)..(203): n is a, c, g, or t
aagtgacaggtggagtggctcatgcctgtaatcccangtactttgaaaggcagaggtgggaggattacttgagctcaggagttcaagatcagcctaggcaacatgacaagatctcatctgtacttaaaaaataaaaaataaaaaaaaaaaacaaacgaaaaaaaaacagccgagttatggtagtgcacgccgtgtaatcccangctactcagggaggcttaggttacaagaaattcgcttgaattccaagaaaggcggaggtttgcagttagagccaagaatcgcgcccacgtggcac

SEQ ID NO: 677805 - DNA, 318 bp, Homo sapiens
ggaaaattagcgacggattgggcaatgggtaaagaatttgactgaattagtgctaagtatataggaaacgcgacaaagaaaaaatcaagacaagtattcactaaagaggaaaggaaacttgtgcagaaaagaagaaattatgatttagtacatgattcaggatttacctagtcataatacaggaaacgctaaatagtcatataaccaaaattatgagaactaaattggaagagtgggagaaacaggaaatgtgtgtacgtgttagtgtgaggcgtcgggtaattttccggggtacgagctcgaaattcggaatccatg

SEQ ID NO: 677806 - DNA, 349 bp, Homo sapiens
ccttcgttgaaaacttgcatatcttctcataaaaatcagacagaaggattcccagaaacttcttagtgatgtgtgcattcaacttacagattttaacttttcttttgatagggcagttttgaaacactctttctgtagaatttgctagtggatatgtgcctccctttgaggcttattttggaaaaggaaatatcttcacatagaaagtagaaggaatcattctcagaaactactttttgatgtgtgacttcaactcacagagttgaaccttccttttgatagagcatttttgaaacacactttttgtagaatctgcaagtggatttttggagggctttgagggggtacc

SEQ ID NO: 677807 - DNA, 240 bp, Homo sapiens
gcccaaacccactccaccttactaccagacaaccttagccaaaccatttacccaaatagagtataggcgatagagattgagaccttgcgcatagatatagtaccgcagggaaagatgagaattatacccaagcatatatagcacggactaaccctataccttctgcataatgattaactagacatactttgcaggagagcaaactaagaccccgagacagcgagctactaagacagctaa

SEQ ID NO: 677808 - DNA, 1037 bp, Homo sapiens
gcttctctcaccatgagctggctctccagttcccaggagtggtactaacagcctagcaccccagcggcaaggaccaggccgtcgggaacagccatgcaaaggcaggggaggaagccacctcgagtcgcagatatggccagtacactatgaaccaggaaagcaccaccatcaaagttatggagaagcctccatttgatcgatcaatttcccaggattcttgtggatgaactatctatgggaagactatcggataggaactcgaaaacagtcaacgagaatctcaagtgataaacagccaagaagatcaagaggtggttgttgtccaaagagcctgatgagggagcaattgcaagcaagagtggcttaaagcaggccggttctatccaatctcttcggcaacagtctgctggacgatccacaggaaagcattgtgtatttatcaacattgacgcggaccccaggcaagcatgcagttcacaagcgagctagtagacaggtctcccagaaccttgagggaacaagagaacaacacatgtgaccagattcctgcacgtcgcgagaccatatttgctcaagcagagagaatcaaaagaaacagctccaggtggcactgaatcgcagtcaacttagaaccaaaatgaaaacaaaatacaaggaagagatgacgaggcatctaaccttgttggtgaaacgagaagctgatccccacctgaggagacgcctgccccttaaacggacatcaaccgggacgttcactggcgaagcaggcactcatcgaacggcgggctccaggagaaatcagaaacaaggggatgtaggcacattactagttcaatggccaagacacaagcgtcaaaggatggggcccccccccggcattacaagttgccttgctagggagcagcccatagtgggcgaggtgcacagaggtgaacaactgtgttggtgccgcctaagagaaacgcagaacctaagtctcaaggacaccgcgcgtgtaacacggggggagcgtttcccactgcactgcacacatatct

SEQ ID NO: 677809 - DNA, 377 bp, Homo sapiens
  misc_feature (10)..(10): n is a, c, g, or t
  misc_feature (66)..(66): n is a, c, g, or t
  misc_feature (129)..(129): n is a, c, g, or t
  misc_feature (152)..(153): n is a, c, g, or t
  misc_feature (171)..(171): n is a, c, g, or t
  misc_feature (190)..(190): n is a, c, g, or t
  misc_feature (193)..(193): n is a, c, g, or t
  misc_feature (219)..(219): n is a, c, g, or t
  misc_feature (229)..(231): n is a, c, g, or t
  misc_feature (239)..(239): n is a, c, g, or t
  misc_feature (244)..(244): n is a, c, g, or t
  misc_feature (247)..(247): n is a, c, g, or t
  misc_feature (259)..(259): n is a, c, g, or t
  misc_feature (263)..(263): n is a, c, g, or t
  misc_feature (279)..(279): n is a, c, g, or t
  misc_feature (286)..(286): n is a, c, g, or t
  misc_feature (289)..(289): n is a, c, g, or t
  misc_feature (296)..(296): n is a, c, g, or t
  misc_feature (356)..(356): n is a, c, g, or t
ttcatgatanatgtattaatatctaaatgagtagtgagttgacataagaaccatagttccataatnattatcttcaaatcaatggatatcttaaatgtgtatttttcttccttagagattattattaanctgcatgtatttgataataaagnnttttaggactgagaaagntaagtttttcttacccatnatnagatatatgacatatataacttatcnccccgaaatnnnatgacatnaaggnggntatccctaaagncatntaccttagtcacttgncattaantanggttacntcggaagaagaagtatggccctaaagctactgtcacatgaatcatgccctaatgtgcacnatatatgacctactttggtca

SEQ ID NO: 677810 - DNA, 179 bp, Homo sapiens
actctactcggatccccgtttcaggcagttcgttctgtcctctgacctcctaatctaacttggattacaggctcatgccaccactaccctcgtgttatttttgtattttttgctacagagagggtttcatcagcgttgtccttccaactctgactctcaagctgatcccacacacctta

SEQ ID NO: 677811 - DNA, 1207 bp, Homo sapiens
ttttaaaagttcaaataaccccaaaaaggcttgtccacggctgtgccccagatgtgtgggtactgacccacaccagccctgtgtctgtcctttcagtcatttgtccctgcgtaattttaatctgtattccaaagcccaattatgtgatggttttcaggttactgcaaattacagaagagccagccaatgatcacccatggagcttgtgcccccagatgggccacagaaagagcctatgaaggacgaatgcagaagcagactggctggcctggctcaccttcccacgccagtgtgtggcaggggtctgcttcaggacatggacgctgtccaggaaatgagcacgagcttcacaagacagccacttctgcttctatgttgcagtacagtactctatacttcgacacctgcagcaagtcagtaatcccccgtggcatcacagctaagtagctgtggccaccggcagttacaacatgcatcctgaacgctggcactgatcgtgactatcagttgacaagacagcttcacttttcaggtctagaaaactgtagcatcttggccactatgcattcttcagtagtactgtcctcacctccctcatgtgacttgctgtcacttctacttttcaaccacatacacgttgcacccgtcagccagtgctgtccataccctcggcacacatcgtcgatcctcctatagaaagaacacttctcggtaccttgcctctataccccactggactatggactcctatctacttccaactccactgggccctcacacactatacacacagcgtgtctacccctcgccctacaccaccaccaagacataatcaagcctacacaccacctcatcttatcaagaatctatacgtcccaacaattcgccacaccaatccgtgtttcattctgtacccattccccatctcacaactctccgctcacatcaatttttcgtacaccagtaccgaccttttctacaaaatcactaccactccataacactcttcttactaccatttccacttacattatcattaatcacaaaataaaacttcctcatcctccctcccacacccgatcccccacacacacaccctcatcactcctctattcattcgtacttgcttcctgtctcttcttcattcactcccatctacatgtatgaagctatacaaaaacaattctatcattcttcctcttccccc

SEQ ID NO: 677812 - DNA, 149 bp, Homo sapiens
gctggtggataatggtagcgggaatataggggagacgcctgtaccagggctgatagcgatggggctatattgacaccggcggtggacggagcgctctaccgagcggacttggtggccagctgctatgcgcggagccttgccgccggctg

SEQ ID NO: 677813 - DNA, 729 bp, Homo sapiens
ccacacccagcccatgttcccgccgctgccgctgccagacacagtcgctgcccctaagcgtgctgtgcccagtgtgctggcctcctgttcttgcctccctcgctgtgaccgccgggcagccgatgctgcggctggcagcacaacttcatcgcctccgtgcgcctgtctgctacctggccaacgatgacgaggcctgtctgcaatcttgagtcctgtcggcgcgaacacgcatcgcgccatcgttggtctgcctggctgccattctgctcggacgctgcggggaccctgtctgttgcccgtgctagccgtgggatttgctataccctgtgcatgtaccttcatctggagcgacgggtccatgcatgctgctggccgtgtgttcaacttttgacgccactctcaatccgtctaggcacagcatacccagtctagtgcagacgccttgcgactgtgaccgggcgccccgtgggacttgactttgtcgcgcgaagaccacttgggatgtgatccgttcggagccttctccgtacaatgcagacgtctcgatgcaagctcgtcctctaggggagtgcccctgtgtgctcgtccgtggcgtcaactgtccaatcaggtctggtgcgtctcgaccgactaactctgtttggctttctggttgcccagcctggcgcatttttaccgcgcctgctacaagcttggccctgcgcttggacatgacctccgaaccgcctg

SEQ ID NO: 677814 - DNA, 127 bp, Homo sapiens
acctcgtcgtttttaaaccccagctcgcgcagcaccgccgcatcggcgcgctcgcccgacatcttcggcgcacggtggtgctgaccgaaagcgcggcgccggggccggctgggtcacgccgcctgcg

SEQ ID NO: 677815 - DNA, 240 bp, Homo sapiens
actcggggcgccccctgcccatggcccagcctgcgcaccgcacctacaaccttcaggagaggaggcgcatcgcgagcatgactggggctgagcagacactgatgccccggatccccacggatgagattgaggcccacacgctggccacggccgacctagacctcatgaacagtcaccgacttgaggacgttcctggggtgcggcggcactggtggcggaagaatgccaaaggttccacac

SEQ ID NO: 677816 - DNA, 437 bp, Homo sapiens
tgccttccatcttttctaccatgtgaagactcaatattcaaggtgccttttagaagcagagataccagacactgaacctgctgtcaccttgattttggactttccagcttctagaacttttagcacaactggggagacctcagaaaacttaacaatcatggtggaaggggaagcaaacacatccttcatcacagggcagcaggaaggagaagtgcagacaaagagatggggttttgccatgttcctcaggctgttcttgaactcctggactcaaaagattcacctgccatggcctccaaaagtgctgggattataggtgtgagccactgaacctggtctaagagacagttccttagggatgaagagttatgcatgctcattaacagaagaatgtgtaccacagcaggtactgcatgctaaacccacgacttatgacc

SEQ ID NO: 677817 - DNA, 427 bp, Homo sapiens
cggctaacttgtttaaatgctttttccccaatgtgcataggatacatgacatcatccaaaaagaagtacataaataattgtggaaggggtccagtggtggccaggtaagctcttttttgtacaacaataacagtgtagattgctaagcccactggatctcctacttctccagacaaacagagtaagtttctatccaggggccagggccatctcctccaccagtggcccccatccaggagtgcaatgcccactgctgtttcagatgagaacaggttagatttcacaggtcttgcccaaagtcattgattttatattaaaaagaataaccagtgtttctgagagcagtattgtagcctgtattttaaaaagattctattttgtatacattgtcaagtgaacagtgaatctattaaccatctttgtttgt

SEQ ID NO: 677818 - DNA, 275 bp, Homo sapiens
ggagttcaagaccagactgaaccggtagtgagaccctgtctctacaaaaataaataaattagctgggtatggtggcacacgcctgtaatctcagcactttgggattagctactctggaggctggggcaggagaatcgcttgaacctgggaggcagaaatttcagtgagccaagatcgtgccactgcactccagcctgggcgacaaagtgggactcaaaaaaagacgaaacagaaaagggagcaatggacctaaatggacaatggacctaaatgga

SEQ ID NO: 677819 - DNA, 892 bp, Homo sapiens
gggttcctgaagctctaaatgccctatggaatgtgagggaaggtctataaactgccatttttctaattataaacttacattctcttacttatttacaaaccctgtgagttctttttgtaaattgtggaacacaaatgatgctagaggttgtgcttcttattttattttattttaaatggggcatccatttgaaatcagaggaacattgtgaattgtaaaatgacttctgttttctcaaaggccatgccatgtaaatgttagtgttcgccaaaggacagccaagctttcttttaaaaagtgataaaagtcttattttaatatgctttaagctgacaagacaaaaccaataaggaaacaggcaggtgttttaaaaaccaccacagattgcacaacgtgtttaagagtatgttcgaacatatttaattctcacgtcgtagtagtgtctctcggtaatgccttcttttttgcagatgtggtcccaatttatagcaatcttctcaacagcacgtaggcatggacacaagacttcttttcatacttctcacctaataaaagaaagctggtttgagaaggacatatggttgtcatttcaacggatgggcttacctagtgagaattcttcatcgggtactaccaggtctcatgtggtggtcttctaatatattcaggtcgaaagatccggcaggatcgtcagagccgggtatcctagggtaagaacagacagcgacccttcacagaggggactataggatcagggggttgggcacgaagcataaatggcggacgactgcaggagctgatacagctctaacgaggagacatcacgaccgcaagtggaacaagacaacgcaaacagagggagaaaggacgtcaaacaccggacccccaggga

SEQ ID NO: 677820 - DNA, 454 bp, Homo sapiens
caggaggctatgtctgaccagaggctccttggggctccctggacagagtcccctgccctaggagagtgtcaccacttgaacagaatgggtaacactgccccagctatgtcactagagggagtctctggccctggtatctgaccaggtagaattcagaaagggctacctttccagagaagtcatggacatttagttcaccaccagggtggtcttttgaagcagatctatcctagccgggaggtgttgcgacatgaagggtgaggccagcccggaacaaatgccaagctggtccattggctgtgtggctagctgtagaggcttcaactcagtacgagccagtgccatgtgaaggaacaagctggtcttttggttttctttccccctccagtttcaatgttatgtaatgtatttaaatccttatttaaataaagcttgttttcagaaaaaaaaaaaa

SEQ ID NO: 677821 - DNA, 617 bp, Homo sapiens
  misc_feature (563)..(563): n is a, c, g, or t
gccacggcggtcgactggtcagacatgtacttgatagtgcaggtatttcgaagactccgcgaattgagatatggaacttcgaataggagatagtgatattgggagaaagaatactatagtacgacgtgtgtgttctcgtgtacacaattccaccaggcgcagtgcgaaacacgtcctttctctgcagatacgcctcatatacccgtgtgagtgctcccatgcggttctgcgtcatcgaactacgcatcatattgagaagtacgacgtatcatacaggttgttctggtaaagtggaggtcatgaaagtggttgtgactgcgatctaagttttcttccacgaatccaaaatcattgtgcttgtaccaacaggatcaagatggacgagctctagtgggaggctagaagggaagataatcagggaaaaatgtcaaggggctcacattgtccttgaagttcctccatatcataacccagcagttacagctgcagtgcaggtgcactgtttatctttgcaatggcaagaggaaaaaaagccagtctcaacgttttacttatacaccagntttggatgaagcaagaacagcggagaagagattgatttgtcttcagttccatct

SEQ ID NO: 677822 - DNA, 208 bp, Homo sapiens
caggagggcaggcaggccaaaggaggggcagtgccagcatgccagtgtcagacctgggattgtcaggccaggtcagggtcaaggctgggccagggccagggccagagcacgggcagggccagggagaaagcagaaccagagaggatccagagcaaggccagggtcagggcagacacaggaccaggataaggcaaagccaagggccagg

SEQ ID NO: 677823 - DNA, 363 bp, Homo sapiens
gaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaaaaaaaa

SEQ ID NO: 677824 - DNA, 359 bp, Homo sapiens
gtaggattgtctggaataaaccgttgtaataaataaccggcaaaaaaaggcgccattaaatggcgcccaataaacctttgccaacggagcagaatggcgcagggtgctacggattaagtaagcattaactcagctgttcggttgcgcctgttcaaccgtgtcggccttgaccgacttgccatcggcgctggcaacttgtcgctcagccttgccgtgggttttttcctgaatgaagctgaagttgttgtagaactccttggagcgctctgcgccgccctctgcaaaggcagcggcagaggtcagggtcatcaggctggccagcatcaaggtcgagagtttcatagtggtatccccattaa

SEQ ID NO: 677825 - DNA, 1091 bp, Homo sapiens
acccctaatgtcagcttggctgtacggactccccgaggttcggtctgtgctagaacaatgggaggctgtgatttagctgtgtaagctcacatccagccttggactctaacgggcattcacaacccgagttaccacttaccactccctgcttaggattactgttccctgggctgaaactgcacacatcaagctcacattttctcgggtccacggaggccagtcaggggcaacctcaggcagggtgtgcagtggcctttgtccagggcattctcagccccatgcacgtgtctcattgcacacccctcactatatactggcacgctggcaggtatgcaatcctggcacagctatatatctcagccacactgcaaccaacaagcctccaggcttctgctccctaggatccatggcaccattgacgcatatacaacgccaccgatatgcccggtactatcgcacttagccacccttatgggacataccctgggtcgcctatcctaattactacctctggggacattcaccgttctacttacactacttggaaaacactagaccttgatgaccccagcagcatgagacgttcccttcatttcccaaagggtatcaccatggatacatcatggcaaaggccttgggcgaccatcaacttcagagtggctcgatcacggccattcacacgaaggacacaaaacacatggttacagcggagacctacagcacatcagggagccctattcccgggggggaaaaaaccatcaatatcgccacccacacctatggcggacacacaccacccacgcgggcaacccccgagcgacacacggcaccggaaccaacgaggaacactaggcagagtaacacaccaacaagggggtgtatccacgcgagaccacccccaaaacatcacaccgaaggagcatacacagcaaccagggcgaaaacccgatccaccccatgggccaatagcaggagccacgacgggagctggaacaacaataggatcaaccgcacaagagacaaaacaagaagaaaagacatccacaacaaaggccacacatagcgccagagaggacaacactacacaaacg

SEQ ID NO: 677826 - DNA, 251 bp, Homo sapiens
  misc_feature (1)..(1): n is a, c, g, or t
  misc_feature (222)..(223): n is a, c, g, or t
nccgggccgggctgggggccgggccggctgggactttttgtatttttaggagagacggggtttcaccatgttggtcaggctggtcttgaactcctgacctcaggcaatccgtctgtctcggtctcccaaagtagggggattacagatgtgagccaccgtgcccaaccaacaatgatctttattttgaaagatgattttcaaccactttagtaccgagcccgnngccggccgggtacggagctcgagatcgt

SEQ ID NO: 677827 - DNA, 413 bp, Homo sapiens
  misc_feature (153)..(153): n is a, c, g, or t
  misc_feature (159)..(159): n is a, c, g, or t
  misc_feature (163)..(163): n is a, c, g, or t
  misc_feature (220)..(220): n is a, c, g, or t
  misc_feature (245)..(245): n is a, c, g, or t
  misc_feature (261)..(261): n is a, c, g, or t
  misc_feature (287)..(287): n is a, c, g, or t
  misc_feature (307)..(307): n is a, c, g, or t
ggacgattaacaagaacaatagccaaggaccacaggacatctcaactggttcaaaattgaagttgagcaagctttccactcgatgggtgccaaaaccgttgtgcccagatcagctgcagacaagagcagagctttcaatggaaattttaaacnagtggnatcnagaccctgaagcatttccttgaattataacaggagatggaacaggactttaccagtnccatcctgaagacaaaccacaatcnaagcaatggctaccangaggtagaagtggcctagtcaaggcnaatgtggacaagtcaaagtnaggtcatggcaacagtttcttgggatgctcaatgcattttgcttgttgactttctggaaggcccaagaacattttttttttttttttgaaatggagtctcgctctg

SEQ ID NO: 677828 - DNA, 525 bp, Homo sapiens
  misc_feature (19)..(19): n is a, c, g, or t
  misc_feature (76)..(76): n is a, c, g, or t
  misc_feature (102)..(102): n is a, c, g, or t
  misc_feature (108)..(108): n is a, c, g, or t
  misc_feature (116)..(116): n is a, c, g, or t
  misc_feature (210)..(210): n is a, c, g, or t
  misc_feature (222)..(222): n is a, c, g, or t
  misc_feature (237)..(237): n is a, c, g, or t
  misc_feature (284)..(284): n is a, c, g, or t
  misc_feature (286)..(286): n is a, c, g, or t
  misc_feature (288)..(288): n is a, c, g, or t
  misc_feature (321)..(321): n is a, c, g, or t
  misc_feature (326)..(326): n is a, c, g, or t
  misc_feature (332)..(332): n is a, c, g, or t
  misc_feature (337)..(337): n is a, c, g, or t
  misc_feature (341)..(341): n is a, c, g, or t
  misc_feature (353)..(353): n is a, c, g, or t
  misc_feature (364)..(364): n is a, c, g, or t
  misc_feature (410)..(410): n is a, c, g, or t
  misc_feature (504)..(504): n is a, c, g, or t
tgttcacctccctccaaantttccaaaattgaaggactcctaccaaaacaaaaacaaaaacaacacacgcccacangaagaaaataaaaagggaacaaaaantcacanttcctaantggggggggtcaggtgcatttgacgcaggttttcgcgcgtgtcgtgtcataaccattcctttcacgcctcgacttttcaaaaaaaaaacacccnctaacgcctcantcaaaattattacanttttccattttcgcgttttttaaatttaaaaattaatttatttaaanananagagggaaaacttttaacgcgagatttcacaantcaanttgccntgacntcanttttgattgtantgtacacgcantattggagggtgagggagaggcgcgtttttgcaggcacagtgtgantttgggcgcctacttgaatctttcacgcgcgctttacgcctttccttccaaaacacgtcgtaaaaatacccaacaatttccacacgtattgaangggacacaagaccgatcctcc

SEQ ID NO: 677829 - DNA, 1014 bp, Homo sapiens
  misc_feature (1014)..(1014): n is a, c, g, or t
ctcgctcgcgggtcccgcggtctgtgtctcgtgctcacaagtgtgtggcgcggaacatctccggacactctctcacactctgagagcgctctgagatctctctgctggtgacatctcgcggacaacccattttctcgggcgattaatccttgtgccttcgtggaccatcgtcgacgagccagctgtttgtgtgggtggagctctcttttgctgacacaaaaacatgatgcatctccacgatatgccgtcgaaataatttactctcccagcagatgtgggagcggccggtcggacaaagacgcccttgcgcatattgttgccatcgtgggggtccttataccatatatctcctcctcggggccttatatcgagcagcgagaatatgtggttcttctgaaagagggtgatgaccaccattttcctcccgagtttgggcgacgaaggaagagcgcgagggtgactacagagtcttcttgtagagatagttagaaccaccgtgtgggggggcgcgctcttctccagagggatcatcagaaaacgacgctggtgaatagtgtggggtagataaaaccacgaagagcgatgaggaaatggttgttgtggcctcggtggaaaaaaagctgtgccccaggcctctttgggtcttccaagtgcctggtggttgtgccccgcaaagacccaatatctgtgagatcctgtggagacacatccagataagagagggggagcgctaaacgacgacgtgccgcgacctcgttgcacatctccaggcgggggggccgggaggggagggggcgaggtttcactcgcaaggggccctcaaagcagaataaaccttggaccgagtttaagggcctgatagaaaggtgggaaagccccaacaaggcgtttaatctcaaccggcaagggaactcgttccaacaaaaaaaagtgccggcgcaataagatgcgggaaaaaggtcactgccgtcacccgcagtcctcaagcagcccccacccgagtacaagaagagn

SEQ ID NO: 677830 - DNA, 407 bp, Homo sapiens
cttaagttacccaatcaacaaaatgcgacgtactcaagcgggggcttcgaatcctaaggtgatattatggatgtgattgacaataatagtatggcgggatgaatcaaattgtgaggaaagttgatccaatacatgccttgagagtcgaaaaaccctggggctacaaaaaatgttgagccgtatataccgtctcaaatggtgaagggctacttcgaagtactctgaggcttgaaggagggtaaaatagagacccagataaaattgtaataagcagtgctagaatatatatggtaacggttgttctcatattagactatggtgagctcaggtgattgatactcctgatgcgagtaatacggatgtgtataggagtgggactactaggggattaagcggggtgatgcctg

SEQ ID NO: 677831 - DNA, 2222 bp, Homo sapiens
aggacttcggaaccgccccgtcctcaagatcgaaaagcccagagccgcgcgctcaagcacggtgttgggggtggggtctcaggagcgcccagcaaggcgcccctgtcggcgtggacccgcgggctcaaaggcagttccccggtgacccgcccagcccctctatgcgaactcgaacgacagcaccacagcccgccagcgtcgagactcgcgctgtgccccaacccaggtgggcgccgcggagccgcgagcctgagcccgccctgcaggtgacccgcggcccttcctcctccaggtaccccttctcctgcggccccgtcccctataggtaacctttacctcccgcggctccttcccctccaagcgacccgcagcgcccgggccctccaggtgactgcgcccccgccaacccccgccccaccacacacacacaccccctcgccttcttccgccctactccctccaggtgaccccacccccgcagctcctcctcctccggacaacctgcagccccgcccctgcaggtgaacggcggcccagtccctgcaggtgacccgcggaccctccccgcccgtcctactaccgtcataggacgcctccgcaggcgcactggagccgattgcgcaggagccgattgcgcaggcgtggctctcacacgcgctgccctgttggcgttggtgcgggactgcgcaggcgcgcgggggcaagactggcagtgcgcctgcgcgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagccagctctttgttcagttgacttactgtttcttaccttaaaaagtaattgtagatggaaatcagttgtgtttggcaggagaatcaataaaaatgtttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggaggcaggtgcttgctccccagtgctacctctctcttccctagggccttttgtggattgacagtagtcccctccgtagagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatat

SEQ ID NO: 677832 - DNA, 198 bp, Homo sapiens
  misc_feature (59)..(59): n is a, c, g, or t
  misc_feature (70)..(70): n is a, c, g, or t
  misc_feature (77)..(77): n is a, c, g, or t
gattatgattacgtgtagttggagtcagcggggaccctctggactccttcacagcctgngcatcttgagntccaagncctcattcagctctcgagaacatctcgaagcgctcacgcccacggatctgaagggtgaaatattctccatccagtggtttcttctttggctggggagaggagctggtgttgttgggcagtg

SEQ ID NO: 677833 - DNA, 131 bp, Homo sapiens
tgctcggaggttgtgtactgctccgagtcgccccaccgaaattttaatgcaggtgtggtagttacgtgacctgtgtggttttgttccggtaatgaatgcattaataaattaaagctccatagggtcttctc

SEQ ID NO: 677834 - DNA, 2222 bp, Homo sapiens
aggacttcggaaccgccccgtcctcaagatcgaaaagcccagagccgcgcgctcaagcacggtgttgggggtggggtctcaggagcgcccagcaaggcgcccctgtcggcgtggacccgcgggctcaaaggcagttccccggtgacccgcccagcccctctatgcgaactcgaacgacagcaccacagcccgccagcgtcgagactcgcgctgtgccccaacccaggtgggcgccgcggagccgcgagcctgagcccgccctgcaggtgacccgcggcccttcctcctccaggtaccccttctcctgcggccccgtcccctataggtaacctttacctcccgcggctccttcccctccaagcgacccgcagcgcccgggccctccaggtgactgcgcccccgccaacccccgccccaccacacacacacaccccctcgccttcttccgccctactccctccaggtgaccccacccccgcagctcctcctcctccggacaacctgcagccccgcccctgcaggtgaacggcggcccagtccctgcaggtgacccgcggaccctccccgcccgtcctactaccgtcataggacgcctccgcaggcgcactggagccgattgcgcaggagccgattgcgcaggcgtggctctcacacgcgctgccctgttggcgttggtgcgggactgcgcaggcgcgcgggggcaagactggcagtgcgcctgcgcgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattgggtcattgacagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcaagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagccagctctttgttcagttgacttactgtttcttaccttaaaaagtaattgtagatggaaatcagttgtgtttggcaggagaatcaataaaaatgtttgattcagacagcttatggggtattttaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggaggcaggtgcttgctccccagtgctacctctctcttccctagggccttttgtggattgacagtagtcccctccgtagagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatat

SEQ ID NO: 677835 - DNA, 123 bp, Homo sapiens
ctagaggatcccggcagaggtagggctgagggcgggacattgtctagacagttcttggagcccggttcttgaagcggtgcagtggtagttgccgtaatccttggtcaggccctggtcgtacgg

SEQ ID NO: 677836 - DNA, 674 bp, Homo sapiens
agcggaattctacgagagccatcactagatgactgggaagtaccgacttgagcagtcagagacagctttctctgtagaatggtcagtctggaatactggcattgctatgtatacctcgtcgggctcccatttgaccctttttgagaacaagaagaaatagagtaacggaacatcaaatcgtcgtatgtcctgccgtgtgtgcatcagtggatcaagcatgtgatgagttgataccagagtatctcagatgttagtccgtggtgtgggtgactctgaggatctgcacttgaatcatctcccgtagaaagtgcgtccatgcgagagacaatgatcgttgacagtcattcgcaaaaagcatctgttaagaacgtgccttggtgagcttttctctgagctggcagaacggacaaggagaattacgagaaattctatgaggcattctataaaaatctcaagcttggatatccacgaagactacagctaaccgccgccgcctgtctagagactgcgtgcgctgatcatacctcccagtctggagatgagatgacgatctctgtgcagagtatgtttcatcgcatgcaaggacgacacgagaagtccgatctattacatcagtggtgagagcaaagagcaggtggccaattcaggttgtgtggagcgagtgcggaaacggg

SEQ ID NO: 677837 - DNA, 177 bp, Homo sapiens
caaatcaccacacccacaccccccatacacacacacacacacacacacacactcacacacaaagtatagagtatatataattaatcaaaatggagtttctcttgaagaaatgaaatattgaatatcttaaaaattattcacacataatatcttctagtgtattcaatacagtaaggg

SEQ ID NO: 677838 - DNA, 209 bp, Homo sapiens
aaactggtaactttaaataatctaaattacttccttaacgaggagggaaagcaacaggcttttaaacaaccgggtaagattaaagggcaaaaccagggccaggcacggggggtccatggccgtgtattcccaggcactcagatttcatacccattaaacattttcacttggatactggcatttttaatttggctaatacaattaattca

SEQ ID NO: 677839 - DNA, 178 bp, Homo sapiens
caagacgtagagactttatcgttgaacaaacgaacctttaatagcggctgcaccatcgggactgtcctgactccaacgtcgagttcgtaaaccctatcgttgatatggactctagaatatgattgcgctgttatccctagggtaacttgttccgttggtcctacatacttgattgaca

SEQ ID NO: 677840 - DNA, 119 bp, Homo sapiens
tatctatacatcatcatgacagcaaaatgtcactcttaaacataaccaaatagtgcatccaaaccccaaaataaatgacttaatgtaataccattatatatgaagtacatatgctgaga

SEQ ID NO: 677841 - DNA, 529 bp, Homo sapiens
ttcgctttctttcttcttcttttttttcctcgagccggagtctttacctgtctcccaggctggagtgcagtggtgtgatgtcagctcactgcaacctctgcctcccatgttcaaacaattctcctgcctcagcctcccaagtagctgggagaacaggcgcctgccaccacacctggctaatttttgtattttaagtagagacagggtttcaccatgttggccaggctggtctcgaactcctgacctcgtgatccgcctgtctcgggcctcccaaagtgctggtgtgagtcaccacgcctgccaaatgtttcactttcttatcattcatgtgtttactggagtagcacttttaatttcctttaagagcatttcctttgcatgcataacttggctacctacttggcaaaagcagcctagcttttggcttagctcagcttttgacatgcattccttactaagtttaattatttctcacttttgatttaaagtgaaagacatgtgactcttcccttcacttagaagccactgt

SEQ ID NO: 677842 - DNA, 373 bp, Homo sapiens
  misc_feature (30)..(30): n is a, c, g, or t
  misc_feature (91)..(91): n is a, c, g, or t
  misc_feature (99)..(99): n is a, c, g, or t
  misc_feature (155)..(155): n is a, c, g, or t
  misc_feature (157)..(157): n is a, c, g, or t
  misc_feature (165)..(165): n is a, c, g, or t
  misc_feature (189)..(189): n is a, c, g, or t
  misc_feature (197)..(197): n is a, c, g, or t
  misc_feature (261)..(261): n is a, c, g, or t
  misc_feature (306)..(306): n is a, c, g, or t
  misc_feature (341)..(341): n is a, c, g, or t
  misc_feature (345)..(346): n is a, c, g, or t
  misc_feature (348)..(348): n is a, c, g, or t
  misc_feature (353)..(353): n is a, c, g, or t
  misc_feature (355)..(355): n is a, c, g, or t
  misc_feature (359)..(359): n is a, c, g, or t
  misc_feature (364)..(364): n is a, c, g, or t
taaaaaaaaaaaaactctaagaataaaaanaaaaaaaaaaaaaaaacaaacaaaaacccaaccaaacaatagtactccttccactctatgntaacggangaattctcacaccagccagttaaacaatgaaattattaaacaagcagcctgctggnantgcatgcngagctaaaatgcaggtgtgctganttcttggngctggtgctgaggaaaacatcaaaaagcatatctgggatctatcacagctttctttcttaagcnaattaaaatgcaaattagtttcataaccacaattcaatttatcanactttttctgaagaattttcatttaattatgtttncgtnncnggggntncaanttttncacaaactc

SEQ ID NO: 677843 - DNA, 125 bp, Homo sapiens
aatttctctaaagggaaagggcttttgcatctaacacaatagagttgaagagagcttaggatctctctctctaggtgctgagcctcactctgtcagctggactaatgtacctgctctctcaatgc

SEQ ID NO: 677844 - DNA, 1661 bp, Homo sapiens
  misc_feature (376)..(376): n is a, c, g, or t
tttgtggggcgtgtgattgattgtaggataattatggttgtgtgtgataagaaagagtcgtcccttacctctcctttttgtggcgccggctaataattatgggttgtggccagccaaaatatgtatatgattttttatagaagggggagatggaatttgatcaactttttggtgggggagtaaaaagagagagagtaccgcgccgcttttgcataggtgtttgatactacctcctctccaccggggaggatgctttcctcccctcacaaggagggagtagttatctcctccccctattctgaatatgtttggtgtgggcgaccgagcatattcgtctccgtcggtaaagatattgggagcgggttgtttctcttcntaccagacaacacagcggggggggtttcccacaccgatggggagtgtggtgtattatgttgaggcacgaaacaccgtttggaataaaggttgtctctctctgtggcgccccttatggaagaatgttggtggctcccaccaggaagataatttcagtgtcgtatgggagagacacgtgtgttgggcccaacactgtctttttatgaggcagcatcagaataatgtttgcccaaacagccctctcgggaaagatttttattcaaccgtcggcagaacagaagaattagtgtttttctcaaacaggggggggttatttatagcataatatatgttgtgtgctcccttctggaaggagcggtgataaagacggttgtggtccccaccattcgggggaccaacattggtggaagatttcttcttgtgtatgaactgcgcccgcgtgggagaccaccaacaacaataatagtgtgtgggtgtttgccaccacgtcggggggtgtcccacaacaaaacataaaaatgtggggccccaacaggaacacatccatcatttgagcattcttccgaagaaaaggtcgcctttctacgacaccagcgttgttgaagatcttgttctccccacaggatgaacttattttctccgcagcattagggggtgattaatacgtggtgggccgttgttagatgcttctacgggtgtactcgtcggtgggtgtggcgcgtttttataccttatagacacacacacgcgcacacacacactgtcacagagatatacgcgagaagagaccctctcttatatggtcttcaagcacaccctctctcacggtgtcccgccccacaatattcccgcgaaaagacaagacatgagatgtgaaattttcacgtgagacccgcatgatgtgtgcactgagccacactgagacttgagaacgacaagctggggtctcaatataatttgaatttccacgagtacgccactttggagaaaagaacacatagggacacaagtgtctgttccacacattgtagtttatccttctccacatgaacgtccttcgttatgagaacacgttaaaaatgctgagagaagccccacagtttgagagattggggaagctcactggaggcttcacatggggaagggcacgtatgttttgggaaaaccacctggggacgagacacggtgctaaaggtgacgagctgatggatatggagccccccggcccagaatctgttgaaaggtcagagctcaaataggggccaaaaaaagtgcaaatattggga

SEQ ID NO: 677845 - DNA, 425 bp, Homo sapiens
ttgaaaaaaactcctgcagctagctcagtgtctgcccaaacagctgcccagttatgtgcttgaagcccagggtcctggtggtgtaggcacacaagataatcttctgatctgcagattgcaaaaaccatgggaaaagcatagtaacccagctgggtagcacagtccctcatggcttcccttggctggcggagggaggtcccctggctccttgcgcttcccaggtgaagtggaagtgacgcaccaccatgcttctgctcactctccgtgggttcatttttccaatgaaatgaacggggcacctcagttggaaatgcagaaatcaccctccttctgcattggtctcactgggacctgcagaccagagctgttcctattcggccatcttggcctctcctcctttgcccatattttaaaatagagtttct

SEQ ID NO: 677846 - DNA, 430 bp, Homo sapiens
  misc_feature (334)..(334): n is a, c, g, or t
  misc_feature (357)..(357): n is a, c, g, or t
  misc_feature (370)..(370): n is a, c, g, or t
  misc_feature (380)..(380): n is a, c, g, or t
  misc_feature (410)..(410): n is a, c, g, or t
  misc_feature (418)..(418): n is a, c, g, or t
atgtgtttttcttgttggaagactttcctgaacacaaattagcagactgaaaaagagatggtaatatttacatttgccatttcttttttaattgaaaaactcaaaggaccatatgacagactgagttgtttaacgatattccagaagggcagcatacttggagtgttttaatatgcattcagccgtctcttcctgactggtggggtggttcctgttactcagatggcctgggcagttgggatgggatgttctcaaggtgcttttttcccctccgacctttgctagtgtgtgtgatgtgatgtgttgaaaaccactgtataaacgataagcaccngctactcatttagagtcatggantttcagagctggnaaagaatccntagacggtttcagtgagttatttgactccnccttaccnttaggagatgat

SEQ ID NO: 677847 - DNA, 192 bp, Homo sapiens
ccctattccatggctagatcagaaataggttgagcctgtgttagggtcctcattaggtatccaaaggtagcagctccatcttaccaagttatatcttctgtttacgggggactgctaaacaggttcaagtggcataaactgggacagcctcaaaaagtgttgatgtggcctgcagtgccaccacactccttt

SEQ ID NO: 677848 - DNA, 145 bp, Homo sapiens
catgagactatgtgtagaagatctgtgtggtagggcatgggaagatagaaatcatgatccctgctgatcatacggccacagatacctagtatctatggttattcctcctacttaattctatacaatattctatttatgccaccca

SEQ ID NO: 677849 - DNA, 181 bp, Homo sapiens
gagaccccggcacgctatccggttcaatcaggtgtgacatttacatattatgcaaatgtactttcattggccagagccatcttgtctactccttactgtacatgtggctggcagagaagggaaggtggagctgccatcttgaacagtcttgtccctagtacccatataagttcccagcttg

SEQ ID NO: 677850 - DNA, 885 bp, Homo sapiens
ggggggagaagggtcggggcggcgggacccgggcctggcccgtatgtgtccttggcggctagacataggccgtcgactgatatggtctatcagccacagtcgtctgcatgtttccagagagcaagcagagaaatgaacacactgcaggggccagtgtcatgtcaaagatgtggctgctggagtttcacccaggaggagatggtggcaactggaccctgatgagaagatagcatacggggatgtgatgtggagaactaacagccatctagttctgtgggcgtatgatatatcaccaagaccataacatcatcatggagtggaggtgacggaagtggagcagggagaggagccgggctacatggcatggtgaatttccactgtcaacgatagtccagtacagaaccggctaaggccatcacaccctatgtgatcggaagtcagtccgtcagatttgctctgggccagtggtactgagtcttaagcgctgcggggaaggagttagtagaaacacagtctggatgcttggtgacactaactatggattctaacgcctaacgggactatggagtgggcatctcatagaagtccaggacaaacgggactgtggcgtagacgcagaacacttggacaggcgtacctcttcgcggccgcaacatcgacgcatgtaagatcacgacgtgccgaactaactgagttggaacgtccggattccagggggacgctcgggacaaccggtgtgcacgggggaggcaccattcaccgcacaagtgcgggaaggtgtgacccaagggttgaaccgagggaaacgccacgaccctaccaacaaggacagcagggtaagcaatcaccacggcaagaataggacagaagcgccactcgcggaag

SEQ ID NO: 677851 - DNA, 177 bp, Homo sapiens
tgagtgaggtgacctttcggggcgcgcgcggggcgcggttgtggagggcaagcctttagcacacctccttgcccgtgttggtgcccggcaggatgatgagctgcgtgagctgcgccgcgtgctccttggcgttgagcatcagcgcggatatgatagaggcgcgtctgtctgcggccg

SEQ ID NO: 677852 - DNA, 104 bp, Homo sapiens
aaactagagcatcagtaatatactaatcacaactacgagaaggaaacaatgatgcacttcagtcagggcactgcttacccacatctggacagatgacccatcct

SEQ ID NO: 677853 - DNA, 374 bp, Homo sapiens
  misc_feature (257)..(257): n is a, c, g, or t
  misc_feature (328)..(328): n is a, c, g, or t
  misc_feature (357)..(357): n is a, c, g, or t
tgtcgcccaggctggagtgcattggcgcgatctcggctcactgcaagctccgcctcccgggttcaggccattctcctgcctcagcctcccaagtagctgggactacaggcgcctgcaaccatgcccagctaattttttgtatttttagtagagacgggggtttcgccgtgttagccaggatggtctcgatctcctgatctcatgatccacccgcctcggcctcccaaagtgctgggattacatggcgtgacatcgcngcgcccaggccaagagctccttcttaaccgcacaggcactgtgaggcccagaagactggctctgccaccangaaggaaggattgtttcctttcaaccaancttttgggttgctaacc

SEQ ID NO: 677854 - DNA, 105 bp, Homo sapiens
ggctctcgttgattatgggcgttgattagctaggtagcttacgtggttgaaccttgtttgtcggtgtatatgttgtccttgagattgctcgggggcgtgtctggg

SEQ ID NO: 677855 - DNA, 335 bp, Homo sapiens
acaaggacaacgggccgagacagatacccaaggcttatgcacctctaaggacagggaacgaaaagagaaaaacggtggacaatcaggtcccagatagcttgctcaggcacgaatgaggtaatttcgtgcctaggaatgcaccatcccacagcttgattttcaccacctccatttgttctctcgagcatccttccagatgttactccccgtctaaagccagcatatttaaccttcccgtgacatgcccacctcaggactcatccccctccaggccttcctggatgcagatatactcaaagatggaagctgggcggaagctgatgcaaacattggac

SEQ ID NO: 677856 - DNA, 1465 bp, Homo sapiens
gggctcgctggccgcgtggagtgctgctcccagccgctgcgcgagtcagactcgggtgtggtggtccctgtgcgtgctgtgtatgctgtgctgtgctgtgctgtgtgcgatgcattgtctgttgtgctcttctgtgcattaacaatggtgccccaatggtgttgaatgtgctgctgtgtgtgcctgcctgctggcctttgcctgccctgctgcatgccctgtgtgtgcctgatgtgtgctgtgctgtgtggacctgctgggtttgggatgacctgtgcctggctgcccaatggacaaattgtgatgcaagcttctgaccccacctgtgccttggatgctgctgcctgccaattgctgtgctgctgctgatgcttggatgcactctgctgttattgccaatggactgcccttgaatcttgtgcacaggatcgcatgtgaggcaggactgcttgcaagtttgtgatgcaacatgtccaaatgctcaaatgatgtattgatgtgcctgcctgttggagcatgctcagaggagcgaggcatgactcctgtggctgcagtgcttgatgtgagcaggctgtgaagacccttgatgctgatggagaaccctgtgacagtgcaccaatgtgccaagtggcgccacggtaatcaagagaacaaggccttggccctgtgcaaggctgcttacgaaggtgacccagagcttgaaatggcaatggcatgcagactttcctcaacttgatgtgacgaacattttacctgggaagggcagtgatggacgtccctgtgcaggagccgcaggtgacagccacttgctgggtgaggcccaccggtggaggcggggcagactggcaggctgtggggcacacacgaacgtgtacgcattgcgtggcggaagttggaggtgcccggatgggcccagggggcggccgtcctgccatggggtcccgagctggatactgaaagtgtcagaaacggttagtccggcggaaggccagtgatcccgtgcgatgaaagtgggggccgggagcaccgggcacggagaagcggtcgtagggacagtaccacttaagcgctactggctgtgacaacctatggatagagagggaaagtggtattacgaaggcatttagttgagagagacattggggagagaagtgtgagaggacaatggtgggattaggatagtgattggatagatgggtgggggggaccagctccagaccgacgcgacgccgcgacgcgtccgaggcagacggcagaacagagatgagcggatggggggagcagaccccaggcggggagcgaagacgcaaacgacaagggggagtgaaccccccaccgagtgggcggggaccacgaggaaccgcggacgtcagagatgattgtgcgcacaccgaggagaggaagcgcgagtggagacggagggagcgatgaacatcatggacggagcgatcgggaagcgcacgcc

SEQ ID NO: 677857 - DNA, 210 bp, Homo sapiens
gccatcgctttgttgtgtcatgcactacgcggcatttagtcagctcccccaagatgagctgcagccccagagagagctctgacgtcacaagtaaccaggcccagctccaggccccaatcgccagctctcccgctctggatactgcactctaacactcgactctgctgctcatgggaagaacagaattgctcctgattgaacacaccactg

SEQ ID NO: 677858 - DNA, 792 bp, Homo sapiens
ggacgtgggccaagactagacttatggtggagtgaatgcggcgtacagcagttatccaaccaatgtctgtggatgagtcagtgacgagcctgaggctggtccctcacatgcacggctagatgggcgaaccctgagaggcatcgggctggggtcccgggaggggtgatccgaagagctggtacccaagggcccatggtcctggatccaaaaggttcttgagcagattatggactcaccgtcgccagtgtgtctaccccctcggaggtggtgcctgtaactgtgctggccgtccaggaggtacctgttagagcgatgagccacgcgacacggtgcccaaggctcccctttatgctatgatgtgacgagtctcagatggaggtgtaccaggagaagtgtctaccatggacccagcttgaactctctcgtaatatcaaagatattcttaaagttcggcattcaaatgagaatttccaggggtctcatgtctttacaactgagaaaaggataggccaggggatcctgtgcatagataacgtccacgtgtggggagaccttcttgacagtattgcctttagagaactcccttcagagatagagcgcatccagggagaaagcagagaggcctttacgaggcgggacacgattccttgacctgcgctgtgcacatacgaaggatccctatggggaatatctggttacagaccagcaccttgggaaaccacttttgcgttcccaaataattcccttctcacctctggaatggccgggcttacacgcgaaattccgcatggg

SEQ ID NO: 677859 - DNA, 112 bp, Homo sapiens
ttaaaagtggcgatctttgggcgcgtgtcgtctcatcctttgcggtcactccccaacccagcatcgaggtgtggcgcacccgcgattgctcctgctgcggccctcctctgtg

SEQ ID NO: 677860 - DNA, 100 bp, Homo sapiens
  misc_feature (65)..(65): n is a, c, g, or t
  misc_feature (74)..(74): n is a, c, g, or t
aaagaaaagggaccctttaaaaagggccttagggttgggaaaaacaaggcaaattttaattaccnccccttttnttttgccctttcccctgccccctgcg

SEQ ID NO: 677861 - DNA, 318 bp, Homo sapiens
  misc_feature (313)..(313): n is a, c, g, or t
gattgtgacaggagacagcagggttggaagaatcaggccagtgtggtgccatgtgctcctgtggattggtcctgtctgcctctgcccaccccagggagagggagcacaacctttctgtgcctcaataatgggataataggagtgtctcctcgcaggcttgtcgggaggtctaagtgacagggggcttgtcaacagctggttataggccacagcccacagatgtgaaggttggcaccatccatccatctcccgctgcctgtgccagttacccattgccaatcatttattcccaccaaataaaaaatattctttntacta

SEQ ID NO: 677862 - DNA, 408 bp, Homo sapiens
ttgctgttcggatatgagcaaccagttcggtgggttcttcaaaccagtgggcaaaaaggctggtggagctggcaaggtccccaagtttgccccgaaaggtcagaagggtaaatggatattatcccttatacctgccccccccctttttatcagtggtggaagaacggtttcagaactgtttgtttcaattggccctttaagtttagtagtaaaagactggtttatgattaccatgccttgttaaaccttcagaaggaaaggagaatgttttgtgggcccctttggtttttttttttggggggggcagttttaaggtattagttttttaaatcaggactttttaatgggaaccacttggcccaaaatttgtcccagaatttttgggcccctttaaaaagtttaattgga

SEQ ID NO: 677863 - DNA, 201 bp, Homo sapiens
tgcctagatttccctgcttcagaaatcgcggtcatacccagaaacaatgtttaaactgggcacctggggccagtccaggtgacacataaaaggaaccagcatagaggcaaacgatctctccttcttcatctcttcctcttatctgctgccctgaatttggactgatggctggagctccagcagccatattgggccatgagg

SEQ ID NO: 677864 - DNA, 748 bp, Homo sapiens
  misc_feature (160)..(160): n is a, c, g, or t
  misc_feature (162)..(162): n is a, c, g, or t
  misc_feature (291)..(291): n is a, c, g, or t
  misc_feature (303)..(303): n is a, c, g, or t
  misc_feature (416)..(416): n is a, c, g, or t
  misc_feature (491)..(491): n is a, c, g, or t
  misc_feature (557)..(557): n is a, c, g, or t
atttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgtntnggtgactgtcaaaaggaactttgacaaatgcattgtaagttttcttttttaaaaaaataccttagcatcctagtcattgcaaaatataggtaaatgtatttaaaatcgagggatttccagctttctgtnggggaatctgtngtttatgtccctcgaagcagggcatggcaacaatctacatgaacagagttagttgggtggcactatgccagctagtttccattccacactgtgaatcttggcaagttctggangaagtggcacagtggcaccagttgcttaagagatccactggaggccagacgcagtgactcacacctgtaatgccngcactttttaaggccgaggtgggcagatcacctgaggtcaggagttcgagaccagcctggagaacntggcgaaaccccatctctaccaaaaatacaaaaaaaaaaaaaaaaaaacaaaaaattttggggcgcgctagggccccgaaaaaccttcgaaaccattggtggggcaccgaggcccaaatggtacagggaccaggggcacaagcggtgtccaagaagaaccgcggccaagaacatgggcggggattccccaa

SEQ ID NO: 677865 - DNA, 101 bp, Homo sapiens
ccactggattcatggaaatctttttttttttgggttggtttggttttttaaagacaggttcttgctctgtcacctaggcgggagtgcagtggcttgatctt

SEQ ID NO: 677866 - DNA, 563 bp, Homo sapiens
  misc_feature (160)..(160): n is a, c, g, or t
  misc_feature (162)..(162): n is a, c, g, or t
atttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgtntnggtgactgtcaaaaggaactttgacaaatgcattgtaaccaaataaggcaacatggaacgaagtaaagatctcaacaaaagagtaaacgttggaattcttccattcgttgctgaatctgaagaatttgctggacttgcagaatcaatcttcaaaaatgctgagcgtcgctggagacctggataacagcatacaccaaacttactcagcaggacgtatttcgtctactcgtggagaacagtagcacaatgacaagccagaagacccccagggcatgtggtctatgatcggacaacactttcaccatattctttgcaactctttctcgatcgacaatctcatgtctagaagcagcaacaccacagaagccaaccaaacacaaaaaacccaacacaaccaacaa

SEQ ID NO: 677867 - DNA, 734 bp, Homo sapiens
  misc_feature (160)..(160): n is a, c, g, or t
  misc_feature (162)..(162): n is a, c, g, or t
  misc_feature (291)..(291): n is a, c, g, or t
  misc_feature (303)..(303): n is a, c, g, or t
  misc_feature (416)..(416): n is a, c, g, or t
  misc_feature (491)..(491): n is a, c, g, or t
  misc_feature (557)..(557): n is a, c, g, or t
atttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgtntnggtgactgtcaaaaggaactttgacaaatgcattgtaagttttcttttttaaaaaaataccttagcatcctagtcattgcaaaatataggtaaatgtatttaaaatcgagggatttccagctttctgtnggggaatctgtngtttatgtccctcgaagcagggcatggcaacaatctacatgaacagagttagttgggtggcactatgccagctagtttccattccacactgtgaatcttggcaagttctggangaagtggcacagtggcaccagttgcttaagagatccactggaggccagacgcagtgactcacacctgtaatgccngcactttttaaggccgaggtgggcagatcacctgaggtcaggagttcgagaccagcctggagaacntggcgaaaccccatctctaccaggaatgcaagaattagccgggcgtggtggcacatgcctgtaatcccaactgctcgggaggctgaggcaggagaattgcttgaacctgtgaggtggaggttgcggtgagccaagattgcaccagtgctctccagcctgggtgacaagagtgaagac

SEQ ID NO: 677868 - DNA, 805 bp, Homo sapiens
taccccctcctatagtcttatatgcgctcaaaaaccaaataaaaccccccccccaatgtaacgggggggcagggacaaaagcaaaaacgcaaaaacccagcctgtgagacccccacgtttctcttgccccccgccattttaattccgccctgtgattgtgatttttgtttttcactcttgctcccttgtggctggggtaagagtgagatgtgtggagcctcttcctgtggggggcacgggccactgtgacgcccccttggtgaaaacgtcagaggggattttggaaagggccatgtgtctccggcctgtggttatctgtggggacaagtgtgttgtggtctccccaagaaagtctccgtgaagggcggtaaggggggaggttgggggcagggactctctccttccggggtgttcaggagggatgcctcgggaggcccacagggaggggtgcctctcgttggtgtggccgagagggtctgcgccgcgtagtggcgaggggtgtcaaccacgcgtgttgttgtaaccggggggtgtcccatcagggttcgggggcagggtggggccgctcttccgcgcgacacctgtgtaggagacaccccctacaccgcatatctaccgctgcggtgtgagaatatgttgaccacgcaccactaagaacacccatgcccatgatctcacagggaagggtcgcagaagctcgtggtgtggaccccctgtggtgcgacagtgggggattaagcacgggaaaataggaagccaggcgggatggagaccccaaaagatggaagtcgaggttttccaagag

SEQ ID NO: 677869 - DNA, 1290 bp, Homo sapiens
ccatgaaacaacgcaccaaataaaaacaagcaaacaaacaaacagcaaacaagagacaaaaaacacgaccaaacaccacaacaaaaataaagaaaaacagaaaataggacaagaaacacgaagcaacggaacaatgacagacaacagaacaacaaactacacagaacaaccagacaggacgaagaacgaggacaaaaggaagcacacagaccacaagggacaagagagagacacaacgggtgtacagcaagtgggaagaaacatcaacaacaaacgaatacacacagcacgacgcggacagtagacaagagaaacaaaagaaccacacagaataacgacacgagacaacaacaaacaggccaacaacagaagcagacacagacacaaacggttgagaacgggcacaaagagagaacagacagatagggacacagcgcagaacgcacggggcacgcaagacgtaacaacaaacagagcgacagaaggatcagaacgtaggacacggaggccacagggacgcgaccaccagaaggtccacacagtcggcacaccacccggcacaactgagcccacagacgaccgagaacaccaagataggagagacagcagctaggagcgccacgaaggacaggagcgagcaaaaccagacaaccagaaaaactgaacaccaactgacaaccatgtgggcacaagcacacgtaaacaccaaagacgcgactcaactggccacaaacaaaggaaacaaaccgaaacgaacgcagcgatcaagaacaggcgcgacaccggggaaacacccacgacacacggacgcccgacgcgatgagcaaccacacgccaagcaacactagctgcacaccgcccagacacaccacgggaccaacacgcagcactccacaagaccaccacacgcagagacaaacccctgacaaacagaagggaaccccgaccaacgcacaacaccgccacaccaccatccacaggcgaccacgaagccgcacagagtagccacagcaagcatgcacacacacgcggcccagaagcaatccagcaagcgccccatcgtacacaccagtgacagacgaccgtagccacacacaacccgccgacactagacgagagagccaagcacaaaactacacacaacggaagccaacaaccccgacacgagcgaacacagtaggacagcacacagacgaggagcaaaacccagagatcgacacacggagcagaagacacaaccaatacgagcagataagaatgcgcgccacgcgcagaacaaccgcagaacaa

SEQ ID NO: 677870 - DNA, 895 bp, Homo sapiens
gatcggagtcaagatggaggagtacgcgcgagagccttgcccatgggaatgtgtggatgactgtggtggggccttaacgatgggtaccattggtgcgtggtatctttcaagcaatcacaggttttcgcacttctccagtgggagtagaccacagactacgagggagtttgacagttattaaagccagggctccacagtctaggaggtagcttggcagtccggggagggctgtttccatgatgtgactgtagtatggtgcaaagtcagaggacaggacgatccctggaaattccatcacaagtggtgccttagcgggagcatactggagcaagagattggaccagtgccatggtggggtcagcccgcaatgggtgcatatcgtaagcttaaatcgaaggagctggtatctgtgtggacaagattgtgcctctgcgaagttgtcccaatgtcctcagttggcagaagacccctccagttgcattcaactcagtgacttcctcaccttgtgagatatcgcaatatcaggcaggatgtctcgcctagggattggtgacgcagaaagagtggggccgacaaggattcaggaagatccagggtgccaggcagggctaaaaccatagcggaccagaaaggcgaaaggcagaagacgcccattagactccgcgcatctgacagacccacgcgcggacgcggccaagagaaacacggtactaaacccacctgatggcttgcgccacacaacgtgaaaccgacagaacacggcacgcgcagatgaggccagcaaaagggaaggacaactggagctgacgggtgggcgagccacagagggggcaccctaaacgggagggaggcaagtaggagaccacccacgacgaggggagaaaagcgtgcgcgc

SEQ ID NO: 677871 - DNA, 146 bp, Homo sapiens
caaggggggggggcccctgggggggggggggaaagttttcccccccccttcccggggagggggaaggaaaaaaattttgggggggggggggggccaaaaggatccccccccccccggttttcccccttttttttttttttttttta

SEQ ID NO: 677872 - DNA, 250 bp, Homo sapiens
aaaaaccttactttttgtttaatttgttttgtccaaacaaacacagcttgctaaaactttagcttctgactaattgctacagctaaaatagctaatttgctaaccagcttagctcaaacaaaacagctgctataactagcttccttgcagtctgatctcatcatgcagtcatcagatcctgtaatcgctctggaatagtctagagcagagcacagatacagtcatcagatccagctgcactgagagcata

SEQ ID NO: 677873 - DNA, 397 bp, Homo sapiens
attcgcggccgcgtcgacgtaaataaattgctttatattaaatttacatttcataaagaaagggaggtttttagaaaatatgatatcaactggccacagtggctcacacctgtaatgccagcactttgggaggctgcggcgggtggatcacctaaggtcaggagtttaagaccagcctgaccaacatggtgaaaccctgtgtctactaaaaatacagaattagcctggcatggtggtatgcccctgtaatcccagctactcacgaggctgaggccagagaatcacttgaactcaagaggcggaggttgcagtgagtcgtgccattggactccagcctgggcggtaacaagagcaaaactgcatctccaaaaaaaaagcagcctgaccaacatggtga

SEQ ID NO: 677874 - DNA, 836 bp, Homo sapiens
  misc_feature (191)..(191): n is a, c, g, or t
  misc_feature (262)..(262): n is a, c, g, or t
ccggttatatttctcccacagagcccccgcgttgggcgccgaaaaaacacaggtgtttctctaacataggggcgaaacggacatagtgcttctgataggtgattggtggctcgttggccgcccccccccccccgcatagagattaattaccgcgggagagtttatattatcaagagaaaggggtccctacnttttattacgcgcccgcacgcacacacaccttgttgggcgcccatacgcacactggcgcgctctgtgtggncaacacactcaggcatagcgcgcgcccacacattataagcgaacacacatcggttagtactgttttcgtcgcccgcacatattatagtgggactcgtgcccggcccccctctttgaccacgcaatgggttgatgcataaatgcggggggacccacacccacatggtgctttttgtggcagcaggagcaacccgacaggagatccatctgtgcttgttcgacacccacggaataggactggtgtccactacttctgctcttaaaaccttgcccgcacaaactgagttctgttcctcgcctggagcaacctaatgcgtgggagaccgtcacttcttctcggagataaaacatttactgtgcccacttgccaccaggcccgatcaataatctaccgctgttttattactgatagtgcccacagactccactgtcttttttatttccagagctaactcctccctgatagcagccccaccttcatggcccacatgcactgcgtgatagcaggaactcgttccaaattcaaaatttataaagtccacagttcctccctccaaatactgatcattaaacac

SEQ ID NO: 677875 - DNA, 265 bp, Homo sapiens
ttgagtaatctatttcagtacattttgcacgatgacattctgaagaaagatccgaagagctgcgtctagcatccaatgtaaattggccagttctcccacatctgggcacagagtggaatttccttcaaggttcacaagactgtgacaactacagtagctgatatacttggatataccacttctacgctgcccccaccccccagaatcaattttttggctccaaaataaagtacaataataaactcttgatgagaaatgggcttcg

SEQ ID NO: 677876 - DNA, 502 bp, Homo sapiens
  misc_feature (305)..(305): n is a, c, g, or t
tgcaacctgttctcgattccagtcattttgtgtgtccagggcctggcagcgacgctaggctttttggccgacccttataatacaaaaaaccacaagattgtctgcataacgagcccgcagtttctctttgaaggcaggtttttgttgtgagtagtagcttccgcgcgcccccggttcctccatccgacgagattgatctcgttgcgctttttcaggctatctggaagcagaaaaggttagtcatggccgctacggcaggcgccgggcttattgctgcgatctacgcgtttctcgcgcctcctcantatgaagtcagcagtgtgttgcgcccggccgcaatcaatgagctggatgctttgaatcgctccgagatatatacacttcctcccggtgatgctcttgtcagagtgggcgcgtcattggaatcctacgatactcgcttgggtttttttcgttcgaaccagaagctgttcaaggcttttgagcagcctggcaggacctt

SEQ ID NO: 677877 - DNA, 620 bp, Homo sapiens
agagatcgtaccaagaaactgacgtatgctgcgacattggatcttagattccagcctgcagaattgttagaaaataaattgtctatcgtttaagccaccagtctgtagtattttgttatggcagtccaagccgactaagttacggtacccaggcgtgagatgctgcgacaacaaatacctaatcatggtcatatgtgttaggaaattggtgatgggtaaaggctggaagagattgaggtcatactagaaaaagccaattgtgaagggactattgaaagaaatatggacattaaaggcaattctggcaaaggctcagaaaggaagagagctggacagaaagcttccattttcatagaaacttagatttataacgatcatggatagaatattaaatatgctggttaaaatatggactttaggccaggcgtggtggctcacgctggtaatcccaacactttggaagactgaggagggcagatcacttgagctcaggagtaagagaccagcctaggcaacatgtcaaaaccccatctctataaacaacaacaaaaaattagccggggtgtggtggtgcatacatgtagtcccagctacttaggaggctgaaggtgggaggattg

SEQ ID NO: 677878 - DNA, 1945 bp, Homo sapiens
  misc_feature (1110)..(1110): n is a, c, g, or t
ggcgcggagccctgtgtccccacggtggcagaagggtggtggaggtgctgaacgcggagggggcggagggagccctgcggctggcggcagaagatacagcgaaaatgggcaggaaacgggtggttgacacccgggcgactgatcaccaaaggcgcgcagacacttgactgaccgccctaaggggaacccccaaaggaaattcctcgacgatcgattgtgaagcaacccggaccaaacgggctgggcgcagtcgggcagggcggcccggtttccaccattttaacagacaactcggggctccacgcacaaattcttcccttattgtcacaacgccttgacaggacacttctacggtggtacagacacgcaacagcactacgagctgacacctttgcgacacttgcctgaccaaaggtggaccttcaaccacaaagcagaacgacagcccagcggttcgtaaagatccccacgcggactcccgtgtggaaaacaaggccggatgaagaggcagggatcacaaggcctccactttaacacgcaagggcacgacgtggactgcgcaacatacatgggaacgagccaccaatttcatcatgggcggcacacgcaacaaccgacgggtgctcggacaccaggttcaatataccacccagcgcccgggagagaaccactccgtgctggcacaagaaaacggaaactgttgggtctttacagcagttggttgtcaccacagcatgtacaatataattgttaaagaggttatcatccagttctaaataaggaacgtggcgtgaatttgggcaaggaaggagcaaacgagggtaattattaacctgattgatatgccgccgtgtgaaaacgttaacctataggagtgggggcgacaacgggtatacagcgcgtaggagataccaaccctatatcatccagtgggttgtgtaaggggcgagcaaggattctcggtgtaaaaagcccaacaggacataaaacgacttggagacaagtggcgaacacacatgtgtctgtctgatgggcgaataatgtatactctctctcttctttttgatctccctttttcttcctctgttatgcatcctgttgctgcttgtncaagacgtagacgacacaccgaagaagaaagaaagaacctagacaaatagcgagtacgataagatgacgacacaatcgacttgacaaacacgcaacgaagaggaggatgggaagaaacgggggaggaagcagagacagagaagctgagaacagccgacaggagacagagcgagcgaacagacgaagagaggcggacagcaggaggagagagacgaccagcgaaagagaagagagagcgagggagagagagggagaggagaggagacggagacagagagcaaagagaaaggagaaggagcgagagaggaaagcagagcgagagagaagaagacgagggcaaagcaagaagggacacgaaccgcagcacgcgcagagaaagcacggagagagagagcaagccaacagagaagcaagcgacgacagaagaagagaggaggagagaagagaagagagcatagagagaggagagcaaggaaggacaagaagaggagagaagacaggggagagaataggaagaggagcgagaagaaaagaaaagcagcaaaaccaggaagcgagcacacagcaggacgcgagaagagaagaagagacacacaaagagccgagcaaggagcggagaaaaacagcaggaagcaagacgaaagagaagagaacagagaggagcagagacgagggaaaagaaggggaagagaaggaacggagaaacggaggagaggagaggagagagaggaagtaaagcacgagacgggccacgcgaagggaaggagacgagaaggcgaaagcggcagaagagagaggcagaagacggcaggagaagaagagagaaaggacaacc

SEQ ID NO: 677879 - DNA, 294 bp, Homo sapiens
aatatttcttcggcactatgtctgttagaaacgttttctcttaaggttgaaattaatgtattttcctctaagagaaatataaatacttattgcctatttaacctttggtaatatatattacaaagtgtgtggttgttttaattatctgaataaactttgtgatagagggagggcataatttactatgcctgctaacacaccagctggtagttacttagtattattacactgagttggagtgggatgaaaaactatgaggggctcaacagctggaggtctagtccacttaatttt

SEQ ID NO: 677880 - DNA, 438 bp, Homo sapiens
tgaacactatacaatgatttctaacggccctgacacaactcctccatcccaacttttcatcccttttattcttctgcaggcttcattctaacataccaattggtcagaatatctatcaaatcttgaccacgtaaagcaccccactataaaccctataatctgccatttcactctcaaacatcccaatgaaatgactgcatcaaggacatggatccaccgttctgtcattgttcgggccttcttctaccgtcttctcattgtagagaatttctttttcttcctccttctggagcctcagaacgttctggatttagaagcgataggcattgtaccactgggagcagtacatccttgaggacgttcatctgacccatcttggacttcaatgtccgccgcggctacctctctgtgaccctcatctacatcgcctccgtcagc

SEQ ID NO: 677881 - DNA, 1277 bp, Homo sapiens
  misc_feature (430)..(430): n is a, c, g, or t
gcgcataatcgccatgtgatgacttccaacctggtcatcggaagtcctgactgcctcacgtccgagtccttcgctatacatacttgtgattcaatcactgccagagcggcggaatgcgcgatgtagcttcataagaggcatagatgaaagcggattgtcagagaaggaccgatggagacgttgtctgcgtcaaggacgacgcctgatgggccgagaaggtcctgaggatcaagcatgatagtgtggacgtcgccgcgatgctttgagtcctacatgcatgcagtcagacgtgatcactcacggtgattcgcagaagtgccctgtcgcatgcgaatcttcccgatagcctcgcatgtcgagttcagcactgcgtcccaaagtacaaggtggcggtccccgcgcgtcttgactgattgtcacttcatacctngagaccactctgaacccagtacaagggtggcatatagacgttgacagagccgcctacattcggaatccgtgtgcgtcgcaggagcaaattggcagagcatccaaaaagggttgattgagcccgccgtgtagtgcacacacttaggatccctagtcgggatcaaattcctatggtctccaaaacggagacatttctcacagacatttgagaacggaaggccaacccggacgccggcaccgcaaggctatgccccattgggaatctaccaatggacgtatgaccgcaaaaagttagcagatgtgcgacctccccgttgattccaattggtagcctcgcttagccaccagctcctaggtaacaccaaacagaaaatctaggagacgaggatacgagcccatgtttcttagagggggaaccgctctcgagaggcccgatccatagactccgatggcgcccctttttagcgttttcattgctagggtgagtttcgaactgccctgaactgcattacgccaacagaaacgctccaagaaccagcagagtgcaacaacggtaaccccccttgggtgaaacccaccggcgggtaattcggggcgcctttctttgaaccgccaaagaggaaagggggcaagctacacgacgaagagggctgccaccaaattccttaccagggctgttagtggtaaccaaacgtggaatgccagggaaagttattccgccaacgggcacggaagaccctcttatgggtccgaaccccttacactgtggcatagtttgtttacagaggccggattcactacttaggaagacattccaattcgccgaaagagtgggttccccacaggaa

SEQ ID NO: 677882 - DNA, 80 bp, Homo sapiens
tcaagcttcttaacgaatgtacggggaccatgataatttctttgtatataaaataaacatttgaaaaaaccgaaaaaaaa

SEQ ID NO: 677883 - DNA, 194 bp, Homo sapiens
  misc_feature (96)..(96): n is a, c, g, or t
tgagaggatcccccgatttatccccaacacccagctgaatttatcttttttcagatatctttttaggttgttttaatggcagttaatggggagagnttagatgctagtatttaatacatcatcatgaactagacatgacacattcttcagactgagtgtaatgtgttggcgataacatcacgggacctctagaa

SEQ ID NO: 677884 - DNA, 160 bp, Homo sapiens
  misc_feature (129)..(129): n is a, c, g, or t
  misc_feature (154)..(154): n is a, c, g, or t
gagagtgagaggggcctctctcaccgcttggttttgctgagtctgctggggctcagtcctgaagtctggggtggagaaagtgcctccagcacgtggtgctggcccttcctggcagaaactgcttgaacnatgtgttttgtcgtctccgtgccantcttac

SEQ ID NO: 677885 - DNA, 448 bp, Homo sapiens
  misc_feature (95)..(95): n is a, c, g, or t
  misc_feature (219)..(219): n is a, c, g, or t
  misc_feature (235)..(235): n is a, c, g, or t
  misc_feature (269)..(269): n is a, c, g, or t
  misc_feature (405)..(405): n is a, c, g, or t
  misc_feature (430)..(430): n is a, c, g, or t
aacaacaggcaataagagaacctatcaggccggggcggagccatgcctgtaatcccatcacttcctgaggccaagacaggaggatttcttgagcntaggagttggagaccagcttaggcaacataaggagactccgtttctatttaagattaacaaacaggccgggcgcggtggctcacgcctgtaatcccagcagggaggccgaggcgggcggatcanttgaggtcaggagttngagaccagcctggccaacatggtgaaaccccatntttgctaaaaatataaaaattacccgggcgttggtggcacgaacctgtaatcccagctactcaggagattgaggcctgagaatagcttgaatcggggaggcggaggttgcagtgagccgagatccggccgttgcantccagcctcggcaacagagcgagantccgtttcataaataaat

SEQ ID NO: 677886 - DNA, 344 bp, Homo sapiens
  misc_feature (344)..(344): n is a, c, g, or t
tgtggtggctcatgcctgtaatctcagcactctgggaagctgaggcgggcagatcaccaggtcaagagattgagaccatcctggtcaacacggtgaaaccccatctctaccaaaaatacagctagcttaggcctaaagagtcaggatcatcaagatcattgttttccatctccatatcttgccacactggaaggtcttcaagggcaataacatatatggagctgtcatctcctatgataacaatgccttcttttagaatacttcctgaaggacctgcctgaggcagctttacagtttattttcttcgtagagagtacactgtaggccaggcgcagtggctctgn

SEQ ID NO: 677887 - DNA, 202 bp, Homo sapiens
gttaattatggattccggtttacaaggaacacgcgtcggcgcgtttgaagtgtcaagaaaacatgcccggttttatggtcaacgttgcccatggcacaaggtaatggattatggaggatttaatcccatttggtgcaaagcgacccgttaaggaaaataacggggtaacactcgagacagaagtacgtattataggagaaag

SEQ ID NO: 677888 - DNA, 344 bp, Homo sapiens
  misc_feature (117)..(117): n is a, c, g, or t
ggctgatgcctgtaatcccagcactttgggaggccaaggcaggaggatcacttgaagccaggaatttgaaaccagcctgggcaacatggtgaaaccctgtctctacaaaagaataanaaatgagctgggtatggtggtgtgtgcctgtaaccccagccacttggggggctgaggtgggaggattacttgagcctgggcggtcaaggctacaatgagctgtgactgcatcactatgttacagtgagaccctctcttcaggaaagaataaaaattaaaaaacaacatctggtccatgggttccatcaaacaagtgctatttcctttttgtcttgttcataaaaact

SEQ ID NO: 677889 - DNA, 415 bp, Homo sapiens
  misc_feature (204)..(204): n is a, c, g, or t
  misc_feature (291)..(291): n is a, c, g, or t
  misc_feature (413)..(413): n is a, c, g, or t
gaacactccacaaaatgatccccattttcctttgtcctcccctgcctcagtgttccctttccctaaccccccatgatgccttcccctttccctgccctctgacatggtcacattcagcaaaaacaccttaggggttgggtgtggtggtttatgcctgtaatcccggcactttgggaggccaagacaggaggatcgccttgagtnccaagagtttgagactagccctggcaacatagtgagaccccatctatacaaaaaataaaaacattagctgagcatagtggcgcacancactgagtccctgcaactccagaggctgaggtgggaggatcacttgaacctgggaggtggaggacgcaatgagctgagaccacaccattgcagtccagcttgggtgacaaagtgataccctnaa

SEQ ID NO: 677890 - DNA, 315 bp, Homo sapiens
tctttattttaattatggtagggtaccaattcagagtaattatggattagggggctccaacttaggtaacggggggaaaaaaagttccttacagggaacatcaagagtcacgggggtatgtggctcaggagctagcagggtttctcctcggctcagccacggtccactaaagccacattccaaatacacatcaccaagttaccacccagcagatctgatccgggggcaccaaaaggcctcagcagtaagtacccaggggccagagaagctccagaatggaacaagcccaggaagcacaacaaggtagggcacaga

SEQ ID NO: 677891 - DNA, 677 bp, Homo sapiens
  misc_feature (15)..(15): n is a, c, g, or t
  misc_feature (63)..(63): n is a, c, g, or t
  misc_feature (102)..(102): n is a, c, g, or t
  misc_feature (125)..(125): n is a, c, g, or t
  misc_feature (175)..(175): n is a, c, g, or t
  misc_feature (187)..(187): n is a, c, g, or t
  misc_feature (213)..(213): n is a, c, g, or t
  misc_feature (221)..(221): n is a, c, g, or t
  misc_feature (232)..(232): n is a, c, g, or t
  misc_feature (239)..(239): n is a, c, g, or t
  misc_feature (266)..(266): n is a, c, g, or t
  misc_feature (282)..(282): n is a, c, g, or t
  misc_feature (288)..(288): n is a, c, g, or t
  misc_feature (295)..(295): n is a, c, g, or t
  misc_feature (358)..(358): n is a, c, g, or t
  misc_feature (366)..(366): n is a, c, g, or t
  misc_feature (379)..(379): n is a, c, g, or t
  misc_feature (385)..(385): n is a, c, g, or t
  misc_feature (408)..(408): n is a, c, g, or t
  misc_feature (415)..(415): n is a, c, g, or t
  misc_feature (417)..(417): n is a, c, g, or t
  misc_feature (552)..(552): n is a, c, g, or t
  misc_feature (574)..(574): n is a, c, g, or t
  misc_feature (585)..(585): n is a, c, g, or t
  misc_feature (597)..(597): n is a, c, g, or t
  misc_feature (674)..(674): n is a, c, g, or t
ttttttatataaacngggttttttagggataatttatacacagaaagtcattttatgtaacanattggccatgttattacctttttttttcttacttaaaanaatttttttttaacaagaaaacncagaaaatgcattatttgcggggcatccattccatcccgccttcggggtnggttttttttancccagacaagggggtacccggggggngacaaacncgggcaaaccnccccccncacccccacgggcgtaggaggcggacnggggttttcaccgggnggcgcngccgacnggggggggggggggggcgcgcgcaaacatccaaatgaaaagtggggaacaaaacccaaatggnttccgggncgttccccgatgnggcgcnaaaaccccggggggttcccaggnggggggnangggggggggggggagacatggccaacaatccactggagttagaggaagtggagtcaactttaaaaccaatttttgtgtatgttatagtttttattaaaaattcttttctgtattggaaatacgtatctgcggggntctgccttaaataaaatagggnctcttctgtgntctaacaatgcngtattcaatcatgatacgaggcatgtaagcaaatggcctgtgtgccccatagctgtcatcgcttatgtgatcactgngca

SEQ ID NO: 677892 - DNA, 299 bp, Homo sapiens
  misc_feature (57)..(57): n is a, c, g, or t
  misc_feature (296)..(296): n is a, c, g, or t
ggaaacccaaaatacagagtagctgtctatgtgaattgaaatgctcaatgagcctgngcttaggcagttataaaaggcattgtgcaaattttatttttttaaaaatgtcatttccaccaactaattttcaagtctcttcttgtacctagatcacttgactgctcagagaactggttttaaacagtagccaagatgtatgtaggtagggaaatgacttggggtataaggaacgattatggaccaataatggatggatgggtgatggatggaaacctggggcactttattaggaaggnatc

SEQ ID NO: 677893 - DNA, 392 bp, Homo sapiens
ttaaataatcaacaccctcctaccttactactaataattattacatttaagactaccacaacctcaatcgagctacatagaaaaaatccatgcccttactgagtgcggcttcaaccctatatcccccgcccgctatccctttctccattaaaaattcttcttcatatatctattaccttcttattatttgatctataaattgccctccttttatccctaccatgagccctacgaacaactaacctgccgactaattagtattatgtccatcccctctttatttatgtcgatcgatccctagccctaagctcctggcctatgcagtgacttacaacacaatggattacgcacttgagcccgtaataaccatatagatacataacaccaaaaga

SEQ ID NO: 677894 - DNA, 841 bp, Homo sapiens
gttacatttcctgttgtgcaactatcacttctgtttccaaaactgtttcatcatcataaacagaaactttgtactcattaagcagtaactcctcatttctcctccctctagcccctgctcacatctaagctactttctgtatctgagtttgcctgttctagatatttcatataactggaatcgttcaatgtttgtccctttgtgcctggtttctttcacttagcatagtgttttcaaagttcattcatagtgtagcatgtgtcagaactttattccttttatggggctgaatgatattccattgggtggatgtgccacatattaaagtaagtaaagtaatgagatggagtcttgctctgttgccaggctggagtgtagtggcatgatcttggctcactgcaacctctgacccctgggttcaagtgattctcctgcctcagcctcccaagtagctgggactacaggcatgcacaacaaacccaggtaatttcgtatttagtagagacgggttttcaccatgttggccaggatggtctcgatctcttgaccttgtgatctgcccactcggcctccggaaagtgtgggattacaggcgtgagccaccgacccagcctcactgtgatttgatctggatttccttcatgactaatgatgtagcccatctttactggtgcatggtggccatcttatagaattcttcacttggcagaaaatggtctaattcagggtccctttggaccatttttacaaatagggtaggtgaatctaacaggatgctagaagtttagaaaattctatcaatattcctggatatcacttaacaatgactccaagaatataa

SEQ ID NO: 677895 - DNA, 289 bp, Homo sapiens
ctggcaaccacgcatggcggaccttgatcatggacacacatagaggctctgcagtccccattttcatggtctgttcttttatgtaggattcactagcattattccacatatctccagatcagactccataggaatccctgtacatcaaatcattctcaatgggtagtataatacaataaattctcgattacagtgattgtccaatgctcaatgttagttaacaccctatgcaatggttatagcctgggtcccaccgctctcgttccctctcctctcatttcttcctttt

SEQ ID NO: 677896 - DNA, 372 bp, Homo sapiens
  misc_feature (125)..(125): n is a, c, g, or t
  misc_feature (133)..(133): n is a, c, g, or t
  misc_feature (144)..(145): n is a, c, g, or t
  misc_feature (151)..(151): n is a, c, g, or t
  misc_feature (166)..(166): n is a, c, g, or t
  misc_feature (169)..(169): n is a, c, g, or t
  misc_feature (173)..(173): n is a, c, g, or t
  misc_feature (178)..(178): n is a, c, g, or t
  misc_feature (189)..(193): n is a, c, g, or t
  misc_feature (211)..(211): n is a, c, g, or t
  misc_feature (213)..(213): n is a, c, g, or t
tcaggccgcaccatctgagacccctcctctgagaggcagggcacagacagggccgaggggcagtggagatgggaacaggaggggggctcagaccatgaaaacattggagaatcttagcgggactntggcctgntccatacaganntcgtanttgcttagatatgcntantgtnttcanccaattttgtnnnnntgtgcgtgtgtgtgcgcntntgtgtgagcaggtgggcgcttgcgtgtgcaacgtgtgcgctgcgtgtttgtctgctgtcacctgtgttcatgtatgcgctgcgcatgagtgtgtgttctgtgtcaggaagtgtctactgtggttatgtagtgttggctgcaagtttttttaccctcagg

SEQ ID NO: 677897 - DNA, 137 bp, Homo sapiens
acgctgcaccgccgtcaaagttaagaacgggaagaatgggtggcacggtggctcctggaagagctcacccagcgcagttccttgagctcgggcgcttggtttcgtgtccctggggatatatatatttaataaatttt

SEQ ID NO: 677898 - DNA, 441 bp, Homo sapiens
  misc_feature (36)..(36): n is a, c, g, or t
ggcggcggcggcgcgggtcggcaacgggagggcgcncggccgagcggaggcggagttggcgccgagaacatgtttcctgtgggccgcatccacagacacttgaagactcgccccccaagccatggaagggtgggggcccctgcttccgtgtacagtgctgcgattttggagtacctccctgcaaaggggtgatccctcccatccccaaatttttgattggaaaaaaggggcagcagaaaactgcttagagggatgctttaacccaccctcttcctccccgtcattgtactgtaactggggcagaaaaaataatggggatatgtagaattttttaccaccgtttaatggaaaagcatagaccatttctgtagacatgataaaaaaaacctttgtatgtttttagactcgaagtttgataaaaggaccctttcatgtggtgga

SEQ ID NO: 677899 - DNA, 286 bp, Homo sapiens
  misc_feature (40)..(40): n is a, c, g, or t
  misc_feature (123)..(123): n is a, c, g, or t
  misc_feature (255)..(256): n is a, c, g, or t
cccgccgtaccagttgcgaggtctgattgagctgatctgntctcccacatacagtagcttccaggcattcgctccagtcacaagtacatgtttgaactgatgtaaagccaggacacttcactngtaactaacttcaactaaaaacagcaatgttttctctctcccttactttcatgtaggctattttttctttgatcatatcagaaactctattttcccatgtgctctgtaatttattcatctgttctgcctctnntgcaccacggtccgcaactggtacggcggg

SEQ ID NO: 677900 - DNA, 258 bp, Homo sapiens
gaagttgtcgttgccagtggggcacagttagaacgtgattgtgcacggattgtgcttgatgctgaatgttcaggcgagcccttttgtcgccgcgacgaaaaagcaagccgaacaactcgatatcagcgttcgtaaggagcgtttcaatgctggtcagcagactgttaagttgagtgaacaagccttgcaacctaaacaagcggcgttggataactccgccaaaatgatagtttggaaaaaataaggtgttgcaaaagg

SEQ ID NO: 677901 - DNA, 577 bp, Homo sapiens
  misc_feature (23)..(23): n is a, c, g, or t
ttcggtgtaccccctcgggttanttgatgcgcgcttaagtaactagtccgtgttcgagggccgccgtatttttttgcgttggtggggcggcgacatgacggggtacactccggatgagaaactgcggctgcagcagctgcgagagctgagaagtgcgatggctgaaggaccagtgagctgagccctcggtgagccggatgctgaccccacagaagatgggtgcctatggagaggttctggaataaattttggagaataaatccgccttggaggaaaatggctccatggggtatacaaaaagagtatacttatgtaaacactacatgtactatgtaccttgtctggattattcattattaacatgaagtatcatgtttctgacaagaaccatatggcatacgttcgaagcagaagtccagaatatatccctggtgactacaattctgggagacttggcagacaggtaagtcacaaccaactgaaagaattttcctgcatcgaaagatcattcaaaggattatgtagaacaagttaaaaggcttattgagcctagagtatagtacctactattaccaaa

SEQ ID NO: 677902 - DNA, 893 bp, Homo sapiens
  misc_feature (150)..(150): n is a, c, g, or t
  misc_feature (691)..(691): n is a, c, g, or t
  misc_feature (744)..(744): n is a, c, g, or t
  misc_feature (755)..(755): n is a, c, g, or t
  misc_feature (787)..(787): n is a, c, g, or t
  misc_feature (791)..(791): n is a, c, g, or t
  misc_feature (800)..(800): n is a, c, g, or t
  misc_feature (809)..(809): n is a, c, g, or t
gcccctcccaccttctacctatgtggagtttacagtgtctggcactgactgtgttgctaaagaggccacagaggcagccaagtgtaacctgctggcagaaaagcaatatggctgttgtaaggcaacactcagtgagaagcttggtggggnagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttgccgtcattccncacaggacagaggcagagtgggtggtgggtatgtttgacagaaggcattaggntgacaacttgncatgattttgacggtaagccacatgatgggtntctnctctgttgnccttcaaancattggactgtgatttgaaggtgctttgtagctatatgtgctgtaatgaagtgctgaagacttctataaaaaggtctagcgaaa

SEQ ID NO: 677903 - DNA, 943 bp, Homo sapiens
gcgcaggcatttagcttctagttgtttttggcattctgcctggagaggaaagaattttcctgatgtcataaaataccagaacaagtttttagcttaattgtaaacaataattttgtgccaagaaaatgaaatctcagaaatacaatttttgacctaaaatggccacctagttagaataattactgatttacttttagataacattatttatttagaaattttactatctaggtatagagaaaaacatgacaacttccctttcctctccctgccatacttttgtttatgcattgtgagatcaaaaactagtgagcacagtaaaggaggataatttcagattatccttttctcattctgcattttaaatcaggtttgtccatcacttccatataaacggggctatgaagtaagactattttaaattgctaattgataacacaaaaaactttaacttgtactgtaataggggattttcaacttttaacatcaggactaagttatttcattattagttgaggcgtcccaaaatactggcgtttcaaatcactgtagctatgaaaacttgtaatcccttggattcctttattacatttacacatcaaactttgcctagtgagaagatatactccttcaaaatatagtcaacgcagtgaactgacgtactgagcgaaatgaacacacaattaaaagtaagacaagcagagcagaacggtacatcatacgaaggggataaggcaccacaaaacgacaaaacgcagaagacaataacacgagaaccactaacagccatgcccaacaaaatggacacgatagaagatcggcagggacatagaacgacaaggtgagggacccacgagagaccacggtacgcagaacacgtaaacataacgaaagcaaagaaaaaatacagggacagacaccacgtagacgcaaacaccagaga

SEQ ID NO: 677904 - DNA, 831 bp, Homo sapiens
tggaggatgaaagcgccaaggtcaagaccatgatcgtggcgggcgtgtgtgtgcctgctcggatcggccttatggtgactaagtgccggacgtaatggacggcccagaacatcactccaatggacttctacaatccgctgttggcctccgtgtcgaaagcgaggagatgggtgcctctctctacgtcggctgggccgcctccgcgcctgcttgctccttgtgccggggggctgctttgctgccaaactgtccaccccgcagcagacgaagccttactccgccaagtattctgctgtcccgctctgctgctgccagcaactacgtgtaaggtgccacggctccactctgttcctctctgcttgttcttccctggactgagctcagcgcaaggcttgtgaccccaggagggccctgccacggagccactggcatgcttggggactcggcggactggccagagactgagccaggcaggacggcagaagcttgagccctctctggcccactcggacaagttcccaaggccgctcctgctagcaagaaccagagtccaccctcctctggatatcggggagggacgcgacagtgaccaggtgtggtaggcggagatggggaggctgggcttcttgcgtggccagagatggttaacccctgactttgggatctgcctgaatcggtgttggacactgtccccattaccatttacccactactgtctgcttgaattcctctggtgcggcaggcttgaataccttggacgggcctggccaccgaaccggccacgaaatggtgagctgccaaccctcgcggagccccccacgcggcaacaga

SEQ ID NO: 677905 - DNA, 985 bp, Homo sapiens
  misc_feature (574)..(574): n is a, c, g, or t
  misc_feature (627)..(627): n is a, c, g, or t
  misc_feature (638)..(638): n is a, c, g, or t
  misc_feature (670)..(670): n is a, c, g, or t
  misc_feature (674)..(674): n is a, c, g, or t
  misc_feature (683)..(683): n is a, c, g, or t
  misc_feature (692)..(692): n is a, c, g, or t
  misc_feature (874)..(874): n is a, c, g, or t
  misc_feature (931)..(931): n is a, c, g, or t
gcccctcccaccttctacctatgtggagtttacagtgtctggcactgactgtgttgctaaagaggccacagaggcagccaagtgtaacctgctggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggagggctggccacgcaagtgtcacatgcgatctacattaatatcaagtcttgactccctacttgccgtcattccncacaggacagaggcagagtgggtggtgggtatgtttgacagaaggcattaggntgacaacttgncatgattttgacggtaagccacatgatgggtntctnctctgttgnccttcaaancattggactgtgactgtgagaggggcggttgctgagctgagatgtgcctgggaatgaaagtgcgtgagagaccttgcttgataaaggaggggggtaggcttggaggaggggggggggcgggggggaggaggggaggggggggggggtggagagagcgggggggggacgtgggggggggccgngggcgcttggcggtagtgggggggagggaagatgaggggcgcgggttggacgaggcngcagggaggagggcctgggtgtgcgcagagtgggcgcgggggggggtggggcgg

SEQ ID NO: 677906 - DNA, 133 bp, Homo sapiens
  misc_feature (45)..(45): n is a, c, g, or t
  misc_feature (78)..(78): n is a, c, g, or t
  misc_feature (85)..(85): n is a, c, g, or t
  misc_feature (120)..(120): n is a, c, g, or t
  misc_feature (124)..(124): n is a, c, g, or t
ctccccaggagaaatccattttgctgccaaatgtgaccagcaganttgggcagagtacatcatagcacaatcacagtnctgtcanactgccaacgtggcccaaggcatggcgtgcagggnagtntctctggag

SEQ ID NO: 677907 - DNA, 221 bp, Homo sapiens
gcgtcgactgctgtgagccatgacggcaccactgcatatcagcctgggtgacagagagagaccctgtttctgaaaatgtaataatgataaaatgtacatcagtgtaggaggctgagcatcgctgcggggagggggtgttggctccagcacacagacgcctcatgcacaggccgagggacctacagccaaggccgtggttctgggaaggctccaccgttctg

SEQ ID NO: 677908 - DNA, 534 bp, Homo sapiens
  misc_feature (54)..(54): n is a, c, g, or t
  misc_feature (57)..(57): n is a, c, g, or t
  misc_feature (64)..(65): n is a, c, g, or t
  misc_feature (75)..(75): n is a, c, g, or t
  misc_feature (81)..(81): n is a, c, g, or t
agtgggtcctcgcctccttcgctgctctctgtgcatgtggctcgggctcctctnctngctgtcnntgcctcttcntgtgantggtggcgtccaggttcctcctcagcactcgcatgtcgcctgcctcttcatgtgaaatggtggcgtccggggttcctcctccagcactcgcatgtcgcctgcctcttccatgtgaaatggtggcgtccagggttcctcctcagcactcgcatgtcgcctgcctcttcatgtgaaatggtggcgtccggggttcctctccagcactcgcatgtcgcctgcctcttccatgtgaaatggtggcgtccagggttcctcctcagcactcgcatgtcgcctgcctcttccatgtgaaatggtggcgtccggggttcctctccagcactcgcatgtcgcctgcctcttccaatgcaagaatggacgtctatgcaagaatggacgtctatgcaagaatggacgtctatgcaagaatggacgtctatgcaagaatggacgtctatgcaagaatggacgtct

SEQ ID NO: 677909 - DNA, 132 bp, Homo sapiens
tgtatatattgatctaacaaatgagtccaggagtggacgttagaaaggaaggagtagaaagaatttaaaacagcagagaacagctccactgggaggcccagtgtactcctattttgcagtagaaatgagggg

SEQ ID NO: 677910 - DNA, 725 bp, Homo sapiens
ggtaactgaaaatccacaagacagaatagccagatctcagaggagcctggtaagcaaaagcctgaagaacggtgcctaatttacagcaaccatgagtacaaatggtgatgatcatcaggtcaaggatagtctgagcaatgtgagatgtcacttagacatgggagttatccattgatgaggatgaaatgcctgatttagaaaacagagtctgtggatcagatgtgaattcctagataccaaatacagtgtgggaatacacaagctatagcctatgtgagacagctgaaaggggcagaatgaggaagccctgaagagcttaaaagaagctgaaaacttaatgcaggaagaacatgaaaacaagcaaatgtgaggagtctgggtgacctggggcaacttgtgccgtggatgtattaccacatgggcagatctggagaagccagagttacctggggacaggtggatgaacattgtgcaagaagctttcaaatcccttcgcgttatagaatggagtgtcgcagaaattagactgtgaggaaggatgggccttggttgaagtgtggaggacaggattatgaatgggccaaggcctgcttgtgaaacggtgcttgaaaggtggaacctgtgaaaaccggattcagcgcgggatagggaaactctgactatacgtggatggtgtacttaggcgaaaaattacaagccattgtttgggtccctaaggaagttac

SEQ ID NO: 677911 - DNA, 264 bp, Homo sapiens
actacgtcgcatatctcttacaaatgtagtataaatgttatggatgaattaggaaatattggcatagtatatggtattagtgaaaagacacaacttcacaataacatataaaagattaacatgaaactattacactacttaaaaaatattttctcccatattattttagcatttttgactagtttaataatatgaacactgccaaaaaatgggttcaaagtcgcctggagaaacagtttcttcttctggatatgcgacagtggt

SEQ ID NO: 677912 - DNA, 275 bp, Homo sapiens
cctcaaaaaaaaaaaaaaaaaaaaaaggaaaatggatttgactttataaaatagatagagtggtgttagcctttatattgtaggcatttagcactataaattttcctcttgatactgtttttgctgcatcctatagattttcatatgttgtttctatgttttcattaatgtcgaagaattttttgatttctgccttaattgtatggtttatcccaaaatcgttcaggaacaagttgtttaatttccatgtagttgggtcttcttggtattgattt

SEQ ID NO: 677913 - DNA, 397 bp, Homo sapiens
tatcccctctacatgtcactgtgaccttggacgtgtcctttaactttagttgtctttcctaaatggggtacaatacatctactttagtgtgttcagcataattcttagcataggttcttaactatcgtatatggcacaaaactgttcagaatttgaatttgtccatgttcacatttcctaacttctctgaacctcatttccttcatttgtctagtggcaattaccacttggagggttgtgtattgtttcattgagattatctatatcaaagtgctttgtagattttcagtgctatctaaatcttatttttggctgctgttattttgtatagtatttttttccaaagacaaaacttctggagttactacttacagagtctagacctgagcaagccagg

SEQ ID NO: 677914 - DNA, 489 bp, Homo sapiens
  misc_feature (212)..(212): n is a, c, g, or t
agtccgagtggagagagcgagctgagtggttgtgtggtcgcgtctcgggagaaccggatagcgctgtggctgtagtggctgagcctaactgatctgatagaggcagattgcagaattcaaagaagctttgttcactagtttgagcaaagatggtgatggaactatagacaacagagaggaattgggaacctgtcaactggacggatcctccntgtgggcgagaattcccagcatgaagcagagttaacaggacagtgatgaatgaagtagatgctgatggtaagtggcacaattgacttccctgaatttgctgacaatgatggcagagaaaagatgaaagacactagacagtgaagaacgaaattagagaagcattccgtgtgtttgataaggatggcaatgggtatattagtgctggggaacttcgccatgtgatgacaaactgggagagaagttaactggtgaggaagttgatgatgtgatcaggga

SEQ ID NO: 677915 - DNA, 211 bp, Homo sapiens
aggcagtgggggggggtcacgcgatgctactcgggcaccttgaagccacagctggcctccacatgaacgcgcacggtcccaatgcgcaggaatgtctcgatgttgtaccatgtgctttctgaagcattaaaacattccgtagtttttgagcagggcgtcctggttgtgcgagtttgtgtcacaattgctgtaagtctgcttgagtgatctg

SEQ ID NO: 677916 - DNA, 113 bp, Homo sapiens
gctctggtagctgtgacggataagagaccagccactgccagacgctcagtctacactgagtgcactcaatggatgaggtagagttttgcaccagtctgcaatgaacccacgcg

SEQ ID NO: 677917 - DNA, 945 bp, Homo sapiens
gctaaagctagccccaaacccactccaggcttactaccagataaacttagacagaccatttacccaaataaagtataggcgatagaaattgatgacctggtcgcgaatagatataaaatacgcggcaacgggaagagatagaccaaagttgtacccaagcatagtatacgcaaggactagaccctcgtataccgttctgcagtataattgaattaacgtatgacatgtacttcgcagatggtagagccaagagcttaagaacgccccgaaaatccatgagggagcgtacctaaggaacagcggtaaaaagagcgagcaacccgtcgtatggtagcaacaatagtgggccatgcacttcagtaggtagcaggcgacagaacctcgtaccgagctctggtgatatgcgtggttgtgcgcaatgcataggaatctgtagttcaactcttgaagtttgccgcaccggacaccactcgtggaaatccactcttgtggaattgtaaactgtttaggtccaaatgaggaacagtttgcgttgggacaactacgggaatcaaaggcttggtagaggcatgacgtaaacaaactgattagcaccccataggtatggtgatacataatgctagacaccagatttaaagaacaggcgtgggcggatgctcaagacccattagctgaaaatgtcccaatggcataatgagctgtgattgcctcagcacgtcatgtgtggggccacttctatccacccttatagaaagaaccctcagtgtgagctatgccgtggatgcatgacaacattgctccttctcattaagacttgtggtcgtattattacattgaagactgacaatcaaacagtggcactttgtagcatccaagaccaataggtgcgttaataccctcctggttcaacccaacagaggattcccataaggacacaggtctaaa

SEQ ID NO: 677918 - DNA, 1704 bp, Homo sapiens
  misc_feature (374)..(374): n is a, c, g, or t
  misc_feature (379)..(379): n is a, c, g, or t
  misc_feature (486)..(486): n is a, c, g, or t
ggacacttgacggttcattcctgtagcgctgacgaaggcagaacgcgagtgcacaagtccgagcaggacgtatagaggttgattcggccttaaacaagcgctaagttcgcgagtcaagtccaatgccttcgaggaagaccgagccatagtcgaaggtacccagtggtgacagtccgagttagccgtgggcccccagccgccttcgaaaccaactccacccaagatgctagggcgcaaggtggtggcatagcgctcgcaaagcgcgaaatcgaccccagagtgacccttcggctgatcatggtatccacctgagccaatgtgggactccatcatatacggggaacccatttgcatccatacctgaacgtctacgncctgnggtattggggcagcgaatgtaatatgtgaaggatgacacaaacgacgtggaagcatcacggtcgttttctagaccctatgggaatcggcgtacacacacgtactagncctattcaaagcccttctgttcgagtatggctgggccaaaggggccgtagccacaggaacaccagcaagggaatgtaagattttatgtaccgaaacgtgccttggctcgtatttatccgcgatcgcagccgaggttggtcggagagtggcaacctcctttcctccacgccaatgtctggtatattgccaaacacgggcgatgtatccgactctagagtgcgcttttcgtcttaaatggtgagtgtactcttggccttcttgcgcatacaaaaagagttagcgctgtgccctcaccattacgccaaaatagcgtcttgcctctatggagcaagtcccgatttccttgctttagtccttttaggcgcatatggcgaagctaaaacacaattgtaataaggctccgtccctaaaaagccccccggtggggaagcgttaaggttgcccgttaagccgcaactgggaaaacccgtgtggccccgttctttcagaatgtgctgtgtgaacgaccctattattactgatgagacaaccgaccaaacctttcgcgaagaatggaggccctcataaggtaaaccggcgttctatacaccccttagaggttgaaaaccattttgtttcggcccttggagggtatggtgaccagacccggggttgctctttacaccgaatggacccttagggttccggaaattgccaaggttttgcgtcggaaacggaaccacggattgtgcgcggacccaattagtggccaagccttgtggggaggggacattcggatgaggcaacctagggggcgaatttctctgacgctggggctcgcttcgggaatcctttttggggggggccttacaattgtattcggcacttgggggggttcccccttttggggcgcaatttctttctcccccatgggtggtaccattgtattttggcaagggaccaagaagcgtccggtgggaatccaaaagatagaaaccatttccaaattggcaacaacggacatggaaacccaacggttcccgccaagggaccagatttccctcacaatataaaagagcagggaatccgagagaggccttttgtattggaaaatttgaagagccggggggcctgggaggttcccacggcaatgttggggccccttaaagtggggggcaccactttggcgccccttggatttccaaggggccgccttggaagaagggcgatccattttac

SEQ ID NO: 677919 - DNA, 275 bp, Homo sapiens
tcggtggacgttgtatcctaaccataggtggaaggatggagacgggagcgaggtggtctctccaccagcacattactattcatctgttccagtgacctaagaaaagctgagcgaggaagaaggcaaagactggctgccttggaggggtcacatgagggagacctgtgcctgatttcattaggaaatccattctgttatttttatggtgctgttggctactttatcaaaaaacccttcaatagcatccttaagatttaccaacaacacgaccaaca

SEQ ID NO: 677920 - DNA, 133 bp, Homo sapiens
cggtcctcgtcgcttcctgcggcacgtttctccttctcctcctcatcctctctggtcctgatccttgagccgccgctgctgcatgatgctgaagtgattcagcaacaaaaaaggaaagaagtgcgcctgggtg

SEQ ID NO: 677921 - DNA, 183 bp, Homo sapiens
tagtccgtgatgtctacacagctactctctttgctgcaattaatgtctttttttttttatttggaaagagagtctctttctgtcccccaggctggagtgcagtagtgcaatctcggctcactgcaccctctgccccccagaattcaggcaattctcttgccttagcctctcaattagctgtga

SEQ ID NO: 677922 - DNA, 169 bp, Homo sapiens
gctcgccagttcaagctgaatttttgtcatatctatgttcctataacatcattttacatactttttgattccataatgaatctggaatcacataaatataagtcctctctttaaaggtacagagaaaagttatctttttttttttttttggaaaagctgtggtaactgg

SEQ ID NO: 677923 - DNA, 122 bp, Homo sapiens
atcccccctagtcctagaagtttcaatagcatataactattacaatgctattctgctgactttctgatttgtaaaagcttatgtatatatgtgttaaacataacctttttaactacgtactt

SEQ ID NO: 677924 - DNA, 363 bp, Homo sapiens
cttgtctttcaggactcaactcaaaaacatgtttctcagaaactgctatctgacctttttatcatagtgattagaaattaactcagtcttgcttatcttgccatcagaccatgagcttctccaggcaggctctatgtgtttggttttacttaccccagatgccctagaacataccttggtacgcagcaggcattttcattaaataaagacacataatttcattggagaaattattgtaatgttttcagctaagcatcaaacgtatgaaatgaatgttagctgtaaaacaacacaatgaacaacaaaccacaaatgaaaagaaactcaaaataataatgggttgcaaagcagaaaatattctta

SEQ ID NO: 677925 - DNA, 627 bp, Homo sapiens
gagagagagagagagagagagagagagagagagagagagagagtgagagagagagagagagagagagagagccgctccgctcgtccgctccctcccccgcgccgtgcacgtcttggttcgggccgggcatgtgatcgcccgtgcgtttagcctttgcccacgcagctttcatacatggcctccgattacccgcgcatctgaaagccagcccctgacttcaaggccacagcggtggttgatggcccctccaaagacgtgaagctgtctgccttcaatcggaagttcgtgctcctttgtctctacccctttgacttcacttttgtgtgccccaccgagatcattgcgttcaccatccgtgcccacgacctttcccagcttcgctttgaactgctgggcgtctcgatggacttttaattcaccccccccgctcggattcacacccccccggaatgagggaagctttgtgccccctgacattcccccgcttgcttgcatgaccacacccctttcttaggatttcggggggccttaaacctattatggcacttgccttcgccctttttttactcattgcgggggtccctctgcccatcactgtttatgttttgccccttgtcccctcccccc

SEQ ID NO: 677926 - DNA, 165 bp, Homo sapiens
gtctcttctacatgtactaacctcttctttcttttctgtgttttggttttgttttgtttttttgatagagtctcactctgtcacccaggttgcagtgagttgagatcacacaaactgcaacctctgcctcctgggttcaagcgattctcctgcctcagcctcccg

SEQ ID NO: 677927 - DNA, 116 bp, Homo sapiens
taccatcgggggtatgctgttcgaattcataagcaacagtgcagttgcagctggtacctggttggcagagatcttggtgagtgaaggtcttggtgcagtgccgcatgcaaaccatg

SEQ ID NO: 677928 - DNA, 991 bp, Homo sapiens
  misc_feature (447)..(447): n is a, c, g, or t
ttacgccggtgctctaaatgtgccccagactgccgaggtgttctcacagcatgcccttgcaacgtgtgccaccaccccgcggggggtcccgttagcccaccacgtgtgttcctcagatgttccccgtgtatgtgtgttcgactggacaccctcacgcgtgggtggtgtcgcggcgcagcaacctgtaccctgcgatggacggtccgtcgccccacagtgtctgtcaacacagcttgtgtgaacaaggcggtagtcccccccattttccccaggggagcacacttctcgttggtgcaccacagggtcatccccgctgctctgctcagaccctggaaaaggagccccgctgttggtgccactcacgctctggcgcccggacccacttctttgctgcccgcagtcagtgcgccccgcggtaccctatcctcgcgggctggcggttagagngctgtcccacgacccaaccggggcagcgtgttctctcgtatatttgctctcacacccggggccccggtccctgtaggttgtgtgcggtattgcccccggcctgcttccaacgtttgtaccgctagtgcgggcacacacgcgcgggttaagacccggtgttcgaattcttcgctcgcgggtggaagagtcttgggttgtgtcccttcgctccgcgtggtaacttctctgcgcggccccccagtacatcttgccgcggcgtttttcgtacgcgccgccgctgggcacaggcttcccgcggcgttcttgcacaggtttcgaggggttcacccttcgcgaggtcccaatgaggtaccccacagaccctgccgctttctcaaccgcgggtgtctcccaattacacgaggcctggacccaacccgcgggggtgggcaacagtgcaacccccaaaaaagtccccgcgggcaggtccaaacagtgggaaagaggtccccgacagggccaacaaaaataaatcaaagcggcccccgaaccgaccatggacgac

SEQ ID NO: 677929 - DNA, 258 bp, Homo sapiens
ttcagacgctaactatgtgtagtgggctaacactgtgaagccactgtgtctccatccctgggccacttagcaagacctcatttctaaaaaaacatactaagaagatgatggttactaggtgagaagacatggtgaatttgggattaaaccaaacctctaggactgatagtttccctttattttcctagttttcaggccctatgctggatgtctttgcatgcgtcatcttattaaatccccacatagttcagcgtctga

SEQ ID NO: 677930 - DNA, 108 bp, Homo sapiens
gcctgttaggggggcagaaggttagcacgtcacttcttgattgtagtgaactgaggcaagctagtccatcttcagcgccatgacggccataatctcttgacgaacact

SEQ ID NO: 677931 - DNA, 203 bp, Homo sapiens
ttcgtttattttctaaactcgataggctcattctactgtcttctccaggtctcttctacgaaacagttacaaacctacggccaggccaggcagtggctcacacctgtaatcccagcactttggaatgctggggcaggaggatcacttagaggtaggagctcgagaccagcctgggcgacaaaagcaagactccgtctccaaaa

SEQ ID NO: 677932 - DNA, 994 bp, Homo sapiens
  misc_feature (47)..(47): n is a, c, g, or t
  misc_feature (73)..(73): n is a, c, g, or t
  misc_feature (92)..(92): n is a, c, g, or t
  misc_feature (170)..(170): n is a, c, g, or t
  misc_feature (219)..(219): n is a, c, g, or t
  misc_feature (243)..(243): n is a, c, g, or t
  misc_feature (263)..(263): n is a, c, g, or t
  misc_feature (274)..(274): n is a, c, g, or t
  misc_feature (279)..(279): n is a, c, g, or t
  misc_feature (295)..(295): n is a, c, g, or t
  misc_feature (300)..(300): n is a, c, g, or t
  misc_feature (315)..(315): n is a, c, g, or t
  misc_feature (330)..(330): n is a, c, g, or t
  misc_feature (337)..(337): n is a, c, g, or t
  misc_feature (368)..(368): n is a, c, g, or t
  misc_feature (373)..(373): n is a, c, g, or t
  misc_feature (397)..(397): n is a, c, g, or t
  misc_feature (422)..(422): n is a, c, g, or t
  misc_feature (441)..(441): n is a, c, g, or t
  misc_feature (449)..(449): n is a, c, g, or t
  misc_feature (464)..(464): n is a, c, g, or t
  misc_feature (467)..(467): n is a, c, g, or t
  misc_feature (475)..(475): n is a, c, g, or t
  misc_feature (493)..(493): n is a, c, g, or t
  misc_feature (495)..(495): n is a, c, g, or t
  misc_feature (567)..(567): n is a, c, g, or t
  misc_feature (578)..(578): n is a, c, g, or t
  misc_feature (599)..(599): n is a, c, g, or t
  misc_feature (605)..(605): n is a, c, g, or t
  misc_feature (624)..(625): n is a, c, g, or t
  misc_feature (653)..(653): n is a, c, g, or t
  misc_feature (740)..(740): n is a, c, g, or t
  misc_feature (743)..(743): n is a, c, g, or t
  misc_feature (858)..(858): n is a, c, g, or t
  misc_feature (892)..(892): n is a, c, g, or t
  misc_feature (982)..(982): n is a, c, g, or t
cgcaggcgctcggggttggagccagcgaccgtcggtagcagcatggntctcctctttctcctaccccttgtcntgcagggtgtgagcagggntgagatgggcaccgcggatctggggccgtcctcagtgcctacaccaactaatgttacaattgaatcctataacatganccctatcgtatattgggagtaccagatcatgccacaggtccctgttttnaccgtagaggtaaagaactatggngttaagaattcagaatggantgatgcctgcntcaanatttctcatcattatngtaanatttctgatcatgtnggtgatccatcaaantctcttngggtcagagttaaagccagggttggacaaanagaanctgcctatgcaaagtcagaagaanttgctgtatgccgagatggaaaaantggaccacctaaactgganatcagaanggaggagaagcaaancangattgacntatttcacccttcagttntngtaaatggagacgagcaggaagtcgattatgatcccgaaactacctgttacattagggtgtacaatgtgtangtgagaatgancggaagtgagatccagtatanaatacncacgcagaaggaagatganngtgacgagattcagtgccagttagcgantccagtatcctcactgaattctcagatactgtgtttcagcagaaggagtcttacatgtgtggggtgttacaactgaaaagtcaaaanaantttgtattaccattttcaatagcagtataaaaggttctctttggattccagttgttgctgctttactactctttctagtgcttagcctggtattcatctgtttttatattaaganaataatccattgaaggaaaaagcatatattaccnagtcttgatctctgtggtaagagtgctacttagagacaaacctgaatcaaatatgtacactcacacgtcatacagccatttcttagaaangagtgtctgtga

SEQ ID NO: 677933 - DNA, 142 bp, Homo sapiens
tgtggagactggggtctcacctggtagccaggagggtcttgatctcctgaccttgtgatccaccagcctcagccttccaagggggctggggattacagggcgtgagccactgtgcccagccaagaatttttttattcgataa

SEQ ID NO: 677934 - DNA, 895 bp, Homo sapiens
taaatactatctctgtggttagtcgtcctgcggaatcgttcacaaatacacgtactgatcttgatgtatttggaagcacgagataacgatatagcagatgtcaggcaatatttggtggaatgatgacgatgtggatggacggagtagaccacgctaacacgcaacagagcagagcaaccatggtgaccctaaaagacctgcgagaagagtggatactataacatgaagccgcacgatgtctttgcatcacgccattcatacccctgcgcaccagggctcacgtgattctcgagtagcgctaccaggccacgagagaaaagaggattcttctctagagacaagtgaccagctcctgaggaagtgatctctgcaggtccgtagtagaaaaagaagtgtacactcgtatgaaatatctcactcaatacacagtactgagcatagagctctcgtatcgatgacatgttggctatgagagagattttatatggcgatacttacagagcttacttgcagaaagtatgaacgtagtgatcacgactgaaggccatgcctccgtttgcgccaattgatctctgcacatccagcgaagtcttcttgcgggccgcatgaggccaaatctagtgcacaacatatcgagacgataccaaaagtctcccacggttgctaacatgagcaggtggtgcatgtcacttctgcaagcagtatcgaatgaattctagggttctgacggtacaggtaaggaccgaggcccagtgtgacttgatgacattagctgagccatgtcgaagacatagagagcagctgataagggttccacaaaagtgcgacgaatgagtagagcctgttgcgtgcggcaccgaagaagcaacgtggaaaggtgggtcaaagccttgtg

SEQ ID NO: 677935 - DNA, 102 bp, Homo sapiens
accttctttttttcctcatttccttcttttattcctccccacactcatggcccttaccacggtactcctacctatttccccttttaaattaaaaattttata

SEQ ID NO: 677936 - DNA, 113 bp, Homo sapiens
aggaggagaggatctcagtgtgatcaagggggctcctaggcctgagcggggctgggcagcctcagttctgggtgcgaaggacctgtcgtgggtggacaccaccttgcatcgtg

SEQ ID NO: 677937 - DNA, 647 bp, Homo sapiens
  misc_feature (37)..(37): n is a, c, g, or t
  misc_feature (51)..(51): n is a, c, g, or t
  misc_feature (53)..(53): n is a, c, g, or t
  misc_feature (81)..(81): n is a, c, g, or t
  misc_feature (88)..(89): n is a, c, g, or t
  misc_feature (248)..(248): n is a, c, g, or t
  misc_feature (351)..(351): n is a, c, g, or t
  misc_feature (492)..(492): n is a, c, g, or t
acgagacctatcgcccaacactgtttttgaggctctncgttaggatgcttnanctaccatttctttttgtgcaggtggganagggggnncataggttggctgttatattttagtacataaaggtttcagaatcatagagctgtcaaatgtggtattgactttatattcataaaggtactggtttcatctgtaagaggtatgatatgagggaaagttgtgctttttcattcttcttcaactatattctnttaaattgttttgaaaccacagtgaaattgaaggtggtgttctaggaattaagagatttgggaaagcttgttagtcaatcttgctagtgcttaaggaaagcanagtggaattgagtggaattcgaattttagtgtgagtagaaaagcggggatggggaaggagaagggagtttgagctcctggatataaatggtcacctgatcctaaaactttgaaagtaataggagaatgcctagtagttacngcaatagcaggaaagtcttgtgacaattgaattgcagcctcatagaaagaaagctcagtctcattttgccttgattcacattggagctacgtatatctcttgttctctcaggaatgtgggatgggtgagtaccatcatccttgctagcagacggg

SEQ ID NO: 677938 - DNA, 108 bp, Homo sapiens
atctagtgtgtgtcatgcaggagcaattctgttttcccatgagcagcagagtcgagtgttagagtgcaggatcagagcggggagaggctgggctgcagtttgggcggc

SEQ ID NO: 677939 - DNA, 392 bp, Homo sapiens
  misc_feature (392)..(392): n is a, c, g, or t
ggtaggtccataccgacagcacctgtgctgctcgactccccccactgtgtgggtgcataccgacagcacctgtgctgttcgactccccccactgtgtaggtgcatactgacagcacctgtgctgttcgactccccccactgggtaggtccataccgacaggacctgtgctgttcgactacccgccgggtaggttcataccgacaggacctgtgcccctcaccttcctgtcagacggtgcgtgtgccgcttggctccccaccaggtaggtgcataccgacaggacctgtggcgctcaccttcccaccgggtaggtgcataccgacaggacctgtgccgctcacctccctgtcgggtaggtgcataccgacgcgcgtgtgccgcttggctcgcn

SEQ ID NO: 677940 - DNA, 352 bp, Homo sapiens
gcggccggctactactactaaattcgcgggcgcgtcgtcgaaaaaaagaaaaatacaaaaaaaaattggctcacctagtctgtaatcctagtactttgggaggccaaggcaggtggatcacctgagatcaggagttcaagaccagcctgaccaacatggtgaaaccctgtctgtactaaaaatacaaaaaatgagccaggcgtggtggcgggtgcctagcgtaatcccagctcctcaggaggtgggggcaggagagccactcgaaccagggagacagaggatgcgctgagtcgagatcatgccattgcactccaccctgggcaacaacaatgaaactctgccccccgcccgc

SEQ ID NO: 677941 - DNA, 193 bp, Homo sapiens
ggggggggggcaggagcgagcagtggcgcgaggtgccgcgcacaccggcgcggttagctcccggcgggaaagtgggagagaatcaagtcggtgaacctcgcaccccttagccctgggagtgggtaaggagcggcgcgggcgctcccgcgcgccaaggatttagggtcttaaggtctcaaaccgccttagaagc

SEQ ID NO: 677942 - DNA, 332 bp, Homo sapiens
  misc_feature (193)..(193): n is a, c, g, or t
  misc_feature (255)..(255): n is a, c, g, or t
  misc_feature (301)..(301): n is a, c, g, or t
tagatttgtatttattcatcctatgtgggtattgaggagtatgctaagattttgcgtagctggtgtttggtttaatccacctcaaactgcttgttatgatggataagattgagagagtgaggagagggcttacgtttagtgagggagagatttggtatatgattgagatgggggctagttttttgtcatgtgnagaagaaagcaggccgggatgtctagagggggtgccttggggtaaccctctggggactcagnaagtgaagaggggggctattcctaagttttatttgctattagcctnattatgtattattaatgattgagtatttgat

SEQ ID NO: 677943 - DNA, 147 bp, Homo sapiens
acccctagaaggaaggagaaaaccacgtagcagcttattaactacacccgtgagaccacttgcgacgtgagagatttacaggaacccttccaggagcccactgacgttggagtgctaaaaatgccccttcagggggtaaactgcatt

SEQ ID NO: 677944 - DNA, 429 bp, Homo sapiens
accgtggcatcacactggggctgctggccgtaccagtgcgcggcctgcggcaatggccttcgggtggcgctccacgctgctgaaacatctgcagcagccacagcggggagagcgcctgtaccactgcccggtgtgtggcaaggccttcgggcagagctcgatcctggatacagcaccgtgcgcatgcacagtggtgtgcgcagacggacctagcaagtgcccagcatttgcgccaagggcttctgggacatgaggcatcagcgcgtgcgtccaggacacctgcagcggtgcattaatcgggctgaagcgtcccgtatcgctgtcagcatctgcgcggaaaggccttcagggcccatagccttcaatgtccgtccaaccgaaagcgaccgcagacgggggctgcccttgcagagggttgcaactaggccg

SEQ ID NO: 677945 - DNA, 313 bp, Homo sapiens
tcggtacccttctcatcagctcataaaattaccaatatattatcgaatatcatgcaaaatctaggtccacattcaagattttcgtcaactggctcaccaccgtgctggcgtcccagagcccaccccagtcttttacagatggtttatcaagaagagtccagtaaatatatttcacattgcagtttgagttattacagtaactttgaatcatagaagagttacccagttccactgtccttttttcttgcccaacacttgatattttgaagaaatgaggccagttatcttctataacgcttcacattccagatct

SEQ ID NO: 677946 - DNA, 371 bp, Homo sapiens
  misc_feature (64)..(65): n is a, c, g, or t
  misc_feature (110)..(110): n is a, c, g, or t
  misc_feature (112)..(112): n is a, c, g, or t
  misc_feature (328)..(328): n is a, c, g, or t
gcgctgtcgaattccttcgggttcggcggcacgaacgcccgctgatattcggcccgccgccggnncggcctgattcccggggcgtgccggatacgcccgtccggcacctntngatctcacagggcatccgtccagatagtcacttgcatattagaagtctcaatgttagccttcacgccatgagaacgaccagctttaaatcgatggagtgcccgaccgcgcgcgcactcgactgcatcggcgaattcgtgggacgctcctgatcctggcggggattgcgttaacagggggtgttacacgctttcggacgaatttccaggcgcagttncgggggatttgccaccaataaggttgaacggcgcagatttgaa

SEQ ID NO: 677947 - DNA, 118 bp, Homo sapiens
tagcgatctagaggatctccgaatccgctggacccagattgtagccagactcttcctccatgttccgacaggtagatgttctctgggttgtagagcttgcccgaaggatcaaccctca

SEQ ID NO: 677948 - DNA, 708 bp, Homo sapiens
  misc_feature (101)..(101): n is a, c, g, or t
gaattccgcacgggcaagcagttttgacacggaaaaggccctttatttttaatggcgggttttatacatgcctggatacccggccccaccctccgggtggnaaccgtcggacaaatagaccggaccccttccccccccttttcatggggcccttttacaggcctgccctttcaggacctaagaaagacccggtcccatcctcagacccttcgagacaaaggacaacccaccgcctcccgggtaaaccctggcctctaaattaacacccccgcacgcccgccgccgcgccagcgagcgggccaagccccccccctgaacattctgggtacccctacccggcctgcggtcgcccttacccttcccctctccaccacctcgccccgcccggacacgactttccctccctcaccgccgtcccctccattcccgacgcggggcgtcgctcttctacagccgcgccccacccccttccgcacctccacgccccaaccctcctctccccccccccactccccccccgtcccctgccctcgccctcacgcccccctccgcctcccacccctcccccggctgcaccctgttgctccgctcccccccctcccgcctcgccgcccctcctccccgccccccccccacctccacccgcacccccccgcccgcgcccctctctccatccccactccctctctcccctctcctgcccccctc

SEQ ID NO: 677949 - DNA, 877 bp, Homo sapiens
  misc_feature (777)..(777): n is a, c, g, or t
agcggatcctcccatctcagcctctcaagtagctgggactacaggcacacatcaccatgcccgggtaatttttttgttttttgttgcccaggctggtcttcaactcctcgcctaaagcaatcctcctgagttggcctcccaaagtgctgggattacaggcatgagccactgtgcccagcttcttttctattatttttgttaaagcaaaaaaaaaaaaaaaaaaaaaaaaaaaaaagggttccggtaacctttatttttaaggggctcttttgggccaacccacggttttaccttccggaaaaattttcattgggctaaccccctttaaaaacattccgatggcctattaatatgggagaggccgcgctatatccttgtgcgcctgtgttggcaaaaatcctaaggtggacctggcggggcatatgtggggcccacataatggcgtgtatcccctttgttgctcaccattcgtgggctgtggcgcctgtttgtgtgtgataagcgcccatatttttcgtgccacagtgtctgtgtttgtgtctgcgaaaagaggggagaatactccccaggcagaaagattctcgataaacaccttttccccccttgtggcccgtgggcgtacacaaatatttgcaactccccgcagcttttaaacgacgacctagattttttcggcgtggcataaacaaccaacgtctggtcgcttaaactcctttgaaacgagaggttataacctctttttaagacccccctgtaaatcgttgcgtccacaatacnctgtgggtcgaccctgaaattacacggttgatttatcacgcaaaccaatctttttcaacccactgcgtgtaaagcaccttcgctttttggatttgtttag

SEQ ID NO: 677950 - DNA, 354 bp, Homo sapiens
  misc_feature (27)..(27): n is a, c, g, or t
  misc_feature (50)..(50): n is a, c, g, or t
  misc_feature (117)..(117): n is a, c, g, or t
  misc_feature (275)..(275): n is a, c, g, or t
acttttcagtagatgttaccattaacntatttctaaaattagcaatatcnaaaagatcctttaacgaaaacagtgaattaacactcagacatgttaactcgcctagcgagtgacccnaaaggtaacattgttcattgtctttcttgtcgggggaatcgatcttagtcatattttttggtgcttgatcttgaggatcagaaggattcgagagtatctggtacaattgatagaaaaggttggagcagactgcaatgcttccggggctggaagggttnctggaagatgtactgcaatagatcatttgattccttgccgttctgactcagtattgtttggaattcctgcagcccgggg

SEQ ID NO: 677951 - DNA, 246 bp, Homo sapiens
cagccccacggcaggaccacggaagatcacagttcatcatgggttctggagacttgcggcctaagacaggatgtgcggtacgagatggggagagagcatcgggacagacgtctgtcttgtgaaaacagaaagccagtgctgacgaacgaagtcccctacgctcacctccctcagcttccatgcggctgattccaggtgaaggtgcgtcttgcgtggggcttgctcggtgagcctccctgcctcgac

SEQ ID NO: 677952 - DNA, 632 bp, Homo sapiens
gaaggcttggctcatataaacaagtgccattgagtttcaaatgaccagcaaatatatttagaacccttcctgtttaatgtctgtacctcgtccacccctcaggtaaatagctgcctctcacaggtacagctgtttcttggtaaattcctccgaacctaaagtagcagttttcctaaacttgattagcttgagctgacagacgtgttagaatacagttcgtctggccacgagctgatgagggctttcgtgtactgcacacagattgtgtacttgaccccagtccaggtgactggtacccactcgtagttgtgccagtgcacaatcctgtccagtatatgcatgtggtggccctactgactggtaatggttagaggcatttatggattgtttagcttgtaaggaaaaaccatgacttttaacaaattttgatgggttatatgcctaaatccttatgccacatagtggtacatcattatgagacaatgtgtctgttcataatgggtaggtgccttgggtgagcagggagcataattattggtatatatatggtaattatggtgattatgtaagatatcatgtcatgttaagaaggttgactaacagtttacgtgtgcttatctccaagatattat

SEQ ID NO: 677953 - DNA, 132 bp, Homo sapiens
  misc_feature (37)..(37): n is a, c, g, or t
  misc_feature (102)..(102): n is a, c, g, or t
attcttaggaagggtgacctgcgagggagtgtggganctgggacctcatcctggtccggcgttggaaaccaaggccttgtatgccagcccttatgaaagcantgtttcacagttactttcacttcccgaata

SEQ ID NO: 677954 - DNA, 714 bp, Homo sapiens
gtagtcccagctgctaaggaagctgatgtgagaggatgtgtcagctcaggaggcagaaggtacagtagagccgagatcatgccacgtgcactcgatgcctggacagcagagtgagacccgtgccttaaagaaacagatacaagaagggaagaccccatagttgattgaagatcgtcattaatagaacccttgtatatcagagatatccataggtgaacatcgagaaatacagggtcaacagttctagcgctacgttgtgcctaatttatttccacaagggtcccaaggttgttcaagaaacaattttaaactacagattaaacattaacaattgggtccatcagcagattaatctcataggagaagagcagactggcaacgaattgggaaaattggaaagtaactatgggggacaggggctttaggccatatggtgttgcatggtggtgcgatgatgtggtgtactggtgtggtgtagcatgggaggatattcggtgacataaccaagaaatttcctcttagaaagggcgattccagaagctctggactcaagacgttacatgtttaactctggcgatccgatgacgcttggcgcataagggagttacacatttgtcagttactctcaataaagggcggacaaccattaagggacaaagagcaacatgtctcgtcggccccttttgggcctcttccaagtggaacctaaagcag

SEQ ID NO: 677955 - DNA, 1206 bp, Homo sapiens
gcaggatctgaagttttggggtcgagcaggcatgcttggcatatggatgatttagcgtcattcatccgcaaggcatctgagtgtccatgaatgttaggaaggtcctgtgcgagagcaagggaaagaacatcaaagattatcagcaaaatcgagaatcatgaggcgtggttcggaggtttgatgaaatcctcggcaggccagtgatgtggtatcctggtggctcagtggtcgatctagagcattcgacgattcctgcaagtagaaggtcttccttgctcagaagatgatgattgtgcacggtgcgaaccgagctgggaaggcctgtcgatctagtaactagctcgatactgcctggtagagcatgcatcaagaagaccccgtaccactattccgtggcttgaaggcgagtgtatgctggcccaagtgcaggcctgcgatggagccgactgtatcattgctgtctggagaaacctggcaaaggggacttatcctctggaaggcttgtgtcgcttgtccgtccacctgaattgccacgtggaggcagaaggcttggcattctcacctcgactgtgcgaatgtattatggagggatacatcccagctctgtcgtggtcggcccccatttagcgcagctgaaactccgacatgaacgtccttcccgaccgataagggttgccaggagagaaggccttccctttgcaacagttgtcttgcaacgttggggtgcccaataatatacggtaccgtctacacaaatgttcctgggcaagcggtctgcatctagcctagggttgggtctacgaattaccggaaccaacgttggccgccaccaatcccatttgcttgtgagaccaccggataatccccccatgaacaaggctcggaccagggcaccaaccttggtacaccagttgaccattacttacgccttgtttgcctggtgggctcaggaacaccatggtcgcgaggtgcggccctggtggctgcaggggaccgttggaccctccctggggcttgaaacttttctgggcgtttgtaacttgctgggcactggggcccggaggcttgccttgcaatggaaagggggagacctcgttggtccacttgggggcttgccacggaatgttgtggcccctagcccttcccgggtttttacccttgggccacatggggttttgtgccctagtgccgggatgtgccccctag

SEQ ID NO: 677956 - DNA, 227 bp, Homo sapiens
gacccgtatattttcttcttccgggtctccagggcccgcttggacttctccagctcatggacgttcttgcccacgtcatccttggagctgagcaggtcttccatttcggctttgagcattttgttgaaccgctcgagctcctctttgacttccaaggcctcttcaagggcccgagccaggcacaggcactgtgattgcttctccctggcttctgcctcagctctgtc

SEQ ID NO: 677957 - DNA, 932 bp, Homo sapiens
  misc_feature (78)..(78): n is a, c, g, or t
gtccttccgcttgcgctgtgagctgaggcggtgtatgttgcggcaagtaacatgtcaaccccggcatgtccgcgccantcgatgacccgaccgacccggaatgtgccagcacgcatgcagtgtgacttttccatgcagtgtgattggtgagatactgggtcacggtgtgggcaggaagccttctgcgaggtatcatgatagttcacaagtaatcgataatatagtctgctccgcattgcgtcgcctgttacggcctggttctaccattgagaattattgaatccgtggcgtagtgaccttcagtggttgctgagtattagttgggggctttcaccaaggattcacagggaggatgacagtctgggattcaaatcatggcagcagaaagctatacaccagctttggattggagtcagagaagtagaagaatgggcattgccttctaacaggaaattatgtgaagcggagggttcagctcaggggaggagctgtatctttatatactggcccttatgcacacgagggagaaactggtgagggtgtccacgtgcagctcaggtagctgggcatatccgactatcggggcgttccatgttccaatcaatgggtccatatcggtggatgcataatagagattattcgtagttctccaagtggccaacgggaggattgggtgacgcctttcgggattaccaccttggataggttcgggtaccatcgtataacgggtgggaaaaaaacgttacaaaaaacgaatttgggatgaaaattcccaggccccagatggtggaacccttgttaacaaatccttattgcacaggtcaattgaattgccaaaagcttgcggtgttccaaaccaggcgacacttgcatggggactcggtcccacgagcgaatttcatggtggattacaactcgctaattcttccaaa

SEQ ID NO: 677958 - DNA, 443 bp, Homo sapiens
ctcaattgatccaataacttgagtatagtagttcgctacgcgagggtaacaggaaatgctatgctacagtccatatcaacaataggagtagactacaagtggatacaggaatcccaatggtgcagccgtactaggtcgcgctcacgatcgtcctaccgtgatctagatcagacggaggcacaaccaggatcggctccccgaatctacggtatcagcacgtcactcccatgtacgcacaggcccaagaagcacaataaggcctcacctctcacaaaagcgcctacccccgcacaaatgatatcatcatcacgcgtgaaggtcaagatagcgcacacacacaccaaggaacagggcttccaaacacacaaaaaaaacggggccgcgaggatcaaaatatatacaaagaaggggacacaaggaagacacgacgcacccaccaaccc

SEQ ID NO: 677959 - DNA, 166 bp, Homo sapiens
  misc_feature (64)..(64): n is a, c, g, or t
tctgatagtcttgaaaagccacgtctcttcttggccgggcagtttctcttccaggtcatcaatngtcttttccagtttgcaaccgttctctctgcaaattcagcacgggtctcagcctctttcagttgtcagacagaagtttaatttcttcttcacattggtcctc

SEQ ID NO: 677960 - DNA, 235 bp, Homo sapiens
tagagatccccgtagtagtgacgtgctgcgggacttgcgaaagtgctgaccatcgagacgagtatataagcagctggacaaataccttcaactgagaaatgtcattagcgactccaggaagctaagcactcggagttatatatgcaggtggatttggtctgtaacttcttcgtagacacagtggtcccagatacttcaggcatctttgtggccccatggatatggttatttcctg

SEQ ID NO: 677961 - DNA, 352 bp, Homo sapiens
ctcatgtggctgatactcaccaacttatgtagccaggcttactacctatattgacagactgttctctccatttcacagttgaagtacactttccattgaacattgaagtttggaactacttcttcaacgtttcagtatactcactgaaactcaaagagcctcagatcacatgtgaacagttttgaaacaaggctgtaccatggcattcatgcatagcatgggacagaagaaatagcacggcatgtaactgtgatgattacttccatttttgtccctcggagagaacagttcacggggcagaggtgatatgttctgcctttagaagattactggcacatagttcagcgtctga

SEQ ID NO: 677962 - DNA, 329 bp, Homo sapiens
tgatcccagagctaaaaaagcccaaggcagacccataagcttaggtcaggggttcaagaccagcctagacaacatggggaaactctgtctctactaaaaagataaaaattagccggacatgggggcaggtgcctgtagtcccagctacttgggaggctgaggcaggagaattgcttgaacccaggatgcgaaggtcgcaggggcagagattacaccactgcactccagcctgggtgacagagcaagactcgccttaaaaaaaaaaggtcaaaaagaacaaaatttttttttaatcaagaatttaaaaattaagaaaatgaattcagcag

SEQ ID NO: 677963 - DNA, 643 bp, Homo sapiens
cccctggtggcctggcgtcggcggggtcagccggtgccatgctagtggtgccccagatactcgggtctggccgcgcagaggtaagctgcgggctcgagggaactcgtacctccgtggcgtacttcagccttggcaccgaggggtggctcactctgctgctcagtggttgcagatgtgaggcggtcgtgggtacctgattcagactcggtaagcggtagtcctacaccaagtcaaggctgatcttgcgaggcacgacgcgcattcgcataggtgggtctcccacggaggctcattcgacggcacacttagctggcctgaggaccgagagagtgacccacccgcgaagtcacccctcttcgttggcgtcgcttttccatccattcgaaacaagaggagggcctcttatggcttgaacacgtataagttcagtacgtagcacaccttgctttccttcacgtagcacttagcggatggacatcgtggttccgtcccgaaggagctgcaggggcctcaaggcccttgattggtaagtccgcgcaaagcgccacagctagagttaaagagcaagctcgttggagccagccagtttgacgattctcgcccgcgggtgaggccttggccgggcggagccctagccagtgtg

SEQ ID NO: 677964 - DNA, 981 bp, Homo sapiens
cgtgtcccgtattcctaacacttcttggagcggttccagtctctgtaccttgtgctacatcgtccattcgtcagatatgacatggggtttcgccagttgatcgactttcttgtgagattacagtcaaatctttgtctaaagggactagtcgccgacgcgatatttgaagcttcgtgtgtgttctatggagtcttagtatctctatgtatgctctgcttggagtgtgttattctctgtagttgctacttagtctagtgcgactgttgtagggctgggtagggatatcgttgttggacggtgggaatgttgtcaggtatcatccgagttgttgtaggttttcaaaaggttattaggtgtaggactagacgatgtgacagtttggaattatgcatgctatagtatcagatgtgcattgcactataatagataaggatagggctctgtggaacatgtctgcttgcgtatgtgaataatggagagtgctcttatctggtcaaggtttgtctggaagatagagggatctgttgagttcgggttgtgttattgaacgtagaagtcatattgttaatctagcgatcagataagaagcagagaataattattttatgttataactacaccgatgtattaaaagacccattatgcaaaagattcaaggtacatcatgcagttcgacaagctattgaacaaaatctggattccattatatagctctttccttgaggagattccagattatcaacctgaattccatgcactcagtgtgcgaagaggaatgtgttaaatctcactgcatcattgaactggccagttcagaaagaatcggataggatgcctcttcgtcataaagttgtcaagtagcacttcgatccataaactgctgtacattaaatttatttaaatacttcaattagcaaaggagtaactatctcaatgtaaaaagttctatggcaaaaacaacgtgttgccataaagacgtta

SEQ ID NO: 677965 - DNA, 882 bp, Homo sapiens
tatcatccaattatttggattggagaagagggggcattcaacgtcctctttttcttatgttttattggaaatagagtctcaacttactctagcctgggtgacagagcgagaccttgtctcagaacaacaacaaggtgctggaattgcagacttgagccacagtgcccagccgtcacttctctagactatgatggtgttgtgtcatggcattctataagtctcttttccaatattgggttcaacgattttgtgaacactattaatttcatcattcagtatatgtgggctttctaaaatatgccaatgtgggttccacttaatcaagtttgacttaatttaacacagtgattatatttcaatagttacatttctgtatcttccactcactagccagcttacagtttattagccctgggatttcagctgactatatgattcatgtctgcagcccttcatgatgagttctttctttacgtatacatactgttgttcaatgatgcaagaacaggcaaaaaactactctatggtgatagggaatcagaagtagtaatgggctgaggaaagggtatgagagaacttgagagaacttcctcggggtgatggaaagttcttatattggaatggggtaataagtgacctagttatatgggtctattcagttggaattcctcacactgagcaatttacttggggtattacatttgtggatagtgccaagtaaggtcgggcacaaagaaattctgctgaaaaaaagactcttttattaagccatctgttttataaggcgtgagggcagggaacatatgaaaacggggggggaaagcacatacggggtggcccaaaagaaaaattgggggcggaaaaggggcggggaaaaaaaaa

SEQ ID NO: 677966 - DNA, 112 bp, Homo sapiens
tccaaatggtttatactttgacaagagacctattcattcacatcttcaaagcccatgttcttgtttctctgtgagatatgttgatgaaatcacaaatgtaaacaacttggta

SEQ ID NO: 677967 - DNA, 769 bp, Homo sapiens
gaagatacaacattaaactatggaaaagtttcacagactgtatgtaactgtttaccgatagcagccatcgtggaagtgagaagatattctgctgttcatggacggttatatcaccagatcttcagatctatgtgagcagttattcggcgagattatgcgaaccaacatgatgtaccagaatcaatggtcttctttgtgatcttttgtggtctgaccccgcataaagatgtcttaggctggtggtgaaaatgacagtaggagtgtccttcactatttggatgcagaagtggttgcaaaatttctccataagcatgattcggatcttatatggtagagcccatcaggtggttgaagatggactccatgaatcttttgccaagaggctaggttgtgctcactgctgtcttgtctcgcgccctaacttattagcggagagagtttgacaatgcaggtgccatgatgaggtgtggattgaaacactactgtgttctttgtcagatttctacaacgcctgcagtagaaataaggaagccaacaatgccacgaggacctgtaaggccgtccaaggcggtatgatcacaaaggcaaagtagaagaaatagatcgtccgtttttgacactgcctaatcgggacttgtaaacatacgagtatataaccttcatttttaagactgtaaatgtgtacttggtcagcttgctcaaattagatctggtacgtgaggggcccttccctccatttttgattgagtgactggcttctgcggtccaa

SEQ ID NO: 677968 - DNA, 453 bp, Homo sapiens
ctttgagacagagccttgctctgtctcccagactggagtgcagtggtgtgatcatggctcactgcagccttggcctcacaggcccaagagatcctcctacctcagcctcccaagtagctgggactacaggcacctgccaccatgcccagctaattttttttattttttgtaaagacagagtctcactgtgttgcccaggctggcctcaaactcctggactcaagtgagcctcctgactcagcctagggtgttgggattacaggcatgagccactgtgcctggcctgatttttcttctttaaaagaaatatttgatatttcttggtttttctacaatttcccaactcaaaaagttgaaatattaatatgccccatttctaaaggaccatgaccgggaccctttgggaccacggccaggttgctttgagggcgcagttttaagggcaccctccat

SEQ ID NO: 677969 - DNA, 108 bp, Homo sapiens
gactctagaggtcccctcccaagatgagaaactgtcagcaatgtttaatatctatgtacaaatcttattaaattgccttcaaaaaaaataaaaataatgaaacaattc

SEQ ID NO: 677970 - DNA, 111 bp, Homo sapiens
agatcagctcggtaccaatatctacaatcaaccaacaagtcattattaccctcacgtcacccaacacaggcatcttcataaggaaaggttaaaaaaagtaaaaggaactcg

SEQ ID NO: 677971 - DNA, 186 bp, Homo sapiens
agataaaggaagccgcaagctgttgtcttgcgggggcagtgtgggtgcttcgcttaagtttcaggggagggacggtaggtctccagcaagagaaagacttggggcttcagttgactcaacacggtaattctgaccctccccggacacggacaggattgacagatagatagctctttctcgatgcag

SEQ ID NO: 677972 - DNA, 137 bp, Homo sapiens
tttttttttaaaccccccccccccccggggccccgggggggggggtgtcccccctttctttttgggcccgcccaaaggggggggtttttttgggggggggggtttttttcctttaaaaaaccccgggccctgtttga
